United States Patent 10,233,495 (METHODS AND COMPOSITIONS FOR SCREENING AND TREATING DEVELOPMENTAL DISORDERS) - sequence listing, part 16

SEQ ID NO: 57 - DNA, 501151 bp, Homo sapiens
tgaaaaacaactgccgtcctcatagtcttcaatttacaaaaaatcatcttgttcttccaaattttcgataagttcttgaaatttcaaatattttccccatagtaacctttgtatctgatcaagaacagtgatatattatatattgacaataatatttttatccatttatttagtatatatatcaggggtatatttctatgggaaaggaatagacaaatactgacttttatgtgtcagaaatgctattgtatttaataattaaaaacatgctttgagacatgcattaaaattattgatttattgataagacaaaaaattcaaagagattagtttctttaattactcacaataagaaggaagaatgtgaatgaaatataaaattctttcctatacactcctctattttattgttagattatttagaaagtaaaaacaagaatatcatgctgtcttcaaagaaattatattttggtcagtggtataaatcatgtaaattaaaatgtattaagtgcagaaatatgtacaaaactgtagatacacttccattttatttatttattaggagacagagtcttgctctgtagcccagactggagtgcagtggtgcgatctcagctcactgcaacctcccaatcctgggttcaagtgattctcctgcctcagcctcctgagtatttggaattgcaagtgtgagccaccatgcctgaataatttttgtatttttggtagggaaggggtttcacctcgttagcctggctggtctcaaactcttagcctcaagtgatctgcctgccttaggcttccaaagtgctgcagttacaggcatgagccactgcacctggcctatagatacactttcagagaaaaaaagagattattttggtatgagatgatgaatcaaaggattctttgtaaaaagtttagaatttgataacagcagacacatatcagatgaaaaaatattttatgtgcaagggatattgtgagttaaatcagtggggtgggaagaatttaacgtgtggcttttaacgtaagaataataaacaatttgtaagtattttatataatccagcatactctgtatgaaatggagaaaactttttctatcaaaatgctgtaagaggaaaaatattagagcaactattttcactaatatgcttaatcacataatattaaaaattttggaagaaagtttccatcctacatttccattaaaactaaaataataaatttcaatgaaaataattcctacttgagttttgcaaaggagaaacttgagtcttattactataattttcatcattttaatatacaattttaatggttttttaaataaactttcttcaccagatactaaatattttatcttacttttttctcatttataaaattcctttggggctgaggaaaaagtgcttttcaaactttacagtattttataaacaacaaaggtagcattttatctgctaccattttacacttcactgctgcacagaagtgaggaggcgaagtcatttggggatctgggcattcactttcttacaagaaggttactttccaatattggacaagtatagagttttccaaagaggcatatttcattcaggttgcacaatcagtgtcaaggtcccagaaggtcattatccttttcaagtcagttggaatgacatctgcctcaagcaacctagaggcacagctgattgttctatagtaagaatataaacacttcctgtaacttatgtcagtataagtctggtggtagaagagatgcatttgggaagaagaagaaatagaaagcaagtttatttactttaaatatacttataatattttaagtttattatttaaaatattacaaatggaaatatatacacatggctattaaaataagtgtggttttaaatttcaaagcctcattgaagagttggatgacagcaaagggaaaacacttaagtccatgttcattgctaggtttctagattttatttcttacaatactgcttatctttgcataaaaaatgaacaaatcaaaaccatatatatacatacatattatgtatatatatatgtgtgtgtgtgtatatatatatatatatatccccagtagagaactcataattcaacctgatacttgttattcttatttttgttgttgctgttataagctctggtccaagcctggacaaaacttttactcccaattcccattagcatgaccatatgctatatttctttcctgctcaacaggaaataatacgcaatgtggtgcttttgcttagaggagctgtggaagatgcaactaaaacaaagaagagagtgtagattcttacaataatccaaattttggctcacattattttccaagctttccttaatgatttaaaagaagatctcattaatcctcttgcaactggaaaatatataatctattccacctcaaaagatcacaagttgaaagggaaccagatcacagaatcaaagctcagccgatagttactccatactataaaatatacaattttattaaaattggagcagattcctgaggcagatattatgattacagtttagtctgttgctgtatgtaaaataagacgtaagaccaagttcggggctttgctacctactgataattgcagagtggctggtgggtacagaacatgagaaagttgtgtggtttttaactatcctatcaccttccttaaaaataatcacttcaagctgggcacggtggctcacgcctgtaatcccagcattttgggaggccgaggtgggtgaatcacttgaggtcaggagttcaagaccagcctgaccaacatggagaaaccccgtctctactaaaaatacaaaaaaaattagccaggcctggtggtgcatgcctgtaatcccagctactctgcaggctgagacaggagaattgcttgaacctgggaggcagaggttgcggtgagccaagatcatgccattgcactccagcctgggcaacaagagcgaaactccatctcaaataaataaataaataatcacttcattcaactcagatgcattaatagatttgctttatattttttaatgacttgcttagaaacattattttcttacataagcccagtaaaagagaataaagctttgatattgatgataaatttagagcatgtacaattgttatttactctcttggtgaatcacaatttccatgatactacaattgacaagttaatttcactattttaatgatcttcatagttcacaaacacacacacacacacacacacttttctttattctttaattacaaagacaagatacttttgctgatcacatttgatacggtttcactgtgtccccacccaaatctcatcttgaaatcccatgtgttgtgggagggacctggtgggaggtaattgaatcatgggggcaagtcttgcctgtgctgtacttatgatagtgaataagtctcatgagatctgatgcttttaaaaagaggagttcccctgcacaagctttctctctttttgcctgctgccatccaggtatgatgtgacttgctcctccttgccttccaccatgattgtgaggcttcaacagcaacgtggaactgtaagtcgagttaaatctctttcttttgtaaattgcccagtcctgggcatgcctctatcagcagcgtgactaataacagtaaattggtcccaagagtgcagcgctgcagaaaagatacccaaaaatgtggaagtgactttgaaactgggtaacaggcaggggttggaacagtttggaaggctcagaagaagatcggaaaatgtggaaagtttggaacctcctagaggcttgctgaatggccttgcccaaaatgctgatagtgatatggacaataaagtccaggccaaggtggtctcagatgaaaatggggaatctgttgggaactggagcaaaggtgacccttgtcatgttttagcaaagagactgttggcattttacccctgccctagagatctgtggaactttgaacttgagagagatgatttatggtatctggtggaagaaatgtctaagcagcaaagcattcaagatgtgacttggatgctgctaaaggcattcagttttataaaggaagcagagcataaaagttcagaaaatttgcagcctgacaatgtgatagaaaataaaatcccactttctgaagagaaactcaagccggctgcataaatttgcataagtgacaaggagctgaatgttaatccccaaaacaatggggaaaatgtctccagggtatgtcagaggtttttacagcagtccctcccatcacagacccaagacctaggagaaaaagtggtcttgttggatgtgcccagagtcccggtgctatgtgcagcctagggacttggtgccctgggtcccagctgctccagccatggctaaaaggggccaatgtagagctcaggccatagcttcagagggtgcaagcccaaagccttggtggcttccatgtggtgtcgagcctgtgagtgcacagaagtcaagaattgaggtttgggatcttccacctggattccagaggatgtttgaaaatgtctggatgcagtggcatccaggcagaagtttgctgcagtggcaaggctctcgtggagaacctctgctagggcagtgtggaagggaaatgtgaggtcagagcccccacacagagtccctactggggcactacttagtggagctgtgagaagagggccaccgtcctccagaccccagaatggtagatccacagagagcttgcaccatgcacagagaaaagctgcagatactcaatgctagcctgtaaaagcagctgggaggcaggctgtaccctgcaaagccacaggggtggagctgtccaagaccatgggaacccacctcttgcatcagcatgacctggatgtgaggcaaggagtcaaaggacatgattttggaaatttaagatttgactgcccttctgcattctggactggcatggggcctgtagcccgtttgttttggctaatttctcccatttgtaatggctatatttacccaatgcctctaccccaactgtatctagaaagtaactaacctgcttttgattttacaggctcataggcggaagggacttgccttgtctcggattacacattggactgtggacttttgagttaacgctgagaagagttaagactttgagggactgttgtgaaggcatgattggttttgaaatgtaagtacatgtgatttgggaggggttggggcagagtgatatggtttggctgtgaccccacccaaatctcatcctgaattgccatgtgttgtgggagggacccggtgggaggtaaatgaatcacgggggcaggactttcctgtgctgttcttgtcatagtgaataattttcacaagatctgatggttttaaaaagaggagttcccctgcacaagctctctccctctttgtccgttgccataaagtacattatatttagaagacaaagaataaatagagaaactatttaggaatatcatgctaaaaagagtgttatgaatttgtcttctgagtttctatgaacatcagtagcaattcatcaaccaatatttaagggccaaatatgaatcaaaatctactggatatttatattcccattacattgattgaagcaatgagtattatttggttgtaatcaaggatataattgtgcaaggtcatgcagactgagagagtaccttatcctgaaagcattatttttaactctcaggaaattatatagttaattagagaaacttgaatatttaacaaaattaggagaaggaaagttttcttgggagggaaagtaaagtgaatatgcaagataagcaggaatcttgtagactatcttgtggcagataccaccattatttctattttagagataaagaaataaaaacataaagtaatatatctaaagatgtgaagctaatcagtaccaaatactagcaagaatgattaaaaagaccctatcaatatcagaaatgtaaaatatcaatttatgtctaaaagcatatctttgtttatgtctaatacatatccaaggcataagaaatagagaaaactaaatacagcaaaatattgtaataaaataatctttatataaaaaatgatacacttacaattcagttggaaatatataaaaaaattcaagctatggaaaactttccattgtggatttatttcaatttttagatatgtatcaagaaataatttataactttagagtcttacttaactgaagcatgatattttaaatttaaaggtaaaatagaaattatgtgaatccagagttaagtagtattatgttaattgcacaatcttactagaattaggaaatgaatgttaatttgaactatggcatatagtcaagcttttaattcgtatttctttcacaattctcattaagaattagagctgatctggctttttacaaatcatcaacattgccaagatggtttggaatagtgcagtgtttcagagcagagaggttcataaggttttattaggtcccatgggagaacatcaacttgttctattctcccccaagaaacaaacaaattcactcagtgaaaaatcctctgtgagtggatctttgcacactgataaggagatggtacaatagttggcattatagaactttgatgatgtggaagaaacacatggaagtcatactttctgggtaaatcaacaaggttagttagacacaaataaacatatttttctctacgagactaattttgtagaatttaaattccacttgtaattatagagaaaaaagtggcaaaatatatactgtctgcatttattcttgaccaagaaaatcctgaaaagtataatactaaaaaatcgaaaaggaaatgctcacgtgatgtaaatattaggaagtttccaactcgggaattgaggtattacagaaagactaggaagcagctacctacatcaaagcagggtgaattaaacagaagaaatgaggtaccattaattaggttaatgaggaaccttcagtggactggttcttatacttctgaggggaaatggtatagatggagttggaaaagccatgggaagctcagaggtttcagctgtagatttgttcttttagtcaagcaagccgaaagaaagtatttaccaacctttggtgaatgccttgaaagctactgtttcgcatatgttgttcaatgttttagttttggcagaacggtcactatggtttgggctggcattggaagtttagagcaatttgtcttaaaatattttcatttgcaaaattcaacaacactgaaagatgctacaaaatgtagcttgaccccagatgcttatcaaaaatgcttattgaatagcattggagcttatataaattattaatttcaattattaagtattaagatctagtaagagtttaatacaaggtgattacatctttccaaatcaaactaagaacttcttaatcatctttgggtaacatttttggataattttttgtaacattttccaataatggctaatagcatgtctgcttcattttcatagtcagatacctgtgattcatgtgaagaattctcatacatttagtcagagttttatcttattttatttgaaaataaataaacatttttttgccctggaattatgtttaatcttggctccaggagttatgtaataaaccattggtataattgaagacttcaacactggtcttcctattccatatatcttagagttactagttccttctcacttttgaagatttttttttttgacggagtcttatgctgttgccaggctggagttcggtggcatgatctttggttactgcaacctccgactccctggttcaagtgattctcctacctcagcctcccgagtagctaggattacacgcacctaccactacacccggctaattttttttgtgtgtgtgtttttagtagagacggggtttcaccatgttggccagaatggtcttgatctcctgacctcgtgatccaccagccttggcctcccaaagtgctgggattacaggcattagccaccacacctggccacttttgatggatttttaaaatttctatatgactttatgtcatctaaattttaactcaaatgcactcgtgttaatttgttaacattttattttttatttttgcggctacataataggtatttatatctgtggcatatgtgagacattttgatataagtatacaatgcgtcaaaatcacatcaggacaaatggaatatccatcacctcaagcattcatccttttttgtgttacaagcagtctgaccatactcttttagttatttaaaaatgtacaatgaattattgttgactgtattcaccgtgttgtgctatcaaattaccacaatcagaataacttctcaacctgtctccatattttacactgatgttgaaaagtcagttccacagaaagcaatatttcaattcaaataataaattacagtcttgttaaatgttatttaaaatattacagtgaagaatatgaagagattacataaaattttccccaggtttaaaataatactcaaatgcctaaatatatcagagctatttctaatgatgtatttcagtttgtatatctttactcacaaatattatttgaaaaataagacaatcttctatttctttatacatatttacatatgtaagccattacctattagctggcaatttttaaaaaaacataataggaatatataccttttaactttatcattcattgatactattgactacaagaataaaaatatataagtaaaaatatagattttatataaccagcgccaaattatatgtgcatttatcaaacttttggaggcttttacatgagaaggctattacaatcactcaaaaaattttagaatataaaaactctctaatttcaaggaatgtaaatcttttaagaggcaggcaagtgaaaagttgaatcaaattagaggaaggtctatatcaaagtaatggataattattgaattttgagaatttcttattaaaaatattacttgaaactgtctctgtctatggcttaattttttgtcttatggtttttgaaaagcatattttatttttttaaatttaaacaatataattaagtacaaattataaaacccttccattggctaaagttatcaatttacttttcattattatgggtacataatagtgtctatattaatggggtacatgtgatgttttgatagtgacatacaatgtgtaattatcaaaacagggtaactgggatattaatcacctcaattatttattatttctttgtgttaggaacattccaagtctactttttcagttattttaaaatatacagcaaacgactattatctacagtcactctattgtgctactgaatacttgatcttattcattctaattgtatttttttgtgcccattaaccatttcccctctatccccttgttctgctacccttctcagccactgaaaaccatctttctactttctatctccatgagtttattttttcagcttccatatatgagtgaagagatataatatttgtctttctgagcctaatttacttcacttaacataatgtttttcagttccattcacgttgttgcaaatgacaggatctcattcatttctatggctgaatagtgctccattatgtatatatactacactcctttgtccattcatctattgatggaaaattaagtcaatttcataccttggctattgtgaatattgctgcaataaacaattgctgcaatattattgctgcaataaacatgaaagtatagatatttctttgatacactgatttactttctttagggtgtacacccattaatggtattgcaggatgatatggtagttctatttttagttttttttaaaaaacctccaagctgttcatagtggtaatactactttacattccgaccaatggtgtatgagattattctattctccaaatccttaccagcattctttattgcctatcttttgcataaaagtcattttaactgggatgagatgatacaacttaaaatgaccatgagaaaaccgtacatattattggaactaaaatcaacaaaattgatcgtagcccgtgttgctgtggatggagaacaaataaaactctcacacatttgggtaaaaaatcaaactttataaccaccttggaaaatagtttggcagcatcttcatacattgaacataatacctgccagctatttcatccttagatattaacccaaaataaatgataatatatgtccatacaaaaacttgtacactgatcttcataactaattttttcctagtagcccaatactggaaataacccaagtgtctatgaataggggaatggtgaaaaaaatgaacatatccatacaatggaagagtattcgtcaataagagaaaaactcttcatacatgcaacaatattgataaatctcaagaattatactaagtaaaaggagtcaagctattacctgcctccaaaaaagacaatattaaatggtttcatgtatgtaacattatagagagcacaaactattccatactgacaaaagtcagggcagtgcttccttggggatgaaaactaggcagcattaggagagtgagactgaaaggaacatgagaaaacatttgaaggtaatggatttgttcactgtgttaatacaatgcatttttacgtataagacctaccaacttccacaatttaaatatgcacagttaattgtaaaaaaagtatgagtaaatagaaaagaagccacaaagtcacttgacactgaataaatttttcaaaaaagttatcgtagaaaagggaaagtcttatatatgctgtaaaagttaaaggacatgccactagactagatgcataacgtgggaaggaggggagagcattctaggcaaaggaagcaaaggaagaataaagcattaatgccaaggagtgttgagaaggaagtgataacactgggatgaaaaactacaacagggtgaagaacagctgtgaacataacattggtagatagatttatcctctaagggatggcaatacggtaaaagatttccaaaaagttcacataaaaaaatgagtgtcagcgttagtgaaacaaaagtcctggcagagagtaagactggagggagaaaacattaagacaaacaagaatatgcaactttaaataagataaatataaatattttattgttataacaccttataccctattgaccttgtgaactttaaaaacatatgtaaaatataaatcaagaatattctgtatggtgagattatagaatcaaatagcaattcaaagaccccaaattccaaaatgtattctaagtagtataatttttttgttagtaagtgtaaaatctatttcaatcatatctaatcagcttgctcattagaaatagcgtatagtgttttcagctagtaaataagtctgtcacgtttcattattattattattaaagtattattagtatctatttctttccctcaaagtcataacagcctattcactagataaaatcagctaatttttccaacattacacttaaaacaagtctttttttctgaattgcttgatggtgacttttgaaaagaactttcatgaggtagacaaaaataaactgcaaaatacacatttataaaacagaattaaaacaatgatacatgaatctggaattagagaaaataatcagcatataaatagaatctgagaagaagtattacccttgaaaataatggctgtatcatttgtaatatatgtaatactcataacattcatcttgtgggttttttttttgcttttaaacaaacagttttggattttgttgtttcattttattataagtgacacatgtttgtacatatttatgagttaaagtatcatgtttcagtaatggatacattgtataatgattaaatcagtgtgattagcttatccttaacattaaacatttaccaattctttgtgatgatagcattcaagatcatttcttctagttatcctgaaacatacaaagcattattgtcagctattttcacctaccgtgtgataaaacactagaagttattcttcctgtctaactgtaactttgtacctaatattcagataggcaagtaactttgtcatatatgtaacctggtctaaatgaacagtaaacagtgatcggtcttggtttattatgttgactaatagagagatcagtggtcataataatcttttttcaaatgtgtttccatttgtaagaaaattttatttataatttgaaagtgctcagctctgcttttctatatcgttttgataccattgtccacagttgtatgcttttgatgcaaatatttcagattatttagaagtcttaggaaggttaaaattactacatattaatacattatctggcatgtttattataaccaaataaaaaagtttattcctcttttaatagaattttaaacacatgtgagttgttcttgtattcttttatgaaaaatgctcatttcaagagaacacattttaagtcatatttttatcaaatatattaattaaaattataatgtcatttcaaactttattcaaacttaattctcaacctctagcctgcttgtcatgatagtctgaaataataatgacataaaatactctgatgggacaaataaattactctcacctttcttggggaatgagaaagacaaaacagaaaaatcagtaaaagatataaaagcagttttctggagtttattggttatagttacttgtcacaagtatctgtgttcatctgagtctgtaattacgtagctgactctctgaaaagggaacacagtgatgaaaagacaaaacttgaaattacacaattaattgcaaactatttctcctaaggctatatatcacgcctaagagagcctgagcttaaaggttatactactaattctcttttcaaatggtacttttattagccattaaatatcactcagtgtgtgattatttttacccttgtcttagaaattgtgaacctgagacactaaaatgggttaatggctctaaatcagacaatatataaaaatctcaactaatttgtttttgtaaactgtttggatcaagttacatgcaaaaaaaaatgagtacaaagcttcagggaaaaacacattaaataaatgtgtgctttacaataggaaaattataaaatatcagcttttgtactcatcttcttttcaacatctgtatcttgagaatgagtgggctacttctgtagtgaggaaaactcccagtagttaatccgttgctagtcatatatatacatatatatgccatcatatgccatcagacacctgaaattttagatatattattgtaatttatagaacatatttatgttagccaatattaaaaaacgaggatatccattggcttgttaaagaataacatccgaacagtactgcaatgaaagttgcccgctagtaggggtgtgtttttctcacttttataaattcagagtttgaatataatatgggccaatacattgatactgcatataaaataattaaaaatggaacatatcatcaggcagtatacaaatctttcgggatacatagtgttgggtgggggcagaagctacataagaacttaggaagtacagtgggtcagggagagatggtacaaaaagagttatcacaaaatttgcatttcatatttggatccaaacacacacacacacatacacacacacacactcttatacaactggatttggtactttttgatactttttatagacttttttaggaatgtgcccttaacccacgcacacaaaagacctcgctcaagttaactcaacttgtcattacaagcagaagaaagcaaagcattgtggtagttcatcttggaaatatctgtaaggtttttatctgatcagttggcttttttttatgtttttaaaacaaaatagaatttggaaaatgcaagctgtatattatatttgtaatgaattttatacttcaaaaatgaaagtgagtgacttcccagtagtaaatatttaaatacttcaacaattctaatacttaaatagtggattgtaaatttattactgaactaaataaattcttcaaaggtattttatttagtctgtaaaacatttgtcagttacctagctttataatttaaggagtttttcttcatctataataaaaagtttagtctctgaaactattatcataattgtatagttatatgtgtttgattttctagaggagcatatactcaccaaaaagtgttttatatcatcaagaagagtaaaggaataataaaattattaccatattgtagagttgctacaaataatatgctatgctgctgtttcaacaaaactgtctacagtttttttaggcaagtaactcatttcttatatatcagattaatgattatgaaaactgtaaatatgtaaagcaggtatgaagcaataaatttttttctacttagtaaactctggaaacatctttatatcaggaaatgtctttactcttagtgatgtttagaatagccaccctttttagtaatgcaaaagggatgaaaatgccttttacctcatgacttatttcatttaggtcaccatttttatacctgtttgatataagttatttaattttttattttaactttataatattgcatggtctcacttacatgtgaaagctaagaaggttaaaatcttgaataaagaatagaatagtggtttccagaggctggaagggttgtggggaggagaagatgaggagacattggttaatgggtaaaaaataaagttagatagaatcaatacaacctagtgttctggcacaatagggtgactatagttaataatagtttattgtatatttcaaaataactaaaagaacgaaatgggaatttttctaataaaaataaattataaatgtgtgaggtgatatatatcccagtgactccaatttgatcacgataatgcattacattgtaagcttgatttttaaacatacatacattttgaagaatcaaataatctacaaaatttatctattacaaaaacaaaacacagtagccaaccctagctctgttttaatgacaaaaacagaaaaaccaaggagcaatgagagtataagcatgacatttagaaatatagggattataaacaaaagtacacagctatcccaaggtacggtgagtggccagctcctcccttcagctaaggcactctcaaaaggctggcagctcagggctgtttgcaggtggccctcccagcactgggagtaacacataatcctgtactgaaggaggatcttgacagtgtcacgtggcttccatccattccctactttggtgctggatcaccttttgttcagaattgcatattatttcctttcttggtatctcctttgttttgttatatgctctactgtagtttcctaaagtccataggagttaagatttctgagaccttgtacatctgaaatctacacttaactttcaaataattgttagcatgggacataatttaagtttggaaatcaaatttgcttcagaagttaaagtcattgcatcattctctctcagcttcagagatgctgttgagaaatccagtgtcaatttaactttttatcattactatattagcttttccgctttgaattcacctaggatattctctttttcccaagtaatcttaaatttcaggcttatttgccccagaatggatctattttcatccattttttgtctctcaatggggccttgcaacttagaaatttaaattatttgttcaatgattgtctactctctattatatctgtgttctttttaagtattacattattaaattaaatttacggtatattaactatatattcaataatatattaaaatatatattaatgttatcaatgcatatatattatgcattacattattatattctatataatatacatcaggggtattttattaatgtatattaaaattatggtatataacgtatctatatatacatatatatgtttatgttatacaatgtatatgtatacatatacatataggtataacatgtatatacatgtgtgcgtgtgtgcatgtatgtgtacatatatgtagttagcataaagtaaaatggagaccagaactggagaacccctgagtagacaaacccattaaggcctcattagtgatattatattaatcttgcttggtttgtaaacataatttaacttgagctatctctcttatatacccatattaaagaaaactaacatttaaggctaaccaatcaaaagccatcaattaattatagttattatgaatgttgcagcaggatagaccaaataaggctttattggtctatttttggattgataataatgttaatatatttgactttaatgactcaaaaattgtcattactttacttccatgttctctgtataaaagccttcccctggcattccttcagcacagccacttttggtttacagcagccttattcatgaatcactggttgctaaaattaagtatagtattattgtgcttttctttacactttaacagacaaattttatatatagttatatataagcatatatcaatatacatatatttatcatgtataatttgtctatattacatacatatatatggtctacaaaagttctggtctggtttgcaattttaagtttcacttttgttcttagagtgtcacaataatatctttcagtctttctactaaatttcaattctctgctcatatatttaatttaaaaaattcttttgttctctgagtatttatgaagtaccataatcttgtttcacagacatgatagcatttcttttatctctgaaatggtaatgaaagtttttgcttttttctgtttctattttatttttagttacctatcttcacagtctctgttttttccaagttgctttctttaagtttgtctgtttaatattagaacattcctttcgtatctgtgatcttgactcatgtttaagatggagtcattaaatcttatttgagaatttgtacacatgcatgctgtttgtggattgcacatgtggtgacctagcaagacaatattactggaaaatacccagagccaatgtatcaggtcatttttgagggaataatcaggtttctgaaaatataaatctttcactctttagctgcccctacttcctatttgtgtggtattcttcctctcaattgtggtagaactgtggccagaagcactgtggtccagatactttttctacctcgatgggtaataaatttcaattttctaagataatgaaagacagcctcttctgattgcctgaagtagaaaatccaactttcaagcaatcttccaattttcaccctttctcctaacctacctcatgttgccaattactgaaccctgcaaatgttccacagtgcacgtcactttgctgctcagctgtccatactgcctctttaggattttacttgttaaggccaattgacagttaccattatgctggtttttctttgcttaaaatacttttgctattatttccccttctaactctcagaagaaacagatgcaaatgtttgtgtttaaaacaatgtcttcaaactggaaattcatatttactaaaattacctgatttagctcttcaaaaatagagagcaatttatttatattattacatattttcagtaactctttaaactcctttataacatgtgtgcgattgaattccagttacctcagcatcatttattgaaaagggagtcctttccccattgcttgtttttgttagcctcgttgaagatcagatggttataggtgtgtggctttatttctgatttttctattctgttccattcgtttgtgtgtctatttttgtagcaacatcaagctattttggttaccgtggctttataatatgatgtaatgtcgagtaatgtgatgcttctggctttgttcttttggcttagcattgttttggttatttgggctcttttctagtgccttatgaattttaaaatcatttttttctaattccgtgtataatgacattggtagtttgataggaatagcaatgcaaattgctttaggcaccgtggccatttttatgatattgattcttccaatcaatgagcatggaatgttttttctatttatttgtgttacctctgatttctttcagcagcgtttcgtagttctccttgtagagatctttcacctccttggttagctgtattcctaggtatttcattttctttgagtccattgtaagtggaattgtgttcttgatttcactcttaactcttagcatagatgttgttggtgtatggaaatgctacttatttttacacatcgattttgtatcctgaaactttacttatattgattatcaattctaggagccttttggtagactctttagcattttgcaatagaatcatgtcattagcaaagagagtttgaattcttcttttcctatttggatatcttttatttcttgctcttgcctgattgctgtgtttagaatttctagtactatattgaataggagtggttagagtggacatccttgtcttattccagttctcaggaggagtgtttccagtttttgcccattctgtatggggttggctgtggatttgccatagatagctcttattattttgagatatgttcctttaatgcctagttttttgagggtatttaatattaagtgtttttgaattttatcaaaagtcctttttatgtcttttgagataatcatgtggtttttatttttatttctataataaatctcatttattaatttttatatattgcaacaacctagcattccaggaataaagctgctggattagctttttaatatgctactggttattttcgtctccctaggtgtgattttaggatgtcaatttcagatctctaactttttcacatgggtgttttccactataaccttccaaattaacatggcttagctgtgtcccaaagattttggtatgttgcatctttgttttcatttgtttcaaatattttttttcatttctgccttaatttaaattttccccaaagtcgttcaggagcaggttgtttaattagcatgtaattatatggttttgaaagagattcttggtataaatttctattttattgcgatgtggtttgggagtgtggttgatataatgggtttcttaaggacgtcttgcaaggctggtctggtggtaatgaattcccttggcatttgcaaatccgaaaaggattttatttccgcttcacttttgaagcttagtttggcaggatctgaaactcttggttggatttttttctttacaaatgctaaatatagattcccaatctcttctgggtggcagagtttctgctgaaaggtctgctgtagtctgatggggttccctttgtaagtgacctaacccttttctgtagctgctttaatatttttttcgttcacactgaccttgatgaatctgatgattatgcgttttggggatggttgtcttttccactgtctcacaggagttctctgaattgcctgaatttgaatgtcaacctctctagcaaggttggggaaatctctttgtagatcaaagaactatatggttaaaaaacacatatgggtgtggtggctcacgcctgtaatcccaggactttgggaggctgaagtgggtggatcacaaggtcaggagtttgagaccagcctggccagcatgctgaaaccccgtctctactaaaaatataaaaaattagccagtcatggtggcatgtgcctgtagtcccacctacttaggaggctgaggcaggagaattgcttgaatccagcaggtggaggttacagtgagctgagattgcaccactgaactctagactggacaacagagcgagactccatcttaaacaaacaaacaaacaaaaccaataaacaaacaaaagtctgtaaaagtagtagaagaaaatacaagtaaatatgtttataagcttgggtaaggaagaattttttttttttttgagacagcgtcttgctctgtctcctaggctgaagtccagtggcttgatcacagctcactgcagccttgaattccttggctcaagctatcatcccacctcagcctcctgcatagctaggactcaggcatgtgccatgctaagctaattttttatttatttttaaaattaattaattttttttttgagacggagtttcgctcttgttgcctagtctggagtgcaatggtgcaatctgggctcactgcaccctctgcctcccgggttcaagcgattcttctgcctcggtcttccgagtagctgagattacaggcatgtgccaccatgcccggctaattttgtatttttagtagagacagggtttctccgtgtcggtcaggctggtctcgaactctcgacctcaggtgatccacctgcctcagcttcccaaagtgctgggattacaggcgtgagccattgcactgctaagctaattttttttttttttttcctgaggcggagtctcgctgtgttgtctgggctggagtgcggtggcaggatctcagctcactgcaagctccgcttcctgggttcacgccattctcctgcctcagcttcccgagtagctgggactacagaagcctgccacaactcggctaatttttttgtatttttagtagagacaggctttcaccatgttggctaggatggtctcaatctcctgacttcgtgatccgcctgcctcggcctcccaaagtgctgggattacaggtataagcaactgcgcccggccctgctaagctaatttttaaaatgtttttgcaaatatgaggtctccctgtattgcccagtttggtctcaaactcctggcctcaagtggccttcctcatgtggcatcccaaagtgctgggattacaggtgtgagccaccacacctagtcccagaaagatattcttgaacaagaaataaatcacagccagatgcggtggctcacacctgtaatcccagcactttgggaggcctgaggctgatggatcacctgaggtcaggaatttaagaccagcctggccaacatggtgaaaacctgtctctactaaaatacaaaaattagcccggcatggtggccacgcctttaatcccagctactcaggaggctgaggcaggagaatggcttgaacccgggaggtggaggttgcaatgagccgagagcatgccattgcactccagcctgggcatcagagccagactccatctcaaaaaaaaaaaaaaagaaaagaaaaaaaacccagaaaacccaaatcagagagccattaagacaaaaaaaaaaaaaagactaataaatttgactccatcaaaaattaaaactcggccaggcgtggtggctcacgcctgtaatcccagcactttgagaggccgaggtgggtggatcatgagttcaggagttggagaacagcctggccaacatagtgaaaccctgtctctaccaaaaatacaaaaaaattagctgggcgtggtggcgggtgcctgtaatcccagctacttgggaggctgaggctggagaatcattggttgaactagggaggcagaggtttcagtgagccaagtcatgccattgcactccagcctgggcaacaagagcgaaactccatctcaaaaaaaaaatgcatatgtttcagctcagcaaccccacttctctattctcaaataatacacatatgtatgtttaaagaggtatgtacaagaatgttcactgtcaacactcttggtaatagcaaaaaaactggaaacaatcatcatttccatgaaaaaaagaatagctaaataaactatgcccacactatgctattctacataacagttaataatgaggatatgtatattgatatgaaaagatcaagatgtagttaaataaaaaaatgcaaccgggtgcagtggctcccacctataattccagcacttagggaggccaaggcaggaggctcacttgaggccaggagtttgagaccagcctgggcaacagagcatgaccccatctctacaaaaaatttttaaaaattagccaggtgtggtggtacatacctgtaggcggtggtaggattgcttgaagtaaggagttcaagattacagtgagctgtgatcacatatctctaaaaaaattttttttttaagatggagtctcgctctgtcgcccaggctgtagtgcaatggtgcaatcacagctcactgcagcctcaacttccctggctcaggtgatcctgccacctcagcctcctgagtaactgggactacaggtgagcaacaacacacccagctaatttatttatttatttatttatttatttatttatttatttatttaatttatttattttttgagaaggagtcttgctgtcacccaggctggattgcaatggcacacaatcttgacttactgcaaccaccacttcccaggttcaagcaattctcttgcctcagcctccttagtagctgggatgaaaagtgtatgccaccatgcctggctaatgtttgtatttttagtagagacggggtttcgccatgttggccaggctggtctcagactcctgacctcaggtgatccacctgccttggcctcccaaagtgccgggattacaggtgtgagctaccgcgcgtggcctgattttttgtatttttagtagagacagggttttgccatgttctcccaaagtactggaattacaggtgtgagccactgtgcttggcccctgtacaattttaaaatttaaaaaaaaattaaaaatacctggagttctggccttgaaaatcccatccttgtgggcgctccttccagtcttgaggagtgaacctggccatcagtgattctgaagaagcaatggccacagagaaccccagcacagcaaactgagaaactgccatttttgttgtattttattatttcctctagagatgggggggggggtctcaacatattgcccaggctggtcttgaactcctggactcaagcaatcctcctgcctcagcctcccatagtgctgtattacaggtgtgagcccccttgcctggcctggccatctatatttcttttgtttgtttgtttttcatttttgagacagagtcccactctgtcttccaggctggagtgcaatggtgtcatctcagcttactgcaacctctgcctcctgggctcaagccattctcctgcctcagcctcccaagtagctgggattacaggtgcccgacaccacgcccagctaatttttgtgtttttagtagagacggggtttcaccatattggccaggctggtcttgaactcctgacctcaggtgatccacccgtcctggcctcccagagtgctgggattacaggtgtaagccaccacactcggcctttttttcccaatgtttttttttttttttttttctcagagacctttgttctgagatctttatttcttctccctgttctttttccttgtctagtctacctcacaaatcatttcatgattaattttcctaaagcaaagggcaaatatttattaagcatttgccattatttgtactcagtatttggtaatggcaggaatgtttgaagaaagttaatatgatagtaatatggagcaatgtgaagttaagaagagagggagatggcaaccaatcaaaagactatatcaggccgggctttattcatcctgttcagaggtggtcacagcttcccaatgcctacaaaataaaggccaaattcctgagcctaatatccaagaccgtccattctatcctcaacatacctttctgatctcttcattacttcttcccattaaaagcctccaattcagccaattttttttttttttttgacatgggggtctcgctgtgtctcccagggtggaatgcatgacaccaccatagctcactgcagtctcaaaactcctgggctcatgtggtcctcagcttcctaagtagctgcaactacaggtgtgcaccaccacatgcagcttcagcctggctttcgcatgtgtgcgtacctctgttcacagttacttctcctgtctccttaaatcttgcttcctttatttattgattgattgaatgatttattgagacggagttttgctcttgttgcccaggctagagtgcagtggcgcaatctcagctcactgcaagctccgcctcctgggttcacgccattctcctgcctcagcctccccaggactacaggtgcctgccaccacacccagctaactttattgtatttttagtagagacggggtttcaccatcttggccatgctggtcttgaacccctgacctcgtgattcacccgcctcggcctcccaaagtgctgggattacaggcttgagcccctgtgcccgacaaggggtgcgtgttttttaaaacatgggagagggaattgtgcttcagaatcaccaccagctgttgcaacatcgggtgccactccatcccgcttctgaggcacgacggagcactttgggaggccgaggcgggtggattacctgaggtcaggagttcgagaccagcctgaccaaaatggtgaaacctggtctctactaaaaacacaaaaaattagccagacgtggtggcgcatgccagtaatgccatccatctacttgggaggctgaggcaggagaatcgcttgaaccccagaggcgaggttgtggtgagccgagatcgtgccattgcactccagcctgggaaacgagcgaaattccgtctcaggaaaaaaaaaattttttttaaaggaaaaaaaacccctctttttctagccggaaataccctctttcaggaaggcgcgcctgtgccgcatacgcacactcagttacttagcaaagtctgggctaaaccacccaaggcggagcccaggaacaacagagccaccgcatcccccaccaatcagcgccgacctcgccttcgcaggcctaaccaatcagtgctggtgctgcaagaaagtttccagagctttcgaggaaggtttctttaactcgaattcatccgcccaataattttcttatattttcctaaagaagagaagtgcatagaggagaagggacataatttgttaggatcctttcttacgctatgggaatttggggctcagttgaaaagcctgaactgcgtctggggatgttgggcgcggcgaactactttcagtggcgcacggagacggtgtctatgtaagaagtgataacgcaacacaccttgcacaaatttgcgctctgccaaaccagagcattcaggcacgactggctttgttgggtgaggttgttgtggtgttcctgtggctggacgtgattcgcagcatcctcgtatccgctaacaggtactggcccacagccgtaaagacctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggttcggttttgttttcagtttacctaacaccgtgcttaggtttgaggcaggttggagttcggtcaggggagtttgaatatccagaacaggtagtggagaaagttgtggacgcttggttagagagcgctctggattctccactgttgacattgaaaccttgagtgacgaattttgtattaagtgacttagcctcataaaaatcaggggaggtttgcggaatgttaccatgtttaaggcattttgaaggagtagttgctaactttgaagcatattagatgtaaaagcaagaaatacaatgatcctgagatgacacgcttatgttttacttttaatctaggtcaaaatgcggatcttcgtgaaaacccttaccggcaagatcatcacccttgaagtggagcccagtgccactatcgaaaatgtcaaagccaaaatccaagataaagaaggcaatccctgtgaccagcagaggctcatctttgcaggcaagcagcgggaagatggccgcagtctttctgactacaacatccagaaagagtcgaccctgcatctggtcctgcgtcggagaggtggtatgcagatcttcgtgaagaccctgaccggcaagaccatcaccctggaagtggagcccagtgacaccatcgaaaatgtgaaggccaagatccaagataaagaaggcatcccccccgaccagcagaggctcatctttgcaggcaagcagctggaagatggccgcagtctttctgactacaacatccagaaagagtcgaccctgcatctggtcctgcgtctgagaggtggtatgcagatcttcgtgaagaccctgaccggcaagaccatcaccctggaagtggagcccagtgacaccatcgaaaatgtgaaggccaagatccaagataaagaaggcatccccccgatcagcagaggctcatctttgcaggcaagcagctggaagatggcggtactctttctgactacaacatccagaaggagtcgaccctgcacctggtcctgcgtctgagaggtggtatgaagatcttcgtgaagaccctgactggaaagaccatcaccctggaggtggagcccagtgacaccatcgaaaatgtgaaagccaagatccaggatgaagaaggcatcccccccgatcagcagaggctcatctttgcaggcaagaagttggaagatggccgcactctttctgactacagcatccagaaagagtcgaccctgcacctggtcctgcgcctgaggggtggctgttaattcttcagtcttgcattagcagtgcccactgatggcattactctgcactatagccatttgccccaacttaggtttagaaattacaagtttcagtaatagctgaacctgttcaaaatgttaataaaggtttcgttgaatggtagcatacttggtgttttgtcatgatattctctagtgatgtgtgggtacacttaaaactggtgaaaatgtctagggagggatttaattttgagattggtaatgtgcccaaagttaagtcacttgactctggtatacacttgggtgggctgaggggtaagagccttctttgctgtaagtcattacaagttaggatcctggactaatggcaaactttctgaagctcgaatttaaagtctgttgggagtccgaggtgggcggatcacgaggtcaagagatcaagaccctcctggccaacatagtgaaatcctctctctactaaaaaaaattagctggatgtgatgtcgcctgcctgtagtcccagctactcaggaggctgaggcaggagaatcagttgaacctgggaggcagaggttgcaatgagctgagatggtgccactgcaccccagcctggtgacagagcaagactccatctcaaaaagttggatatgcaggcttttttaaagatggtcttgctctgtagtccagactggtatacagtggcacaatgacagctcaccgtatcattcttgggctcaagtgactgcagggattttctttacaaatatgcctgcctaggcctaatcaaagattgctggagaaatagttttgattgaggctgcctgaatagtggtaacgtaactgctttcaattctgcaattattgggtgactatgagctgtgtgtttattgctctgtagtgtagtaacaccgaagtgtttaacctgggtggtagtatgggaccgtaatcttgtctgtttgctgtatatgttttaaatgatgagccaagaagcagctaattactgagtatggaagactactggctgaggagaaagatggcttgcaggtacttaatgtttaaaactgtatcctgatctaagacaatcttcctggtcttgatgagttaggtggcaaattaaagtggttcctcacacagttggtttttgtttttgtttttgttttttttgagacagagtctcactcttttgccccaggctggaatgcagtggtgcgatctcagctcactgcaaactccgcctcccaggttgaagcaagtctcctgcctcagccccccacgtagctgggactacaggggcccaccagctaatttttgtattttcagtagagatggggttttaccatattgaccaagctggtctcaaaagtcctggcctcaagtgatccacccaccttggcctcccaaagtgctgggattacaggcatgagccaccactccgggccacgctgttgtttcttaatgtctaacagcttaactttattgtgaaagactgcagcaacaaatgagattttatctgtatttggtaaaaatgcttatccttgtctaagtctggcaacataagcagtttttaggcttctatcccaatggacattaggcagtaatacatgcgcagtgctaatagaaaatatttgagggagtaagggtgtactaaggaagttctcaaatcttcctgcttcactatcttctgtaatacaacttcagtaaatgtgattctcatcttggcacaaaattgggagtagtgtggggagccctgtttaattttttttttcaggtttatagtagggaaataatgttttctggtactaaaactggcgtggtaagtgcatacttagggtaaggactttaaatcactggccagttaatctctagttggtggtttagcatgcaagaagtacccatgggtatattacacaaatgcgggaatagcatatctagaaataagcctttgatattcatagtgtacctgagaatggtttcacacataattttaggtaatctgccttagtcactctggttttacggatctttgcccacagttcctggttcataacttctatagcccttgttatagtcatgttgggtgtgttaggccacaggaaactcacttaacttctgcccttttaccttccctaagacaggactcataatcttcccctacctttctgagtcctgagacccccatttcagagagggttctgtcctgtaccctggggaaaggaatgctgtcatcgtgaagcctccttagaaaaccaagaggactgagtttggatatctgaacacatggaggttcctggaggatggcacacccaagtaaggcattaaagctttgcaccccttcccccataccttgtcctatgcatctcttcatctgagtcctttgtaatatctttataataaaccagtaaacgtggccaggcgtggtggcttatgcctataatcccagcactttgggaggtggaggtgggtggatcacttgaggctagagcttgaggccagactgggcaatgggctctttacaaaaaaaaaaaaattaaaatgggcatggtggcatatacctgtagtcctagctacttgggaagctgaggtggaaggattgcttgagtccaggagttccaggccagcctagcacagcaagatcttgtcactaaaaacctagctcttcaaacctggaaaattaaaacgtttcactgaatacctaaaaactattatctggggcaatagggcttaaaatattgtgctgtcatttctcccaaagtgtcactgtctgacaatataggctcataggtctgtagtctggtgaatccttcagaagaagattcagctgttgctctttagttctcttttggaatattttattttccatagagatccccctctaagtaattcatggatctcagcaaattcactctgcacacaaatgaatctgagcaattttgagacagagtcttgctctgtagcctaagccagactgcagtggcacaatcttggctcactgcaacctctgcctcccaggttcaagcgattcttgggcctcagcctcctgagtagctgggattacaagagtggtcaccacacccagctaatttttgtatttttagtagagacggagtttcaccatgttggccaggctagtcttgaactcctgacttcaggcgatctgcccgccttggcctcccgaagtgctgggatcacaggcgtgagccactgcacctggccagggaaaggctctttaaatatgtgttggaggcctggtctatggcctgatgccagtccaaaatagttcttgtcagctctcagttaaataaaaatgagaacagcggccaggtgcaaaggctcacgcctgtaatcccagcactttgggaggacggggtggggggcggggtgcggatcatgaggccaggagttcgagaccagcctgaccaacatggcgaaaccccgtctctactaaaaatacaaaaaattagctgggtgtggtgtcacgcacctgtaatcccagctacccaggagggtgaggcaggagaattgcttgaacccaggaggcggagattgcagtgagctgatatggcgccactgcactccagccttggcaacagagtgagacttcatctcaaaaaaaaaaaaaaaaaaaaagaacagctcagtggattttacataaaaaatgtattcaacttaaaagacatgtcctctgtaaaaatgttgtggtctaatggtttagtgtgactctggatacaagacttcttgagtcaaatctggctgcttactagcttgtaacgttgggcaactaatcctgtcagtacatcaaattcctcatctataaaaattgggttaattacacctgtctcagactagttataattacctgtgaagcacttaaaacaatgtaaaaacttggccaggtgaggtggctcatgcctgaagtcgcaactacttgggaaacaagcagaatggcttgagcccaggaattcagggctgcagtgagttaccaggtaatgccactgcactgcactccagcctgggcaacagaatgaaaccctgtctctaaaaacaaaacaaaaccaaaaaccccacacacttgcgtagtgcttaatatgctattttttgtaataaaattaccaatcaagatgagatgataggctgggtgctgtggctcacacctgtgtaatctcagcactttaggagcccaaggtgggaggatcgcttgaacctggtagtttgagatcagcctgggcaacatagtaagaactcatctctacaaaaaatgaaataaaaggcgggaggatcactgcaatgaggttaacgctgcaatgagctgtgatcttgccactgcactccagcctaggtgatgggagtgagaacctatctcaaaaaaaaaaaaaagatgataatgcaataagtaaactgaatgaaggtgataggaacttcgtggggcaatatccaatagaggaaaaaatgctataggaaaaaatatgcctaagcacaaagacaggtgggccactgttaacaatggttgcttcaggagaatagaggagtagttttaaagggaggtatatttcagctcctctctagatattcttaaatctggcacccacataacatcagcattgtccacaagcactccatgtttaagagccagcaatataacagccctgaagtcagactgtgtttctggatagagtagacattttgcacaaatctctggttcaatctctatcactcctatagggcctctagaaactttatctcatgagacttcctgaaccgcgacacacttcattttagctacactttattcattcttcaaagaatctgagcaggcaagccatgactctattttaatcaggcccagctaactctaaatggaagctttagatacatgttgggttctgggaaaggatcttgtacttagcgcagcaataattatttagtatatgagcacttagtttccttagtctgacaataagtacttagtttcctcagtgcaacaaggaagtaggttttgaggtttttccttttttcatacttttttcttatcttttttttttttttttttttttttttgaggcagagcctctctctgtcacccaggctggagtgcagtggcatgatctcggttcactgcaacctccacctcatggattcaagctattttcctgcctcagcctcccaagtagctgagttttatactttcttaatctcccacttttttttttttttttgagacggagtcttgctcttgtcgcccaggctggagtgcagtggtgcgatctcagctcactgtaacttccgcctcccaggttcaagtgattctcctgtctcagcctcctatgtagctgggattaccggtgcccacagccacgcccagctaatttctgtatttttagtagaaacagggtttcatcatgttggtcaggctggtgtcgaactcctgacctccgctgatttgccaacctcggcctcccaaagtgttgggattacaagcgtgagccaccgcgcccagctgatctcccacttttttttttcttttttcttttttgagaaagagtttcactcttgttgcccaggctggagtgcaatggcacgatcttgccttactgcaacctccacctcccaggttcaagtgattctcctgtctcagcctcctgagtagctgggattacaggcaggcaccaccatgcccagctaattttgtatttttagcagagacagggtttcaccatgttggtcaggctggtctcaaactcctgacctcaggtgatccgcccgcctcagcctcccaaagtgctgggattataggcatgagccaccgtgcctggcctcccactttttttaatcatcaaatgttgggtggtgaagttcactctccgccagtaggtcccagacagctcctataaaattctaaaacctattctaaccacacaacactaaccagggccccttttaagaaacactattatcttcagaaatttctgatatcagtgtttccccaaactatcttccaaacattacaaccagtacgaaaaacgatgctgtgatcacaaggagttatccattatctccctcctgaagacctacaatgtcctacaattgtacattagcatatttaagtctctaaggagttctaccttataggaactggtttaacattgtttaacccagtgttttccaattttcaatttcacttatgtttcactttttttttttttttttgaaatggcattttgctcttgttacccaggctggagtccagtggtgccatcttggcttacggcaacctccacctcccaggttcaacagtgattctcctgcttcagcctcccaagtaactgggattacaggcatgagccaccacgcctagctaattttgtatttttagtagagatggggtttctccttgttggtcaggctggtcttgaactcccgatctaaggtgatccacccacctcagcctcccaaagtgctgggattacaggcgtgagccactgcacccggcctcacctttttttggtgggggagacaaagtcttggtctgtcacccaaattgaagtacagtggtgtgatctcgcctcactgcaacctctgcctcccaggttcaagagattctcctgcgtcaccctcctgagtagctgggattacaggcatgtgtcactatgcctggctaatttttgtatttttagtagagacagggtttcaccagtttggccaggctggtcttgaattcctggcctcgaatgatccacccactttgacctctcgaaatgttgggattacaggtgtgagccattgcgtctggcaatcatttttttttctttgtccccaaggccggagtgcagtggcgtgttctcagctcaccgcaacctccacctcccaggttcatgtgattctaacaggaggtgacatattattattaatgaatgataatagttaactcttatttacgcttaccatgcaataggcattattctaaggttttacatgaactggcttatttgattttcacaactatccacccacttaggcacacagagctggggtttgagcccagacaggctggctccagagttcttgctcttaatgcttcgagataagatctcctgagagaataagcagaagtcagtcacataaggatctggaaaacaacattccagaaaatggactaagcaaggctcaagtttctgaggctagccagcactgagatatttagagatccacctacctcagcctcccaggtagctgggactacaggtgtgcaccaccacgcccagttaatttttgtatttttagtagagatagggtttcaccatgttggctaggatggtctcaatctcttgaccttgtgatctgcccaccttgcctcccaaagtgctgggattacaggtgtgagccactgcacctggccatcactttctttttcaatgacataacatttctcataatttgagaaacagtgttcaagccatgccctgtctcctgtctccgtatctagtactgctgattgtgcttggttctaggcgtctttcgatgatagaaacatgctgctgtgaattcgaggcaggctgcacactgggcttggatcttctacttttaaaatagaacaatacaggctgggtgtggtggttcacgcctgtaatcccagcactttgggaggatgaggtaggtggatcatctgaggtcaggagttcactatcagcctggccaacatggtgaaaccccgtctgtactaaaaatacaaaaattagctgggcatggcactgggcacctgtaatcccagctactcaggaggctgaggcaggggaatcactggaactcgggtggcagtgagatcccgccactgcactccagcctgggtgacagagtgagactctgtctcaaaagaaaggaaaagaaaagaaaaaagcatgaaaaaaggaaaagcaagactccgtctcaaaaaaactagaacaattcaaatattgagggggacgaagacttggtctgttgcccaagctgaagtacagtggttcaatctcggctcactgcaacctccacctgccaggttctgaggcggaaaatgaacgaaaaataaaatttagaagaaagagaaataagttttcctatattaggctgacttgtgcagcaacgggcacagcccagacccaggaaaagtcttgataatattatctaatgtgctctggagattctcccagcactccctcaacattgggagaagaaaaacaaattttcctttgttttatggaatgagtttatagattcttgttctctgtaactaatgacttcaagtattctgttttatctaagaagtacaacgaaggtcacaagaagcctgagtaggcctgaactacagctgcctgagcaccatagtgaaggttataggataagcctgtgccctgacaaacctagataacagacatctgggttgcttggcaacagtcatgtgcaatcctgtctttgtcctgcctctgtatccctgatttcatgccactgtaaccttgcttcaagctagcccacccccttttctgaagtgtgtataaaagtcaggtgctgtctttattccgggcccagtcttttacacgtgagtcagccgggcctgagtgcactcaatattctcctgtttcaacccgaggtctctctcgtcctcctgaatcccgcaacagttcaagcaattctcctgcctcagccttctgagtggctgggaccagaattgtgtgtgccataggtgtgtgccactatgctcagctaatttttgtatttttagtagagacagggtttcaccatgttagtcaggctggtcttgaactcctgacctcaggtgatccatctaccttggcctcccaaagtgctgggattacaggtgtgaggcactgcacccggccaattttttgtatttttagtagagatggggtttcactgtgttagccaggatggtctcaatatcctgacctcatgatctgcctgccttggcatcccaaagtgctgggattacaggcgtgagccatcatgcccggtttatagattatcttaatcagttgctactttgctgcagcttgtctttaagcatatgttaccagaaaaattaacagacaaatttcgacatggaatttttttttttttttgagacagagtcccactctgtcgcccaggatagagtgtagtggcatgatctcagctcattgccacctctgcctcccaagttcaacggattttcctgcttcagcctcctgaatagctgggatacaggcgcacaccaccacacccggctaatttttgtatttttagtagagatggggtttcaccatgttggccaggatggcctcgatctcaaggtgggtgatccacccaccttggcctcccaaagtgctgggattacaggcatgagccaccatgcctggcacacacctggctaatttttgtattttttagtgtagacggggtttcaccatattggccaggctggtcttgaactgttgacctcgtgatccgcccacctcggcctcccaaagtgctgggattacaggagtgaaccaccgtaccaggcctggacatggaattttaaaaaattatctaattcgttgctttcttctgagagagagtctcactctatcgcccaggctggagtgcaatggtgcaatcttggctcattgcaacctctgccctttttttgaggcagagtctcactctttgcccaggctgtagtgcagtggcatgatctcggctcactgcaacctctgcttccaagggtcaagtaattctcatgccttagcctctggagtagctgggattacaggtgtgcaccgccacacccacctaattttttttttttttttttgagatagagtctcactctgtcgcccaggctggagtgtggtggcatgatctcagctcactgtaacctccacctcctgggttcagtgattctcttacctcaccctcccaagtagctgggattacaggcgcacaacaccatgcccagctaattttttgtacttttagtagagatggggtttcaccatgatgcccaagctggtttcaagctcctgacctcaagcaatccacctgcctcagcctctcaaagtgctaggattacaggcatgagccaccgcaccctgcctaatttttgtatttttagttgagacagggtttcaccatgtttggtcaggctggtctcaaactcctgacctcaggtgattagcacctctcttacaggcctgagccaccctgcccggccctagtttagttttgttttttcaaaacagggtctcactctgttgcccaggttggagtgcactggcctaatctccgctcattgcaaactctacctcccgggttcaagcgactcttctgccttagcttcccaagtagctgggattattggtgcccccagccatgctctgcttttcatattttttagtagagatgggttttcaccatgttggccaggctggtctcaaactcttgacctcaagtgttctgccccccgaagtgctgcatttacaggcatgagccacggtgaccagcctgattggttttgtaaaatacaaaagtgatacaagctcttgataaaaatacattcagtggcatataagagtatccagtaggctgggtgcgtggctcacacctgtaatcccagcactttgggagtccaaggcgggcagatcacttgaggtcaggaattcaagaccagcctggccaacatggtgaaacactgtctctactgaaaatacaaaaattagccaggcgtggtggtgcacgcccatagtcccagctactagggagactgaggtaggagaatagcttgaacctgggaagcggaggttgcagtgagccaagatctcgccattgcattccagcctggctgtcgcaaaaaaaaaaaaaaaaaaaaaagtatccagtaaaaactcccctctcacctttccttgtatccccagaagaaaccgtttaatgagagtatatgttttcatttatttattcattcaacaaatattaggtgtttgctgttttttaaaaaaatgtaatttaagtttttagagtcagggtctcactctgtggccctgcctggagtgcagtgacacaatcatagcttactacagccttaaactcccgggctgaagcgatcctcacaccttagccacccgagtagctaggactacaggcacctgccaccacaccaggctaattaaaaaacttcttcttcttcttttttttttttttgagatggagtcttgctctgccgtccaggctggagtgcagtggcgccgtctcggctcactgcaacctccgcctccctgcctcagccttcggagtagctgggattacagacgtccgccatcatgcccggctaattttgtgtatttttagtagagacggggtgtcgccaccttggccaggctggtcttgaactcctgacctcaggtgatccacccatctcggcctcccaaagtgctgagattacaggagtgagccacggcgctgggcttttttttttttttctttttagacggagtcttgctctgttgcccaggctggagtgccttggtgctatctcagctcactgcaaactccgcctcccaggttcatgccattctccggcctcagcctcccaagtagctgggactacaggcgcccaccaccacgcccggctaatttttttgtatttttagtagagacgggggtttcaccgtgttagccaggatggtctcgatcttctgacttcgtgatccgcccgcctcagcctcccaaagtagtgggattacaggcgtgagccacagagcccagccgacgcctttttttttctttcttttaaagagatggagtctcaccgagcactgtggctcacgtctgtaatccccaggactttgggaggccgaggcgaggggatcgcttgagcccaggagtcgagaccagcctggacgacatagcgagacttcgtttctgaaaaaaatgcaagcattttgaacccgggaggcggaggttgcagtgagccgagatcgtgccgctgcactccagcctgggcgacagagcgagactccgtctcaaaaaacaaaacaaacaaacaaacaaaaaaacaagcaaacaaacaaaaaaaaaaaccaagcatttggcaggcatggtagcgcacgcctgtggtcccagccagccactctggaggctgaggtgggaggatcgcttgagccagggagttcgaggctgcagtgagcggtgatcgtgccactgcactccagcctggaggacagaggcagaacttgtctcaaaaaaaacaaaaaacaaaaaaccggccagtgtgtgaggggcgcgcgatttttaagatgtgagagagggaattgtgcgtcaccatcaccaccaggtgtcgcgacatcgggtgccgcgccgtcccgcttctgaggcgcggtggcctgagaaactggcttcagagcccgctcttcctagccttctgcccgaaaatgcagaatttggggaattggaactttggaggcgggagcgaaagacctctccttctctcgccggaaatatccctctttcgggaagcgctcccctgccttccggaaaggaagagccctgatcgcgcccctgcactcaagcctctgggtgatagagcgaggagaccctgtctccaaaacacaaacaaacaaaaggtaatggggggggggggggcaggcgcggtggctcacgcctataatcccagcactttaggaggccgaggcgggtggatcacctgaggtcaggcgttccagaccagcttggccaacatggtgaaacccccgtctctgctaaaaataccaaaaaaatagctgggggtggtggcaggcacctgtaatcccagctactcaggaggctgaggcaggagaatcacttgaacccgggaggcggaggttgcagtgggctatcacaccgttgcactccagcctgggcgacaagaatgaaactctgtctcaaaaaaaaaaaaaaaggtagtaggaacattgctggtaattgctgtgtgagcacactaataccacatttatacctgtctttctgaacttctatgacaatgtaaacatgcatatgtatatagatatctccatatatagttactctcaccttgttcacagctgctcttacactagatatacaattttctccttcaaataatgttaatgctaactatgaatgtaatatatgctcagtgtatgaaatttaggaaatatagaaaaagaaagcactcattatccctacgatccaagtatattcagtttggcatgtttcctcttttcccagtattaattttttacttaaataacaatgaatacaatacaagttgtaaggacttgaccagcagatatacagagagtgagtaaaaacattgaagtcctttttcagcgtcccttcccagatgtcctcttcccacacatctttttctgtgccacttgctagaagtttggtgtatttacgaccagattgttttcaatgtgtcacatatgtttgtgttatataaaaacatactttaaaaatcatatataaatgcaattatgcattacacacccatctttcttggagacatttccatgctaacacatatagatgtgccttattcttctcaaactgctgcaaaatatttcatggtatagatacaccatattttacccttctccttactgatggtatttatattgtttctaatttttactattaaaacaatactgcaattaatatctttgtaaatgtctcttgtcacaaatgtgcaagtatttcttcaggatatactagaagtagaattgctgtatcaaagattatggcatttaaaaattggggattattacagaattacccatcaacagactgtacaacaatggaatattattcagccttaaaaggaagaaaattcggctgggcacggtggctcaggcctgtaatcccagcactttgggaggccgaggcggacggatcacgagatcaacagatggagaccatcctggctaacatggtgaaatcccgtctctactaaaaatagaaaaaatagctgggcgtggtggtgcacacctgtagttccactcagctacactggaggctgaggcaggagaatcgcttgaacccaggaagcggaggttgcagtgagccgagatcagggcactgcactccagcctggagacagagtgagactctgtctcaaaaaaaaaaaaaaattctgctgggcacagtggctcatgccagtaatcccaacactttgggaggccaaggtgggaggatcactcgaggcccggagttccagaccagcctggccaatatggtgaaaccctgtctctactaaaaatgcaaaaattagctgggtgtggtggcgcatgcctgtaatcccagttactcgggaggctgaggtaggagaatcacttgaacccgagaggtggaagttgcagtgagccaagattgagccactagtggcactctagcttgggcgacagagtgagactccatctcaaaaaaaaaaaaaaaaaaagagaccagccttgctaacatggtgaaacgcatctctactacaaatacaaaaattagctgggcgttgtagcaggtgcctgtaatcccagctactctagaagctgaggcaggagaatctcttgaacccgggaggcggaggttgcagtgagccgagatcgtgccattgcactccagcctgagcaacaaaatcgaacctctgtctcaaaaaaaaaaaaaatggaacttctgacacatattaccacatggatgaatcttaaagacattacactaaatgaaacaagacagacacaaaaggacatatactgtgtgattccactatatgaggtagctagagtagtcaaactcatagagacataaagtagaatggtgggtgccaggggctgggaaaggagggaatggggagttagtgtttaatggggacagagtttcagttttgcaagatgaaaaaagttctggagatggatggtggtgatggtcacacacaatgaatattaatgctacgaaactgtacacttaaaaatggcttaaacggtacattttttggtatttatagttgatcacaatttttaaaaagactgtaccaatatcaattcccaccagtattgcataagagagagtatctagtcctccaccacttcattaatattatacattatgaataatttcaactttgaacatattgaggggcaaaaacaacacttgattgttttaatttgcatgtgcccaattacttctgagattggataccttttgaatgtttacttaacattaatttgtcttgcaaattatctgttcatttcctttgcccaattttagtatgaatttgttcgactatatattctaacaactaataatttatttaattgtggtaaatattgtctttcagacttgcttcactttttttttttttttttttgagacagtgtctcactctgttgtccaggctggagtgcagtggtgtgatctcagctcactgcagccttcacctcctgggttcaagactcccaagtagctgagcttacaggcacacgccaccacacccggctaatttttgtatttttagtagagacaggatttcaccatgttggtcaggctggtctcgaactcctggcctcaagggatccgccttcctcagcctcccaaagtgctggaattacaggcatgagccactgcacctggccttacttcacttttcaattatggtgtcttttgtaaaaaagaagtttttaattaaaaaaaaaaagctcccatctctccaaaaataaaaaattagctgggcatggtagctcacacctgtggtcccagctattcgggagactgaggtgggaggattacttgagccgagggggtcgaggctgcagtgagctgtgatctccccactgctctccagcctgggcgacagagcaagaccctgtctcaatcatcatcatcatcatcatctgacaatctttttccttatggcttctgggccaaaggaataaatgaaggtataaggcttgttgataactattaataacacacattaaaaaaaaactatgcataacacacatttgaaatctacagcacattgcctgaagttagcatgttgggttctggctctgtctcttgcttcaacagtgtttagaacgaacagaccagggggatccctcttccagcctgtgatcgcctcccatctccttttcacttgagcctcccagaccatcttcttggcaacctcctgcttctgggcccagccaacaccgtttttgtggatatcttcttcttgtccccaagcatgagctcctagatgtgttagaatgattccacccaggcagaggcagccaccaactgccccgtcaaccggcatctctctggacttctactttggccacgatgacatggctctggaaggtgaactggccaagcatctctggaagatgcaaagccagcgtggcagcctgctcttttgcaggacctgcagatgagatgaatgggataaaaccctggacgccgtgggggtagccctggccctggagaggagcctgaacctgggttctgctgacacagacgtcacctctgggacttcctagagaggcctttcctagatgggggagtgaaactcgtcaagagggtggatgatcacctgacctctgcgggctggccacctggagccgggccaggcaactgtcttttccaaagtctggccaccctcaagcatgactgggagcctagcgagcccagtgacctctgagaggctcctctcaaaggatcagggtttctgcctgcctgagcctccccctccagccactaggcagctttttaaccctggagccctctcccaagcctggatcaaatttgcagggacaaaacgggggcaggggctggggtggggaaatcaaattaatgaccttcttagggtaaggatgttccaggaagaggaaacctgccatcccacaacccctagaccataatagcaattattccctccagggatcaacaaaccagtgacagactctagaaccattgaaatctactgattaaggccaggcgccgtggctcccacctgtaatcccagcactttgggaggccaaggtgggaggatcacgaggtcaggagctcgagaccagcctggacaaaatagcaaaaccccgtttctattaaaaatacaaaaaaaatttagctaggcgtggtggcgggttcctgtaatcccagctactcaggaggctgaggcaggagaaccacttgaacctgggaggcagagattgcagtgagccaagattgtgccattgtactccagcctgggtgacaagagcaagactccatctcaaaaaaaaaaaaagaaaaagaaaactctactgattaatgcctatcttaactccagtgtcagtagtagctttgacaaaggccttttatatcacatggctatactttgccaagcatactgaacactattataattgtttcctaataccccatgtgatacccacatgcttcttcataagtttgtaacacatttaaaaatagcatgacgccaggggtggtggctcatgcctgtaatcccagcactttgggaggctgaggcaggttgatcgcctgaggtcaggaattcaagaccagcctggccaacatagtgaaaccctgtctctactaaaaatgcaaagaattagctgggcatgggctgggcgtggtggctcacacctgtaatcccagcactttgggaggctgaggtgggcggatcacctgagattgggagttcgagacctgcctgaccaacatggagaaaccccgtctctactaaaaatacaaaattagccaggtgtggtggcccatgcctgtaaccccagctaattgggaggctgaggccagagaatcacttgaacccgggaggcagaggttgcggtgaaccaagatcgcatcaatgcaccccagcctaggtgacaagagcaaaactccgtctcaaaaaaaatttaaaaaaatgaattagctgggtgtggtgggcgggagcctgtaatcccagctactagggaggctgaggcaggagaattgcttgaacccaggaggcggaggttgtggtgagccaagatcacgccattgcactccagcctggacaacaaaagcaaatctctctctctcaaaaaaaaaaaaaatcagataatctagaatggtaaaaagaagagagtaaaattacctaaataaattaccaaattcccatcatctggaggtaactattcatagcacagatttttaaaaaatgggttatcatataatgctttctattttttatcctgcttttttaaacttaatttttctacttacattgttttatgctaataaatatatatcttcattgaaataactgcatagctttctgttgtatatatcataatttatttaactcatactaatggggcatttgtaaacaaatctatgatagaaatgcatctcttcatatatatatgtgtgtgtgtttgtgtgtgtgtgtgtgtgtgtgtgtgtgtgtgtatttagagataggctcccactctgctgcccaggcttgtgtgcagtggtgcaatcatagctaactgtaaccttgaattccggtgtcaagtgatcttcccatctcagcctcctgagtagctgggaccacaggcaggtgccaccatgcctggctaatttatttttatttttatttttttgtagagctggggtctcaccatattgcccaggctggtctcaaactcgtggcctcaagtgatcctcctacctcagcctcctaaatcattgggatttagaggcatgagccactgtgcccagtctcttgacatattttgtaaataaaaaacaaggaagaaatatttataacacaggcgtgtgccaccatgcccagctaattttttgtacttttagtagagacagggtttcacaatattggccaggctggtctcaaactcctgacctcaagtgatccgcccaccttggcctcccaaagtgctggcattacaagcatgaggcattgcgcctgaccttaaaggactaatttctttcttttttttcttttcttttgagacaggatcttactctgtcacccagactggagtgctgtgataaaatcacagctcattgcagtctccatgtcccaggcgcaagtgatccacatcagcttcccaagtagctgggactacaggggcacatactacacctggctaatttaaaaaactctttgtagagacaggttcttgccatgtttcccagactggtcttgaactgctgacctcaagcgatctttctgcctcagactctgaaagtgctgagattacaggcatgggccactgcacccactgaaaggactaatttcttcaatatgtaagtggtttctataaatatatgagaaacagattaataacacaataggaaaatggacataggacaggagcaaacaattcacagaaaagaaaattgttcctttttttcttttgagatggagtcttgctctgtcacccatgctggagtgcagtggtggcactatctcggctcactgcaagctccgcctccggggttcacgccattctcctgcctcagcctcccaagtagctgggactataggtgccggccaccacgcccggctaattttgttttttgtatttttagtagagacgaggtttcaccgtgttaaccaggatggtcttgatctcctgacctcgtgatccgcccccctcagcatcccaaagtgctgggattacaggtgtgagccaccatgcccggccaaaaattgttcttaaacacatgacaagatgtgcagcttcacttagcataagaaaaatgaccattcaatgtatgaagtggcattttttaatatttcagattgacaaagataaaacaagactgttaatacttttgtttacaagagtgcagagaaatgcatcctcatgcattgttggtcagtgtaaactggtacaacctctttggaaggcagttgggtaagtagctatgaaaatctcaaatgcagctgggtgaggtgcctgtcatcccagcactttgggagactgaggcgggtggatcacctgaggtcaggagtttgagatcagcctggctaacatagtgaaaccctgtctctactaaaaatacaaaaaaaaaaaaaaaaaattagccaggcatggtggcaggcacctgtaatcccagctacttggaggctgaggcatggagaattgcttaaatccaggaggcagaggtttcagttagccgaggtggcaccactgcactccagtctgggcaacagagtgagactccatctcaaaaaacaaacaaacaaacaaacaaaataaaatctcaagtgcacgtaccgtttgtgccagtaattccacaaccgggaattttacagatactctcacagatgtgaaaaaagaagtatgcgcacagatgttccctgcagtatcgttaataatagaaatacactcaaggccgggcgcggtggctcacgcctgtaattacagtactttgggaggccgagatgggtggatcacttgagggcaggagttggagagcagtctggctaacatggtgaaacccagtctctactaaagatacaaaaattagccaggcgtggcatcacacccctgtagtcccagctactcaggaggctgagttgggagaatcacctcaacctgggaggaggaggttgcagtgagccgagatcacaccattgcactccagcctgggtggcagagagagaccccatctcaaaataaataaaatacaataaaataaaataagaaaggtgaacattagcagcagcaaggcagccatcacctttgctctgtgaagcctgtggtagggatggatatgaattagctgtggtgggagggactgagtaagctctgggaccatgtggctctgctggacacagcaggggaaggcagtggtccaggcttcccaaaaaccagccttgaggaataaagataatgctccgaattttcagaactgctctgctcactctgagtcagagtggaaaatactgactgctgcatctagcaaaggagatgtttcagcactgttttgggaagaagggcctgtagggcttatctgacgagggccttactgtcatctccgcatcatgccaagcagcctttccttagacccagggctcccacccccactttcagattagctgccagcctccaacactctgctgttttcctttcctgagaagcagcccctgtgaaagctgtttttctgagcatcaggcctgagcataatctgctttagcagctgaagtggtctgctcttcttttactgaaagcactttaatacagaaattctgttgaccttttagatttatatatgcttctccctcccctctgggcttttcctggaagtaggttggcaaggtttactggaacagtatggttcctacccccacaccagccaagaccttgagaagagagaaggtgctgagccactcaagcacatggccaggggagcttagaaaaacagggacttccaacctgcctgggcaatatagtgagaccccattctccaaaaacaaggaaaaaagaaaaaagaaaaagagggaccctccaaacacaagcagggagaagctgaagaagtgggtgctagaagagcctggagatgtgtagatggcagcctgtctgctgctctgggccttggccattgcctgtgctgctgatgcttctgccgtctcttcttctttcacaaaactacaagagctcaggttgcggctgctcaaaagcttcccgcaatgtgctgattcactctaagtgtctgctcctctgcagactgacttcatgcacttaaaataattcactcatttcattgttagctctgtcctctccacttgcatttcaggccagagcagtacaatgaggtcccaagctctgtcctgtaaaccacagataaaattctaaggcccctccacaaccatctgaatgggcccctcttcttggctaaggacattcccaaggaaatctgaaaatctagttcaggacatgacggaagagcaggtcacacaagcatcattataacctcctcccttttggaattcaggaaaagccaaccagcattaacatcaacacagatcttaagtctggtaagaaacatttacaatctattttctctgaagtttgctacctggaagcttcatctgcctgataaaaccttggtctcaacaactgcttatcataacccagacattcctttctactgataataactctttcttcttcttttttttttcctagacagagtctcgctctgtggcccagactggagtgcagtggccccatctcagctcaccacaacctctgcctcccgggttcaagtgattcccctgcctcagcctgctgagtagctgggattacaggcatgcacaaccacaaccagccaattttgtatttttagtagacacggggtttctccatgttggccaagctggtctcgaactcctgacctcaggtcatccacccgcctccgcctcccaaagtgctgggattacaggcgtgagccatggcccctaaacaactctttcaaccaattgccaatcagaaaaaatttaaaatctgcatgtgacctggatacactccccacaagaacttcaagttgtcctgcccttccatatggaaccaatgtaagtcctatatgtatttgactgatgtctcatgtctccctaaaatatataaaactaggctgtgtcttagcaccttgggcacctgctctcaggatctcctgagggctgtgtcatgggccactgatcactcatatttggctcagaataaatctcctcaaatacatttttgccaacagtccactgggctcaggtgagcagggcctgaaacagataacatggaaatttataataaaataagggacccatgccttaagacataccacaaagtaaatataacactgtacaggctctctcgggtgaccctggactacagaatgtgggttgtggggagggagagacgtggactttttcctgcaggtcatggcttgggtgcacctagaaacaggccaataccaccccttcttttctggaaaggtggggcctgacagctttgcgtggggaaccagtgtcctgttacagttcaggtctaaaatgcctgctgagtaaataaacatgttgttctcaacctaacccaaaaagcctgatatttgtaggaataaaattgctctttcctaccctgggcaaactgcttccctgacaaatatgctcagtcatggagtggagacagataagtaaagagatgctgggaatagagcagagacagataagtaaacagatgctggggatatgtcatgatacagagccaggccagagtcaagcaaggtgttgcattggcatactgccggcctttcctgcaggaaaaggtgtgaaaaagctcttgaggtgatgggaaggggtgtgctgttttgaaatgggaagataaaaacagagccatgggggttctgcaccatcgccttggaacaaatggtgtctgcctccacatctgcaatgactcagatctctgctctgggcatacttgcagtcaaatcagggctgcccagacatcctgtgtttgtgaaatgctgagaaagactaactggcttccagcagttgcctactcatccaccctcttccaaacacccaggctggggagtaacattttggggatgagtccttgtaatgctgcttctctctggagagcaatgtgtgaaaattgacccaaggagttgtctcatgggatgaggcataattggctgtcttttttcggaacctccttgaggctcatctacccccgtgccctgagctcactggggcctgcctggccaaacagaatatacccattaagggaataaatttccaggccacaataacaagcatcaccactttgaaaagaaaaagccatgaactgaaattcttcaaaataagaatttttaattagcccaataaacacattaaaagatataaggaagatactagaactatgaaacaaatgaacacaaaaacaccaaaaagaaccgacaagaaatactaagttgaaaacataacagttgaggctgggcacggtggctcaagcctgtaatcccagcactttgggaggccaaggagggtgaatcaactgaggtcaggagttcgagaccagcctgaccaatatggtgaaaccccgtctctactaaaaatacaaaaactagccaggcgtggtggtgcatgcctgtaatcccagctactcaggagactgaggcaggagaattgcttgaacctgggaggcagaggttgcagtgagccgaggtcgtgccacagcactacagcctgggtgacagagcaagactccatctcaaaaaaaaaaaaaagaaagaaaagaaaatataacagttaatgccaggtgcagcagctaactcctgtaatcacagcactttgggaggccgaggcgggcagatcacctgaggtcagaagtttgagaccagcctgaccaacatggagaaaccccgtctctactaaaaatacaaaattaaccaggtgtggtggcatttgcctgtaatcccagctactcaggaggctgaggcaggagaattgcttgaatccaggaggtggaagttgcggtgagccaagatcacagcattgcactccagcctgggcaatgagagcaaactctggctcaaaaaaaaaaaaaaaaaaaaggtgggggggcggggctcagtggctcaggcctgtaaccccagctctttggtgtagggaaaagaaagagagatcagactgtcactgtgtctatgtagaaaggaaaggcataagaaattccattttgacctataccttgaactattgctttgctgagatgttgttaatttgtaactttgccctagccacttcgccccagccacttcgccccagccactttgccccaactttgagctcacaaaaacatgtgttgtatggaatcaaggtttaagggttctagggttgtgcaggacgtgccttgttaacaaaatgtttacaagcagtatgcttggtaaaagtcattgccattctctagtctcaataaaccaggggcacaatgcactgtgaaaagctgcagggacctctgcgctgaaaagccggtattgtccaaggtttctccccatgtgatagtctgaaatatggcctcgtgagatgagaaagacctgactgtcccccagcctgacacccgtaaagggtctatgctgaggtggattagtaaaagaggaaagcctcttgcagttgagatagaggaaggccactgtctcctgcctgagataggagaaaaaccaccctatggcaggaggtgagacatgttggcagctatgctgccttgttattctttactccactgagatgtttgggcggagagaaacataaatctggcctacgtgcacatccaggcatagtacctccccttgaacttaattatgacatagattcttttgctcacattttttttttttttttttttgctgaccttctccttattatcaccctgctctcctactgcattcctcttgctaagataatgaaaataataatcaatacaaactgagggaactcagagaccagtgccagtgcatgtccttggtatgctgagtgccggtctcctggacccactgttgtttctctatactttgtctctgtgtcttatttcttttctcagtctctcatcccacctggcaagatatcccacaggtgtggaggggcaggtcacccctttacttttggaagccgaggcagggggatcacgaggtcaggagatcaagaccatcctggctaacatggtgaaaccccgtctctactaaaaatacgaaaaaaaaattagctgggcatggtgttgggtgcctgtagtcccagctactcgggaggctgaggcaggagaatggcatgaacccaggaggcagagcttgcagtgagctgagattgcaccactgcactccagcctgggtgacagagcgagactctgtctcaaaaaaaaaaaaaaaaaaagaaaaaaagaaaaaagaaaacataacagttgtactaaagaacacaaatgattgaataaactgcaggatggacagagctgaggaataaattagtggactggaataacagaaattcccctaaaggaagaagaaaaaagaacaggaaatataaaaagaatatacaaaatagaatataaaaaggaaatataaaagaatagctaagggatatggagaataaaagtgaaatggcaacattcagaagataggattcctggaaagagaaagagaaaaatggagaggaggaaatatttgaaaaaataaagaataaaaaattctcagaattaggaaaaaagatgaaatgtgaacacaagatctgtatacagattattcctcattaaaaataattttggccaagcgtggccaggcgcggtggctcacgaaatcatgccactgcactccagcctgggcgacagagcaagactctgtctcaaaaaaaaaaaaaacaaatttttggccaagcgtggtggctcacgcctgtaatcccagcactttgggaggcccaagaccagaggatctcttgaacctaggagttggagatcagtctgggtgggcaaaaccctgtctctaccaaaaaaaaaaaaaaaaaaaaattagcctggtgtggtggcacaaacctgtaggtaggagggtcgcttgagcctgggagatggaggctgcagtgagccatgatcactccactgcacttcagcctgggcaatagagcaagaccctgtctaaaaaaaaatattttggggaaatttaagaataccagagacaaaaagaacattctaaacatttccagagagtcagagatcacagataaaggaagaagaggcctatttacttatttatttatatctttttgagacagggtctcactctgttgcccaggctggagtgcagtggtgccatctgggttcactgcaacctctgcctcctgagttcaagcgattctcttgcctcagcctcctgagtagctgggactataggcgcccgccaccacgcctggctaattttttttttgtatttttagtagaaacggggtttaactgtgttagccaggatggtcttgatctcctgaacttgtgatccactgcctcagcctcccaaagtgctgggattacaggcatgagccaccacaccagcccggtttttcaatatacttgtccatgggtccctaaatgtcttgtcgtagattctttaaaaagagtgtttccaacatgctgaatcaaaaaaaaaaaaatggtttaactctgtgtaatggatctgttcatcacaaaacttttttacaggtagcttatttctagtttttatcacgggacattcagatttttaatacgggcctcaatgggctccacagtgtcccttcatagattctacaaaaagagtgtttccaccccgcccttcatagattttccataaacagtgttttcaacgtgctgaatgaaaacaatggtttaagtcttttagctgaatctactcatctgaaagcattttcacagatagcttgtttctagtttgtattgagagataatcgatttttcactataggcctcaataagcttctaaatgtccctttgtagattctttaaaaagagtgtttccaaccttgtgaatcaaaacaatggtttacctatgtgagatgaatgcacacatcacaaagcattttcacagatatcttgtttctactttttatcatgggatattcggttttccaccataggcctcactgggcttcataacgttcccttgtagattctacaaaatgaatgttttcaacctgctgaatcaaaacaaaggtttaaatctgtgagatgaatccagacatcacaaaggattttcacaggtaccttgtatgtcgtttttattaagggaaatttgatttttcccaacaggcctcaatgggctctaaatgatcccttcctagattctacaaaaagaatgtttccaaccttctgaatcaaaacaaagtttaactctgtgaaaggaatctgcacatagcaaagcattttcacacattgcttgtttctagttttaatggcaggatattcggtttttcacaatataccttaatgggcttcgaactgtccctttatagattttacaaaaggaatgttttctaactgctggatcaagacaaaggtttaactctgtgaaatgaatccgcacatctaaaagcatttccacagtttgcctgtttctagtttttatcgtggcatattcagattttcactataggcctcaatgtgctttgatacgtcccttcttagattttactcaatgagtgttttctacctactgaattaaaagaaaggtttaacactgtgagatgaatccacacattgcaaagaatttccacaggtagcatctttctaatttttatcgcaaatattcatttttttcacaataggcctcaatgggctctgaagtgtcccttcatagataccacaagaagcttgtttccaacctgctgaatcaaaacaaatgtttaactctgtgagataaatgcatgcatcataaagtattttcaaatataactagtttttagtttttatcatgggatattcagtttctcactataggctgcaatgggctaagaaatgtccctttgtagatactgcaaaaaagtgttaccaccctgctgaatcaaaacaagggtttaactctgtgaaataaatgaacacatcacaaagcattttcacagatagcttttttctaatttttatcgtgggatgctttttttccactataggcctcaatgtgctttgaaatgtccctttctagattctacaaaaaaggtatttaaaacctcctgaatcaaaacaaaagttaaactcagggagatgaatgcacatatttcagagaatttttacagatagcttgtttctagtttttatcacgggatattcattttttcactataggcctcatttggctccgaaaagttcctttgtagtttctaaaaataaagtgtttccaacccgcacttagtagattttactaaaacagtgttttcaacctttttaataaaaacaaaagtttaattatgtgacatgaatatacacatcacaaagtatttacatagatagcatgtttctagtttttatcatgggatatgcggttttttactgtaggcctaaatcagctctgaagtgtcccttcttaggttctagaagaacagtgtatcctacctgctgaaccaaaataatggtttagccctgtgagatgaatccacagatctcaaagcatgttcacagatagcttgtttctagtttttatcatggaatgcttggtttctcattataggcttcactgggctctaaaatatccattcgtagattctataaaaagagtgtttccaacctacttaatccaaataaatgtttcactctgtaaagtgaatccaaacatcacaaagcattttgatggatagcttgtttctagttttaatcatgggatattcagtctttttctgtagacttcaatggtctctgaaatgtcccattgtagattttacaaaaagagtgttgccagccagctgaatcaatacaaacgtttaactctgtgagataaatcttccatcacaaagcattttcacagatagcttgtttctggttttcaaggcgaaatattcagtttttcactataggcctcaatggactccaaaatgtttctttgtagattttacaaaagagtgtttccaacctgctgaaacaaaacaaaggttaaactgtgtgagatgaatccacactttgcaaatcattttcacaaattacttgtttctagtttttatcatggaatattcagttttccactgtaggcctcaatgggttccaaaatgtcccttcgcagatactacaaaaagagtgtttccaacctgctgaataaaaactaagatttagctctgtaaaatgaatccacacattgccaagcattttcaccaatagtttgtttctagttctaattgcaggatattcggtttttcactataggcctcaatggcctccaaaatgtccctttgtagatcccattaaaaggatgtttccaacctcccctttgtagattttacaaaaagagtatttccatcctgctgaataaaaacaaaggtttatctctgtgagatgaattcacacatcatgaaacattctcatatgtagcttgtttcaagtttttatagcgggatatttagttttatgactataggcctcaatgtgctccgaaatgtcactttgtaaactgtgtcaaaagagtatttccaacctgatgaataaaaataaaggtttaagtctgtgagatgaatccacacatcacaaaccattttcacagacagcttgtttctacttttcatcatgggatatttggttattcactatagacttcaatatgctctgagatgtccccttttagttctacaacagagtgtttcaaacctactgaatcaaaacaaagatttaactctgtgacatgaaatgacccattgtaaagcatttttacaggtagcttgttcctagtttttattgcagaatattcagttttttactacaggcctcaatgggctttgaaatgtcctcttgtagattctacaaaaagagtaattttggtctgctgaatcaaaacaaaagttaactctgtgagatacatccacacattgccaaggattttcacagatacatttttctagtttttatcatggaatatttggttttttactacagttctcaatgtactctgaaatatcccttaatatattcttgaataagtttgtctccaacctgctgagttaaaacaaagctttaactctgggagatgaatccacacatcacagcacattttcactgatagattgtttctactttttatcttgggacaatctgtttttgactataggcctcaatgggctttaaaatgtcccctcgtagattctacgaaaagagtgcttcaaacttgcttaatcaaagcaaaggttaaattatgtgagatgaagccacacatcacaaagcattttcacatatagcttgtttctagtttttatcatgggagatttgattttttactataggcctcaattggctctgaaatgtaaacttttatattctacaataaaagtgttttcaacctgctgaatcaaaacaaatgtttaactccatgagatgagtccacacatcacaaacattttcacaagcagcttgtttctaatttttattatgagatattcagtttttcagtacaagcctcaatgggctccaaaatgtttcttcatagattctaaaaatagagttgttccaacctgccaaatcaaaacaaacatttaactctgtgagataaatccatacattgcaaagcattttcacagatagcttgtttctagttgtttattgtgggatattttgtttctcactataaacctcaataggctctgaaatgtcccctcatagattctacaaaaaaagtgctttcatcctgctgaataaaaacaaaagtttaactctgtgacatgaaatgacacatcataaagcatttcgacagagagctttgttctagtttttgtcatggcacattcagtttttcactacaagccacagtgggctccaaaatgtcccttcgtggattctacaaaaagtgattttggcctgctgaatcaaaacaaaggttcaactctgtgagatgaatccacacatcacaaagaattttcacagatagcttgtttctagttttcatcctaggatattagggttttttcatgcatttcttcatgggctctgaaatgctcctttgtagattctacaaaaagtgtttccaacctgctgaatcataacaaaggtttaactctgtgagttgaatccacacatcatgaaacattctcatatgtagcttgtttctagtttttatctcgagatataaagtttttaactgtaggcctcaatgttctctgaaatgtgccttcttagattctacaaaaagagtatttccaacctgttgaatcaaaaccaaagtttaactctttgagatgaattgacacattgcaaagcattttcacagatagcttttttctagtttttgtcacagaaattcaggttttcactgttggccattgtggaccccaaaatggccctttgaagattctacaaaaagagtagttccaacctgctgaatcaaaacaaaggcttaaatctgtgagatgcattcacacattgcaaagcattttcacagatagcttttttctagtttttgtcacagaaattcagtttttcactgttggcctttgtggactccaaaatggcccttcatagattctgcaaaaagagtagttccaacctgctgaaacaaaacaaaggcttaaatctccacacattgcaaagcattttcacaaatagcttgtttctggtttttatcacaggatatttggtttttgactttagacctcaataggctccaaaatgtctcctcctagattatataaaaagattgtattccacgtgctgaatcaaaacacagttaacttggtgagatcaatctgcacatcacaaagcattttcacagatagcttgtttctcgtttttatcacaggatattcagtttttcactataggcctcaaagcacaccaaaaagtcttcttgtagatccaaaaacagactgtttccaacctgcttaatcaaaacaaagatttaactctgtgaaatgaatccacacatcccaaagcattttcacaggtagcttgtttctagtttatatctccagatattttgtttttcactacaggcttcaatgggctttgaaatgtttcttcatagattgtactaaaagagattttccaacctactgaattataacaaagatttaattctgtgagattaatctacacatcacaaagcattttcatagatagcttgtttctagtttttattatggtataatttgtctttcattgtaggcctcaatgggctttgaaatggcccttagtagattctgcaaaaagagtatttccaacctgctgaattaaaataattgtttaagtctgtgagacaaattcacacaatgcaaagcattttaacagatattttgcttgagtttttattgcaggatatttggtgtctcaatatactcttccatgggctccaaaatgtccctttgtatattctacaaaaagagtgtttccaacctgttgaataaaaacaaaggtttaattctgagagatgattccaaacatcacaagacctttggacagatagcttgtttctagttttcattgtgggatattcaacttttcaccgtagtcctcaaggagctttgtaatgtcttttcatggaatctacaaaaacagtgtttccaccctgctgaatcaacacaaatatttaactctgtgagatggatccacacatcccaaaacattttcataaatagtttgtttccatttttcatagaagaatatttgctttttctatatatttatccatgggctccaaaatgccccttcatagattctaaaaaaagaatagtttcaatctgctcattcaaaacatatgtttaataatctgagagataaatccacccatcacaaagcattttcacagatagcctgtttctagtttttaatttcaggatatttagtttttcattgtacacctcaatgggctccaaaatgtcccttcatagattctacaaaaagagtgattccagtctgtggaatcaaaacaaatgtttaactctgtgggatgaatccactgactgcaaagcattttcacagataggttttttctagtttttatcatgggatatttggttttttactcttggcctcaatgggcttcaaaatgtcccttcgtagattatacaaaaagagtgtttccaagctgctgaatcaaaacaaagaattaactctgtgacatgaatccacacatcacaaagcattttcacagatagactgtttctagtttttatcatgggatatttagtttttcactatagacctcaattggctctgaaatgtcccctcatagattcttcaaaaatagtatttccagctctgctaaatcaagacaagagattaactttgtgatatgaatatacatatggcaaataatttttagtgataagttgtttccagtgtttttgatgtgatattcagtttttcactgtaggcttcaatggcctctgaaatgtccacacgtaggtggtacaaaaggactgtttccaacatgctgaatcaaaacaaaggtttaactctatcagatgaatccaaacattgcaaaggattttcacaggtagcttgtttctagtttttatcgtgagatatttggatttttactaatggccctaatggactctaaaatgtcccttcttagattttacaaagagagtgtttccaacctgcttaatcaaaacaaaggtttaactctgtgagatgaatctacacatcacaaagcatttttagaaatagactttttattgttattgttgcaaaatattcagatttttaccgtaggcattaatgggtgttgttgggaaaaggtgagtgttgggagaagctgagacagggcttgcatgtctgacataatgtaaaagagtcttggaacatgtccagggtccagggtctaaaaccccttgtggcatttggaacaccaaagtctgtgctaaagggtggaaggctatccagatgcacaataatctaagcccagggcataaaatccctgatggcagggatagaatccagggtttgtggctttggaatgtgtccagaattgctggatccttgctccttgctctcccagaattgattgtatcttgagttagaagaacctgctctccattatctcaagtagcagagcaaatgctaaaccatcacagctgtaaatcatgtgtttaatgcaacacactcttttgaccacattctcaccacctgtttctttgttggattaccaataaatactacgggcttccagagctcaaggccttcatagcctccatgatcgtgatggaccctggtcccactttacttctcaaactgtctttttctcaatcatttgactccaccggacttcatcaaccccacaacctggtgttgggtctgatcaccccaacaggtgtgatgtatcctttcataaatccatgcattgcaaagtattttcaaagatagcttgcttgtagtttttatcacgggatattcaggttttcactattggcctcaatgggctctgacatgtttcttcatagattctacaaagggagtgtttcaaacctactgaatcagaagaaaggtttaattctgtgagatgaatccacacattgcaaagcattttcacagatacttttcttctagtttttgtcaaaggatattcagtttttcagtataggcttcagtgggctctgaaatatcccttcgcagattctacaaaaggagcgtttccaatctgctgaataaaaacaaaggtttaactctgtgagatgaatccatactactcaaagcattttcacagatggcttgtttctaacctttataatgagacattcaatttttcactattggcctcaatgggctccatagtgtctcttcctagattctacaaaaacagatttttcatttctccaaatcaaaataaaagtttactctgtgatatgaaatcacacatcacaaaggattttcacagatagctttttctagtttttatcataggatattgggtttttgactataggcttcagtggactcttaattgtaccttcttaaatgctacaataaagtattttcaacttgctggatcaaaacaaaggtttgactttgtgagacgaatcctcacatcgcaaagcattttcacccatagcttgtttctagtttttaccgagagatattattttttcactagaggcctcaatgggctcctaattgtccccttgtagattctacaaacaaagagtctaacctgctgaagcaaaacaaagtttaactttgtaagatagacctacacatcacaaagcattttcacagataggttgtttttagtttttatcaagggatatttgatttttcactgtaggtctcaatgggctatgaaatgtcccctctagatccacaaaaaaaagtttccaacctgttgaatcaaaagaaaagttcaacttgtgaaatgaaatcacacatcataaagtattttcagagatagcttctttatagtttctatcactggatatttggtttttcactatagacctcaatgaacttcaaaatgtctctttgtagattctacaacaagagtgtatccaacctgcagaataaaagcaaaggtttaactctgtgagatgaatccacacatcacaaagcattttcagagataattttttttattgtttttatcgcaaaatactcacttttttactataggcttttataggtgtgaaacatccctttgtatattctacaaaaaggtattccaaacttgctgaataaatgcagaggtttaaatttgtgacatgaatccacatattgcacagcatttttactgacagcttttttctagtttttatcacgggataatcagtttttcagtataggcctcaatttggtccgaatagtaccctagtagattgtagaaaaagagggtttccaacctgctgaattacaagaaaggttaaactctgtgagataaaatcacacattgtaaagaatttttagacatagcttctttgtagtttttattacaggacatttgattttttactataggcctcaatgagctctgatatttcccctggtagattgtacaaaaagagcatatccaatctgctgaatcaaaacaaacatttaactctgtaagacaaatctacatatcgccatgcattttcacagatagcttgcctctagtttttatcacgggatatttgatttttcactataggcctcaatgggctccaaaatgttgcttcatagattctacaaaaagagtgtttccaacctgctgaatcaaaagaaaggtttaactttttgagataaatacacgcattgcaaaacatttttacaggtagttcattttagtttttatcatgggatattccatttctcactataggaatgaatgggctctgaaatgtcacttcaaagattctacaaagagagtgtttccaacctgctgaatcaaaacaaacatttaacttgttgagatgaatcctcacatcactaagcattttcacagatagattgtttttagttttatcatgggatattcagtttttgattataggcctcaaagactgaattgtggccaagcagatagtaaaacatatgtgtctccaaccttctgaataaaaatcaaaatttaactatgtgagatacatccatatatcacaaagcatatttacagatagccagtttctagttttaatcatgggatattcagtttttcactacaggccttaatgggctcaaaaaagactcctcttattctactaaatatttgcttccaatgtactgtataataacaaatattaaacgctgtgaaagaaatccacagatcacaatgctttttcacaaatagcttgtttctagtttttatcacaggatatttggtttttcactgtaggcctcaatgggctatgaaatgttcctttgtagattctataaaaagtgtgtttccaacttgctgacttaaaataaaggttttacactgtgagatgaatccacacattgcaaagcattttcacagatagcttgtttctttttcttatcatgggatattcagtatttaactagagacttcaatgggctctggaatgtcccatagtaaactctatacaaagagtgtttccaactggctgaataaaaacaaaggtttacgtctgtgaggtgaatccacacaacacaaagcattttcactgacagcttgtttctagttttatagcaggattttttttcaatattggtctcaatgggctccaaaatgtccctttgtagattctacaaaatttttttccaacatactgaatcaaaacaaatgtttaacactgtgagatgaattttcacatcaaaaagcatttttacagtagtttgtattagtttttattatgaaattttgaatttttcactgctagcctcaaaattgtcccctattagattctactaaaagaatatttccaacctactgtatagaaacaaaagtttaactctgtgaaatgaatccacacattgcaaacctacttcacagatagcttgtgtctagtttttatcaagaattatttggcttttcactataggcctcaatgggctccaaaatgtcccttcatatattttgctaaaagagtgtttccaacctagctgaatcaaaagaaagtttaaactctatgaggtgaaactgcaaattgcaaagcattttcacatatagcttctatagtttctatcatggaatattcagtttttcactatcggcctccatgggctatgaaatgtcccctcgtaggttctacaaaaaaagtgtttctaacatgttgcatgaaaacaaagatttaactttgggagatgaacccacacattgcaaagcatttctatagaaagattttttctagtttttatcacaggatattagatttcatactgtaggcctcattttgctccaaatttaccccttgtcaattctacaaagagaatatttccaacctgctgattcaaaacaaatgttcaattctgtgagatgacatgcaaagcttttcacagatagcctgtttctagttttcatcataggacatttggtttttcactataagcatcaaagggctctgaaatgtccctttgtagattctacaaaaagagtgttcccaacctgatgaatcgaaagaaaattttaactttgtaagatgaatccacacatcacaaagcattttcactcatagcttgtttctagtttttatcgtgggttattggttttcactaaatgcctcaatgagctatgaacagtcccttgtagattctacaaagaaagaatttccaatctgctgaagcaaaacaaagttttaactttgtaagatgaatctacacatcacaaagcatttttacaaaaggttgtttttagtttttatcaagagatattctatttttcacagtacacctcaatgtgctacaaaatgtcccctagtagattctacaaaaaaactttctaaactgctgaatcaaaagaaaagttcaactggtgagatgaaatcacacatcacaaagtattttcagagatagcttctttatagtttttatcatgggatattagatttttcaatataagcctcaatgagctctgaaatatccctttgtagattctacaaaaaaagtgtttccaacctgcaaaataaaaaggaaggtttaattctgtgagataaatccacacattgcaaatcatcttcacagttggcttgtttctaatttttattgtggaatatttggcttttcactgaaattctcaagtgctctgaaatgtccctttgtagattctataacaagagtgttttcaaactgctgaatgaaaacaaaggtataacgctttaagaggaatccacacatcacaaagcatatattcagatatcttgtttctagtttttaaagcatgatatttggtttttcactataaccctcaatgggctcagaaatgtctcatagtagattttacaaaaacagtatttcctacctgctaaatcaaagcaacagcttaaatctgtgagattaatccaaacctcgcaaagcattttcacagatagcttactcctagtttttatcgcaggatatttggattttcagtataggcttcaatgggctctgaaatgtccattcataagttatataaaaagtatgttcccaaacccctgaaaaaaaaatgaaggtttaactctatgagatgaatccacacgatgcaaagcattttcacagatagcttgtttctagcttttatgatgagacattcgaatttttactattggcctcaatggggtcagaaatgtctttttgtagattctacaaaaaaaaaaggcttttatttttctgaatcaaaataaaggtttaactcttctatatgaaatcacacatctcaaagtattttcacagataacttgtttctagtgtttatcactggatattgggtttttcactataggcttcagtggactcttaattgtaacttcttaattcttcaaaaagtgtgtttccaacctgctgtatgtaagtaagtgtttacctctgtgagacaaatcttcacattgcaaagcattttccccaatagcttgtttgtagttttaattgcataatatttggttttgtactataatcctcaatgggcaccgaagtgtcccttcgtagattatatgaaaacagtgtttctaacctgttgaatcaaaacaaaggtttaactgtcagatgaatctacacattgcaaagcattttcacaggtagcttgtttcaagttttcatcgcaggatatacgtttcttcattataggccccaagagctccaaaatgtcttagagtatttcaaacctgcagcataaaaacaaaggtttaactttgagacaaatgcatacatcacaaagaattttcacagaaagcttgtttctagtttttatcaggagatactcagtttttcactatagacctcaaggggctttgaaacatcccttcatagattacacaaaaagattgtttccaccttgctgaaacaaacaaacaaaaaattaactctttgagatgaatcaacacattgcaaatctattcacagatagcttgtttctagtttttttttttttttttttgaagggtattctgtttttcactataggcaccaataggctcctaaatgtccctccgtagattctacaaaaagagtgtttccaacctgctgaaccaaaagaaaggtttaattctatgagatgaaatcatgcacaagaaagcatttttttgagataccttttttatagtttttatcactggatattctatttttcacagtaagcctcaatgggctttgaaatatctctttgtcgattgtaccaaaggagagtttccaatttcctgaatcaaaacaaaggtttaatgttgtgagataaatccacaaattgcaaaacattttgacagaaaacttgtttctagtttttatcacaggatatttggttttcattataggcctcagtgggctaagaaatgtcccctcatcaaatctacaaaataggtttctccaacctgctgaatcaaaattaacattcaactctgtgaaatgaatccacacatcacaaagcctttttttttttgatggaatctcactctatgacccacgctgccgtacagtggtgtgacctcagctcacagcaacctccacctcctgggttcaagcaattctcctgcctcagcctcctgagtagataggagtacaggcacacaccaccatgcccagctatttttttttttgtatttttagtagagacagggtttcaaaatgttggccaggctgctcttgaactcctgactgcaggtaatccaccagcctcagccttccaaagtgctgggattacaggtgtgagccactgcacccagccacaaaacattttcacagatagctagtttctagtttttatcaccagatattcagtttttcactattgtccacagtgggctttgaaatgtccccttgtagattctacaaaaatagtgtttttgacctgccaagtcaaaacaaatgataaactctgtgagatgaaactacacatttcaaaacatttttacagatagcgtattctagtttttaatcatgatatattcactttttcactctaggccccaatgggcttggaaatgttttttcattgattctacaaaaaaaaattgtttccaactttttaaatcaaaacaaatatttaactctgtgagatgaattcacaaatcacaaaatattttcacagataatatgtttctagtttttatcaagggttgttcttttttttattgtaggcctcagtgggctctgaaatgtccccttatagattttataagaaaagtttctccaagctgctgaatcagaagaaaagttaactctatgagataaaatcacacatcacaaagcattttcagagatagttttttaaatagtttttatcattaaatattcattttttcagtatttgcctccatgggctctgaaaagtactatcaaagagtaaacaaaattagtgtttccaacatacttagtcaaaacaaaggtttaactctgtgagatgaatccacacattgcaaagcattttaacagatagcttgtttctaatatgtatcatgggatattcagtttttcaatataagcctcaaagggttctgaaatggaacttcttagattctacaaagagactgttttcaacctcctgaataaaaacaaagatttaactccatgagatgaatccacacatctcaaagcattttcacaaatagattttatctactttttatcatggaatattgggtttttcacaataggcttcaatggactctatatcatcccctattaaattctacaaaatgagtgtttccaacatgctgtatataaacagaggttaactctttgagatgaatctatatacacaaagcatttgcacagagaacatgtttctagttttcgtagtgaaatattcagttttcagtctataagacctcaatgggctctgaaatgtcccttcatagattgtacaaaagtgggtttccaaactgcagaatcaaaacaaaggtttaactctgtgagatgaatccacacaacacaaagcattttcactaataatttgttgctagtttctatcatgggatatttggtttgtcaatatgctcatccatggaaaccaaaatgttcctttgtagattcttaaaaaaaaagtgtttccaatctgctgaatcaaagcaaatgtttaactctgagagatgatccacacatcacaaagcattttcacagaaatcttgattctcatttttatcagggaatatttagtttttcaccataggcctcaatgggctttgaaatgtcccctcttagacaaaaaaaaaaaaaaaaaaaaaaagtgtttccaacctttgaattacaactaaggtttaactctatgagatgaatccacacattacaaagcattttcacagatagcttgtttctagtttttatagagggatatccagtttttcactatatgcctcaatgggtttaaaaatgacccttcatagattccacaaaaagagtgtttccaaactgttgaatcaaaacaaagttttaactctgtaaaatgaatgaacatatcacaaagcatttttgtagatagcttgtttctagtttttatcacaggatattctggttttcactacaggcctcaaagagctccaagatgtcccttcatagattctacaaaaagagtgtttccaacctcctcaatctaaagaaaaatttaactcattgagatgcccacattgcaaagcattttcacacacagctcctttctagtttttttgctggatatgcggttttttcactataggcctaaacaggctccaaagtgtcccttttagattctacaataacagttttttctacctactaaatcaaaacaaaggtttaactctgtgagatgaacccacacatcgcaaagcatgtttacagatagcttgtttccagtttttatcatgggatgttggatttttcactgtagacctcaatgggctctgaaatgtccccttgtagatcctacaaaaagagtgtttcctacctatgaaatcaaaacaaaggtttacctctgtaaaatgaatgcaaactgcacaaattattttcacagatagcttgtttctagttttaatcacgagatattcactcttacaccataggcctcaatcagcttagaaatgttgccttgtagattctacaaaagagtgttttcaacctgctgaatgaaagcaaaggtttaactctgtaaaatgaatgaacacattgcaaagcattttcacatagagtttgtttctattttttttttgtgggatattttgttttccactctaggcctcaataggctctgaaatgtcccttcacagattctacaaaaagagcatttctaacctgctgaataaaaacaaagatttaactctgtaaaattaatccacacatcagcaagtattttcacggatagcttgtttctagcttgaatcacgaaatattaggttttttattatagacctcaatgggctccaaaaaggccctttgttcattccacaaaaaaaagcatttccaacctgttgaatcaaaacaaaggtttaactccatgagatgaatccacacattgccaatcaagttcacacatagattgtttttagtttttattgtgaaatattcaattttttactgtaggcttcaatgatctccaaaatgtattttttgtgtattctacaaaatgattgccccaactttcttagtgaaaataaagtttaactctctcagataaatccacacattgcaaagcattttcacaaataaatagttgttagtttctatcataggatatttggtttatcaatatatatgcacatgggctccaaaatatccctttgtcaatgcttcaaaaagggtgttcttaaactgctgaatcaaaacaaagttttaattctgagacccacatattagaaagcattttcacagatagcttgattctagtttttatagggaatattcagtttttcaccataggcctcgacgggctccaaaatgtccctttgtagattctacaaaaaaaaagtgttcccagcctgttgaatcaaaaccaaagtttaactttgtgagatgaatccacacatcacaaagcattttcacagatagcttatttctagttttcattgcaggatattcagtttctcaatatagtcctccttgggctctgaaatgttgcttcatggattctaaaaatatagtgtttccaacctgctgattcaaagcaaaggtataattctgtgagagaaatccacacatcacaaagcattttcaaagacagcttgtttctagtttttaacatgggatattcagtttttcagtataggcctcaatttgctccaaaatgtcttttcgtagattcaagaaaaagagtgtttccaacctgctaaatcaaaagaaaggtttgactctgtgagataaaatcacacattacagagcattttcagacatagcttttttatagtttttattatgggacatttggttttttactatatgcctcaatgggctccaaaatatcccctcatagactgtacaaaagagcatttccaacttactgaatcaaaatgaaggtttaactctgtgagatgaatttactcatggcaaaaaattttcacagatagcttgctttgtgtttttatcacaggatattccgtttttctccataagcctcaatgggctccaaaatattcctttgtagattttacaaaaaaagtgtttcaaaactactgaatcaaaaccaaagtttaactctgtgagatgaatccacacatcgcaaatcattttcataaatagcttttttctagtctttattgtgggacatttgattttttgccataaacctcaatggattctgaaatattgttttgtagattctataaaatgagtatttccaacctgctgaatcagaagaaaggtttaacactgtgagatgactccacacatcacaaagcattttcacagatacattgcttctagtttttcttgtgagatattcggttttcactataggcctcaaatggctctgaaatgtccctgcttagattctacaaaaaaaaagtgtttccaacctgctgaatcaaaacaaagttttaactctttgagataaatccacacattgcaaagcattttcacagatagatgtttctagtttttatcgtgggatattgatttttcactacatgccaaaatgggctccaaattgtccccttgtagaatctacaggcagggcattttcaacgtgctgatgcaaaacaaagttttaactgtgtgggatgaatctacacatcacaaagcatttttacagataccttgtttctagtttttatcacagtatatttggtttatcactatatgcctcagtttgctctgaaatgtcctatcatatattctacaaaaagagtgtttttttgtttgtttgtttgtttgttttgttttgttttgtttcatttttgagaatgagtctcgctcttttttgcccaggctggagtgcagtggtgtgatcttggctcactgcaagctccacctcccgggttcatgccattctcctgcctcagcctcctgagtagctgggactacagatgcctgccaccacacctggctaattttttgtatatttagtagagacagggttttcaccatgttggccaggatggtcttgatctcttgacttcgtgatccaccagcctcggcctcccagagtgctgggattacaggcatgagccaccatgcccagccaaaaagagtgtttttaacctgctgaatcaaaagaaaggtttaactctgtgaggtgaaattacacattgcaaagcattttcagagataacttctttattgtttttatagtgggatattaggtttttcactataagcctcaataggctttgaaatatctcccagttgattgtaaaaaaaagagagtttccaaactgctgaatcaaaacaaaagtttaacgtcatgagataaagccacaaattgcaaagaattttcacagataacttctttctggtttttatcacaggatattcagtctttcactatagtcctcagctgactgagaaatgtaccctcataggttctacaaaaagagtgtttccaacctgctgagtcaaaacaaaagttaaaatctgtgagatgaaatcacatattgcagaacatttttacagagagcttgttctagtttttagcatggcatattcggtttttcactataggcctcaataagctctgaaatgtcccttcatagattctacaaaaagagggtttccaacctgctaaatgaaaagaatagtttaactctgtgacatgaatccacacattgaaaaacattttcacacatagcttgtttctagtttttatcacgggatatccagtttttttagtacaggccactgtgagctccaaaatttacttctgtagatgctacaaaaagagtgtttccaaccttctgaatcaaaacagaggtttaactttgtgagatgaatccacaaatcttaaagcattttcacagataatgtttttttcagtttttattggggatatttggttttacatgataggcctcaaaggactcagaaatttcttcttttagattctactaacagagtgttgccaacctgctgtatataaacataggtttaactctgtgagataaagccacacatcacaaacattttcacagttagcttgtttctagtttttatcaaaagatatttggtttttcactataggttctaatgggctctgaaatgtctcctcatagattatacatcagtttacaaactgctgaatcaaaaacaaaaaagggtttacctctgtggaataaatccaaacatttcaaagataattcacaggcagcttgtttctagactttaccatggcatattggtttttcactataggcctcaacaggctcggaaatgttttttggttgattctacaaaaaaagtgtttccaaccttttgaatcaaaacaaagtttaaactctgtgagatgaattcacacatctcagtgtgttttcacagatagcttgtttgtagtttttgtcaagggatattcatttatttattgtcacactcactgagctctgaagtatcccctcatagattccacaaggaaagtgtttacaaactgctgaatcagaagaaaagtttaactctgtgagatgaaatcacatgtcataaagcattttcagagatagcttctttatagtttttatcaagatatattcagtttttcagaattggcctcaaggggctccaaaatgtcctctcgtagagtctacaaaattagtgtttccagactattgaatcagaacaagggtttaactctgtaagaaaaatccacacattgcaaagcattttcacagatagcttgattctagtttttatcagggaatatttggttattcaccataggactcaatgggctttgaaatgtctcttcttagattctacaaaaaaagtgcttccaaccttctgaattaaaagtaaggtttaactctatgagatgaatttgcacatcacaaagcattttcacagatagcttgtttctagtttttatcatgggatatctggtttttactataggcctcaatgggcttcaaaatgatccttcatagattctactaaaagagtgtttccaacctgtttaatagaaacaaatgtttaattatgtgagatgattccacacatggtgaagcattttaccacacagcttgtttctagtttttattggttttttactataggccttcatgggctccgaaatgtcccttggtggattctacaaaaagagtatttaccgtctgctgaatcaaaacaaggctttaactctgtgagatgaatccacacatggcaaagtgtttttacagatagtttgttttcagtttttattgggaaatatttggtttttcttaataggcctcaaagggctcagaaatgtcttttttctaattctactaaaagagtgtttccaacctctgtatataaacataggtttaactctgtgagataaatccatacattgcaaagctaattcacagatagcttgtttctaatttttatcaccagatattggtttttcaatataatctttgagatcaactcacacattgcaaagcattttcacagatagctttttttagtttttatcaagggatattcactttttattgtaggactcaataggctctgaaatgccctttcatagattctacaaaagaaattgtttccaacctgctgaatcaagaaaagttaaactccgtgggatgaaatcacacatcacaaagcattttcagagatagttttattatagtttacaccacaaaatatttggtttttcagggttggcctcaacaaaattttaactctgtgagatgaatccacacatcacagagcatttttcacaaatagcttttttctggtttttatcgtgggataactggtttttcaatataaacatcaatgggcttcaaaatattcctccttagattttactaagagactattatcaacttcctaaatacaaacaatggttaaatcagtaagatgaatccacacattacaaagcattttcacagataaactttttttactttttctcacagaatattgcattttttcactataggcctcaatggactctaaattgccctctctcacattttacaaaaacagtgtttccaacctactgtatataaacaaaggtttacctgtctgagtagaatctacacacgcaaagcattttcctagataacgttttcagttttcattgtgaaacaatcagtgtttcactataggtctcaatgggttccaaaatgtcccttcgtagattctacaaataaggtgtttccaacctgctgaaacaaaactaaggtttaacactgagagatgaatccacacattgcaaagcatcttcacagatagcttatttctagtttttatcatggaatatttggttttacactataggactcaaagccctcagaaatttattcttttagattcaagtaaaagagtttttcatacctgcagtataaaaacaaaggtttacttctgtgggataaactcacacattgccaagcatattcacagatagcttgtttctagtttttatcacaggatgtttagtttttcactaaggctcaatgggctttgaaacattcctctgtagagtgtacaaatttgacctgctgaatcaaaacaacgtttaactttttgagatgaatccacacatcacaaagcattttcacagaggcttgtttctagtttttattgcaggatattggtttttctctacaggtcaatattgtctttgaattgtcccctcatagattctacaaacaccgagcttccaagccaatgaagcaaaagaaagtttaactttgtaagatgaatctacatattgcaaagcatttttaaaagatagcttgtttttagcttttattgctggatattcagtttttcactgtaggcctcaatttgctctgaaatgttttattgaagatctacacaaagagtgtttccaaccactgaatcaaaagaaacgtttaactctgtgagattaaatcacacattgcaaagcattttgagagacagcttcatatagatttatcatgggatatttggtttttcactgtaagcctcaataagctttaaaatgtctcttcatagattgcacaaaaaaagagtttccaacctgctgaaaaaaaaagttttaacgttgtgagatgaatccacctattgcaaagcgttttcacaaatatcattttttctagttttcatcgtggaatattgtttttaagtgtaagcctcagtgggctcaaaaatacccctcatagattctacaaaaagagtttttctaacctgctgaatcaaagcaatagttcaactctttgagttgaatccacacatcacaaagcaatttcacagatagcttgtttccagtttttatcacgagatatttggttttttactgtaggcctcactagctcagaatttttccctcttagattctactaaaacagtgtttccaaaatgccatataaaaataaagttttaactctgtgtgatgaatctacacattgcaaaccattttcagacatagattatttctagtttttatcatgagatattctgtttttcactataggcctcaaaggtctccgaaatgtccctttgcagattctacaaaatgagggttttcaacctgctgaatataaagagaggtttaattctgtgagataaatccacacatcacaaaacattttcactgatagtttttttcaagttttttatcgtgtgatatttgatttttcactataggcccaatgggatccaaaatttctctttgtagattctataaaaaagtattttcaacctgccaaatcaaaacaaggttttaactgcatgagatagatctacacatcataaagcattttcacaaattgtttgttctagtttttatacggggatattttgttttttactataggccacagagagctcagaaatgtcttcttttagattctgcaagaagaatgttttccacctgctgtatataaatataggcttaactctaggagaaacatctgcacatcacaaacattttcacagatagcttgtttctagtttttatcacgggatatttggtttctcactagaggcctcaataggcccctaagtgtccctttgtagattctaaaaaaaagtttccaatttgctgcataaaaacaaaggtttaactctgtgagatgtgtgcacacatcataaagcattttctcagaaggattatttttagttttttcatgagatactctgtttttcatttgaggccacattgagatctgaaaaatccctatgtagattctacaaaaagagtgtttccagcctgcagaatcaaaccaaggtttaattctgagagatcattccaaacatcatgagacacttttacagataggttgtttctaggtttaattgtgggatattcagttttttaatataggcctcaaagggctctgaaatgtcccttcatagattctatgaaaagagtgtttccaactggctgaatcaaaacaaatgtataactctgtgagagaaatccacacatcacaaagcattttcactgacagcttgtttcaagtttttattgcaggataatcagtttttgactataggcctcaatgggctttaaaatgtaccttcatggtttctacaagaagagtgcttcaaacctgcttactcaaagcaaaggtttaattctgtgagatgaatccacacatcacaaagcattttcacgtatagcatgtttctagtattgatcactggatatttggtttggtttttcactgcagacctcaataggctctcaaatatccccctcatagattctacaaaaagaaagtgctttcaacctgctgaatcaaaacaaagttttaactttgtgacatgaaatgacacatcataaagaattttcacagatagcttggttatggtttttatcgtgtgtattcatttttccactacaggccacagtgggctccaaaatgtccactcaggcctacaaaaagagagatttttgcctgctgaatcaaaacaagggtttagctctgtgaggtgaatccacacatctcaaagaattttcacaaataccttgtttccagttttcgtcacaggatgttggtttttttcatatgcttcttcatgggatctgaaatgtcccttcatagattctataaaaagaatatttccaaccagctgaatcaaaacaaaagcttaactctgtgagttgaatccacacatcacaaagcattgtcatatatagcttgtttcaagtttttatcttgagatataaggtttttaactgtagggcccaatgttctctgaatgtgccttcttagattctacaaaaagagtgtttccgacctgttgaatcaagatagaggtttaactctgtgacatgaattgacacattgcaaagcgttttcacagatagcttttttctagtttttgtcactggatattcagtttttcactattggccttagtggattcccaaatttcctttcatagattctacaaaaagagtgtttccaatctgctgacaaaacagagctttaaatctgtgagatgtatccacacattgcaaagcatttttacaaatagcttgtttctagtttttatcacaggatatttggttttccactatagacctcaataggttcccaaatgtccccttgtagattgtacaaaaggagtgctttccatgtgctgaatcaaaacaaaggttttactccatgagatgaatccacacattggaaagcatttccacagatagcttgtttctcatttttattgtgaaatatttggtttttcactgtaggccttaatgtgcaccaaaatatcttctcgtaggttctacaaacagactgttcccaacctgcttaatcaaaacaaaggtttaactccgtgatatgaattaacacattctaaagcattttcacagatagcctgtttctagtttttatttccacttttttttcactattggcttcaatatgctttaaaatgtttcttcatagattctacaaaaagagttttccaaactgctggattaaaacaaaggtttaactttgtgagataaattcacacatcacaaaacatttttgcagatagcttgtttctagtttttatcatgggatatttggtctttcactgtaggcctaaatgggcttcaaaatggcctttagtagattctacaaagagagaatttccaatctgctgaatgaaaaagaatgtttaactctgtgagattaatccacacaatgcaaaacattttcagaggtagcttgtctttagtttttattgcaggatatcggtgtttcaatgtacttgtttatgggctccaaaatgtcccattgtatattctacaaaaagagtgtttccaatctgctgaataaaaacaaaggtttaactctgagagatgattccacacatcacagtacctttttacacatagcctgtttctagttttcattgcaggatatttagcttttcactataggcctcaatgagctttgtaatgtcctttcatataatctacaaaaagaggatttccagccttctgaatcaaaacaaacatttaactctgtgagatggatccacacatcccaaagcattttcatagatagcttgtttctactatttatcaaaggatattcgctttttctatttacttctccatgggctccaaaatgtcccttcatagattccacaaaaagagcatttcctaaatgctaaatcaaaacaaaggtttacctctgtgagttgaatccacacatttcaaagcattatcacagatagcttgtttctcatttttaatgcggatattcagtttttactataggcctcaatgtgcaccaaaatgtcttgttgtagattctgcagactgtttacaacctgcttaatcaaaacaaagttttaattctgtaatatgaatccacacatcacaaagtattttgacggatagcttgtttctagtttttatctccacatattttgtttttcactgcaagcttcaatgggctttgaaatgtttctttgtagattctacaaaaagagattttttttaacctactgaattaaaacaaaggtttaactctgtgagatgaatccacacatcatgaagcattttcacagatagcttgcttctagtttttatcgcaggatatttgttctttcactgtaggcctaaatgggctccaaaatggcctttagttgattctacagagagagtgtttccaacctgctgaatcgaaataaatatttcactctgtgagatgaatccacacaatgcaaagcattttcagaggtagcttgtttttagtttttattgcaggatattatattcagtgtttcaatatactcatttatgggttctgaaatgtcccttcatatattccacaaaaagtgtttccaacctgctgaataaaagcaaatgtttaactctgagagatgattccacacatcacaatatcttttgatcgatagcctgcttctagtttcatcacgggatattcagcttttcaccataggcctaaataagatttgtaatgtcttttcatagaatctacaaatagagttcttccagcctgctgaatcaaaacaaacatttaactctttgagatggacccacaaatcccaaagcattttcatagatagcttgttcctactgtttatcaaagaatattcactttttccatttatttctctatgggctctgaaatgtccctttatagattctacagaaagagtgtttcctattggctaaatcaaaacaaagttttacctctatgagttgaatccacacatcacaaaggattttcacagataatttgtttctcatttttgatatgggatattcagtttttactataggcctcaatgtgcaccaaaatgtcctgtagattctacaaacagactgtttacaacttgcttaatcaaaacaaagttttaattctgtgatatgaatccatacattgcaaagcattttgacagcttgtttctagtttttatctccacatattttgtttttcactacaggcttcaataggcttttaaatatttatttgtagattatacaaaaagagtttttttaacctgctgactgaaaaaaaggtttaactctgtgagatgaatccacacaatgcaaagcattttcatagatagcttgtttttagttttcatggcaggatatttggtcttttactgtaggcctcaatgggctctgatatggcccttagcagattctacaaaaagagtgtttccaacctgctgaatcaaaataagtgtttaagtctgtaagatgaatccacacaacaaaaagaatttttacagatagcttctttgtagtttttattgcaagatattcaatgtttcaatatactcatccatgggctccaaaatgtttcttggtatattctacaaaaagaacgtttccaacctgctgaataaaaacaaagatttagctatgagagattattccacacatcacaagaccttttgacagatagcttgtttctagttttcatcatagatagtcaacttttcactacaggcctcaattaactttggaatatcctttcatagaatctacaaaaagagtgtttccagcctgcaaacaagggttaaccctgtgagatggatccacacatcccaaaccattttcacaaatagcttgtttctccttttcatcaaaggatatttgctttttccatatacttctccatgggctctgaaatatcacttcacagattctacaaaaagagtttccaacctgctgaatcaaaacaaaggtttaactctgtgaaatgaatccacacatttcaaagcattttcacagatagcttttctctattttacgttgcgggatatttgattttttgctatactcgtccacgggctccaaaatgtccttttgtagatactacaaaaagagtctttttaatctgctcaatcaaaacaaatgtttaactctgggagatgaatctctgcatggcaaagcatttttatagatagcttgtttctagttttccttgtgggatattcagtttttcactgtaggcctcaatgggttctgaaatgtcactctgtagacaaagggacaaacagagtgattccgtcctgctgaatcaaaacaaaggtttacctttttgtgatgaatccacacatcgcaaagcattttcacagtttctttctagtttttatcgtgggatattcagtgttttactcttggccttaatggactctgacatgtcccttcatagattctataaaaagagtgtttccaacctgctaaatcaaaacaaatgtttaactctgtgggaagtattgacacatcacaaagcaatttcacagatagcttgtttctagtttttattgtgggatatttggtttttcaccgtagaccaaaattggctccaaaatgtacccttgcagattctacaagaagagtgtttccaactgctgaatcaagacaaaggattaactctgtgagataaatatacacatggcaaagagtttttagtgataggttgtttctagtttctttagtgggatattcaatttttcactgtaggcctcaatggcctctgaaatgtcccacagagatggtacaaaaagactgtttccaatgtgctgaataaatacaaaggtttaactctatcagatgaatccaaacatcacaaagcattttcacaggtagcttttttctagtttttattgtgggatgtttggtttttcactattggccctaatgggctccaaaatatcctttcttagattctacaaagagactgtctacaacctgcttaattaaaacaaagatttaactctttgagatgaatccacacatcataaaacattttcagagatagaatttttgttatttttattgcaaaatattcggttttttactataggcatcaatgggtatgaaatgtcctttgtatattctatttaaaaaagtttttttttaacctgttgaataaatacaaaggtttaactctgtgagatgaatccacatattgcaaagcattttcaaagatagattgtttctactttttattgcaggataatcagtgtttcactatgggcctcaatgggcttcaaaatatccctttgtagattttacaaaaagatattttccaatctgctgaatcaagacaaaggattcaatctatgagatgaatccacacattgcaaaaaatttttacttagaggctgtttctagtttttatcatgggataatgggttgttcatcaacgtgctgaatcacaaaaaggtgtaactctgtgagatggaatcacacattgcaaataattttcagacacagttatttgttattgctataatgggatgttcaacttttctctgtaggcttcaacaggcttctaaaactcttttcatagattgtacagaaagggtgtatccaaagagctgaatcaaaacaaaggtttaattctgtgagataaatccacacatcacaaggtattttcacatatagcttgtttttagtttttattgtgtgatgttcggtttgtcaatgggctctgaaatgtttctttgttgaatctacgaaaggaaagttttcaatctgctgaatcagaaaaaaggtttaactctgtgaaatgaatccacacaatgtaaaacattttcacagatggcttgtttctagtttttaccatgggatattcggtttttcactacaggtctcaatgacctccaaagtgtcccttcttagatcctccaaaaaaattgtttccaacctgctgaataataacaaaggtttaactctgtgagctgaatccacacatggcaaagcgtattcagagatatattttttattgtttctattacaaaatattggtttattactataagcatcaatgggtgtgaaatgtccctttgtatactctataaaacaagtgttcacaatctgctgagtaaaagagaggtttagctctgtgagatgaaatcacacattgcaaagcattttcagacatagtttctttttagtttttattgatgaacattcgttttttcactatacttctcaatgggtctatgtacctttgtagactgtacaaaaagagtgtatccaacttgcagaatcacagcaaaggtttaactctgtcagataaatccaaatatcacaaagtgttctcacagatcacttgcttctagtttttatcatgagatattctgtttttcactataggcctcaatgggctctgaaacatgttttcctagattctacaaaaaaaagtgttaacaatctgctgaatcagaagaaaggtttaacactgtgagatgaatccgcagattgcaaagcattttcacaaaaagctttcttttagtttttttattgaaaatattcagtttttcactataggcctcaatgggcttccaaataacttttctgaaattctacaaaaaaagtgtttccaacctgctgaatgaaaacaaaggtttaactctgtgagatgaatccacacattgcaaagcatttttacaaatagggtttctagtttttatcgtgggataatcaatttttcactataggccttaatgaactacgaaaaggctcttcatagtttccacagttaaagtgtttgcaacctgttgaaacaaaacaaaggtttaactctgtgagatagatccacacattgcaaaacattttcactgatagcttgtttctagtttctatcacaggatacacagtttttcactatatgcctcaatgggcttaaaaaagttccttcgcagattctacagaaagagtttttccaacctactaaaaaaaaaaaagtttaactctgtgagatgaattcacacatagcaaagtgttttcactgattgcttgtttctactttatatcgtgaaatatttggttttttagtataggcctcaatgggctctgaaactttccttttcagattctacaaaaagagtgtttttaacttattcaatctaaagaaagttttacctttgtaagatgaatccaaacatcacaaagcatattcacagatagcaagcttttagtttttatcacagaatattttgtttttcactatatgcctcaatgggttccacaaaatttattagtagattctacaaaaggagtgtttccaacctgatgaatcaaaaaaaaggtttaattctttcagatgagcccacaaatccgaaagcattttcacagatagcttgtttctagtttttaccatgggatatttgttatttcactataggactgcatggactccgaaatgtctcctcgtagatcctacagaaagagtgtttccaaactactgaattaaaacaaatgtttaaatgtgtgacataatttcacatatcacaaagcattttcacagacagcttgtttgtagtttttatcacaggattttcagtttttcactataggcctcaatgtgctttgaaatgtctcttcttagattctgcaaaaaacatgcttccaacctgctgaatcaaaacaaaggtttactctgtgagataaatacacacattctaaagccttttgacagacagcttgcatgaagtttttatcaggggatattatgtttttctcaatgggtatcaaagggctgccaaatgtcccttcacagattctacaaaaaaagtcttaaaaactgctgaatcagaacaaagatttagcttcataagatgaatccagaaatcgcaaatcatttcactgaaggcttgtttctagtttttatcacaagataatcagttttttactataggcctcaatttgctcaaaaatgttccctcgtagattctagaaagaaagtgtttctgacctgctgaatctcaggaaaggctaactctgtgagatgagatcagacatcagaaagcattttcatacatagcttctttgtagtttttatcccaggatattcagtttttcactatatgcctcaaaaaattttgaaatgttccctcatagacagtacaaaattatgagaggacatttcaaatgaggggacatttcaaaagattgtacaaatctatgaggggacattccaaatgaggggacatttcaaaagagtgtatccaaccttctgaatcaaaacaaatgtttaactctatgtaataaatccacacatcacaaagcattttcaccatatcccccaaaaaggaaactcttgttctcctactcctattggagggctgcatgattcctataggatgaaaagcaggcagccatggctggcttttgcctggtaatctaggctctgtttcatttcatctgcacgtcctttctcatagtggagaggctctttcattgggctgttgctgggtgggactgcctctcgccacagttctattggctgccggggatttcagggagcaaaagggacttcgggtaggcaggccatgctccaggttgtgtattatgatctcgttgtggtgcctgaggttgtttgcactttgcaggagacttttgggtcctctgacaggaatccttgaacgttgcttggactccagcacaagtcagctcgttctctcatgcaaaccttgattttcctttgttttcatgggggcggggggggtcaacagtgcccctcaacagcactgctggacacccttttcatgcttgcaatcgccacagacggcctctgagacaatgtctcaacctcctctgcacccgtgagaggccagttcaaggtgtgagaacactgctacgccttggacttgcctttgccgtagttcctgcctttcccagagagcccctgcgaggcccaggatgaagggaggcaatgaggtcaaaggcccggccatctttcgctgacacccgcctctggggtctcaggtatgagttcatcacccaaagacccctcaacaggtcaccagactatattccaatccccatgggacccgattcctgaacgcagcctctttcgggaagggagtcagaagagcagtttccagagaccaactcacactctcgaaatgcctccttctccagcgggacccgaccttggagacggtccgagggggccctaaggtcgagacttttagggtcctgcagtggattatcgtaggcagcctttttcctgataccagaccagctctgcctgtaccattttcctctgtttaagcaggctaacagctctgacagctgggcgcccgagactgcctcgctaaagcgcatgcgctagtctcagggcgccaggcctgagctgtaaattctggctagcgtcacaatgaatgccaccgtcacctagcgacaaatccctgcggcttggcggagacagagaactttgtggaggtgcctaggcggtggactctcgcctgtcttctctgtgggatccacgggatagtcccatgatcctaggagagggcagacgtgagccagcctgaagaaacgccaagcaggagccccaggaataaaccgcaaaatccctaaggatccaaaaggatctgcaggatgcctcaggcctgcctagtcatcgtaggggtaagtctttttgaaacttgccccactgtgatttttagatacagcccacctgtgttcctcagggttgctctctcttaggtggggtttccttcagaaacatgcagcctcagaagctgccggtctgtgtgttctgtgggagtgttacaagtgttggaagtctgcgtgtgtgtgtgtgtgtatgtgcctgtaagtgtagtcgacttaaaggaatgtggctaatgcactgcagcgcttctttttttttgagtctcccaaccttatgttgtcctgtctgtgtggctctgcttggtctgcgcggctcggtgctctttatctttctgtggatcatgaatccgcagtgaattcggaggctggctgagaccggcctgggtcaaaatcacctccactgcaaaaaaaaaaaaaaaaaaaaaaaaaaaaaaagatgttcttctagaaagaacaggagcacaccacacccaagaaaggacatctcccagtgttttaccgtcttgcgtccaagtcagggaaagacactagcagttctgtccgcagggcagaatttacatcgaattcagttcccagccgagcaggtacttcccgtcgtgagggggcactcctccatcatcttcggatttcattcagggacagaaagtgtgagcagcaataaggtcagataggggagaggatacaatctgttgtggggtgaatgaggtcccacacctctacctgcaaaaaaggtgaagacagatgaaggtgcttccagctgcatcccctcagtcccttaattgcacaaccagtacacccatggcccggtgttcaggtgggaaaactccaaggtgcagggaacatttggagtgcaaactgaggccatcctgacaaactcccaatttgggggcttttatacctagagccaaatggaagtgtgatgggttgatgctgggtgggatgtggccaccgcacttgcctcttcttttgctgacttccatgttcctcatcggcctagggtttcctggggctggctcaacgtcttacacactaaatgtttcacagttcacagaggacgatcctcatgggaatccattacatgagtgttttcttctaaacgctgtcacgttttaatgactggcagctgttataattttaaaaccgtaaattcccattacattcaccaacaaggaaactcttgttctcccacttctattgaagggctgcatgattcctataggatgagtagcaggcagccatgtctggcttttgcctggtaatctaggctctgtttcatctcatctgcacgtcctttctcattgtggaggttctttcattgggctgttgctaggtgggactgcctctcgccataaatcttttggctgcgagggatttcaggcagcaaaagggacttcaggtaatcaggctgccctccaggttgtgggtcgtggtctccttttggggctgaggttgtttgcactttgcaggagggttttgggttttctgacaggaagctttgaacattggttggactccagcgcaagtcagctcgttctctcaggcaagccttgatttttgttggctttcatggggggtcaacagtgcccgtccacagcactgctgggcacccttttcaggcttgcaatcaccacagacaacctctgagacaatgtctcaacctcatctgcagccatgagaggccagttcgaagtgtgagaacactgctctaccttggacttgcatttgtcgcggtttctgcctttcccagagatcctctgcgaggcccgggatgaagtaaggcagtgaggccaagggcccggccatcttttgctgacacccgcctctggggtctcagtttagattccatcacccaaagacccctcaacaactcaccagactatattccaatccccatgggacccgattcctgcaaacagcctctttcaggaagggagtcagaagagcagtttccagcaaccaactcacactcttgaaacgcctcctcctccagcgggacccgacaacagagacgacccgagggggccctaaggtcaagacttttagggtcccgcaatgggttatggaaggcagcctttctcccgataccaggccgtctctgcctgtaccattttcttctgcttgggcaggctgacagctctgacagccgggcgccccggtccgcctcgctaatgcgcatgcgctagtttcagggcgccaggcctgagctgtgagctctggctagcatcacaatgaatgccactgttacctaatgacaaatccctgcggcttagctgggaaggagaccaccgtggaggtgcaaaggcggtggactctcgcctgtcttctccgtgggatccacaggatagtccgaggatcctaggagagggcagatgtgagcgagcctgaagaaacgtcaggcagagccccaggagtaaaccgcgaaatccctagggatccaaaaggatctgaaggatgcctcaggcctgtctagtcgttgtaggggtgagtctttttgaaacttgcccactttgatttctaggtatagccccctgttttccgcggggttgctgtctcccaggtggggcttccttcagaatcactcagcctcagaagctgccgggctgtgtgtttctgagggagtgttgcaagtgttggatgtctgcgtgtgtgtgtggctttgtgtatgtgtgtacgtgtgtgtgtgcgcgcctgtaagtggagtcggcttaaagaaatgcggctaactcactacagatttttcccccacctttttgtggcctgtctgtgtggctttgtttgggctgtgggactctgtgtcctttgtgtttccgtggttcctgaatccgcgatgaattgggaggctggctgagacccgccggggtttaagtcacctccctctgcaaagaagccactcatctagaaagaaaaggaccacaccacacccaagaacagacaactcccagtgcttcattatcctgtggccatcccagagaaagaccctagcagtcctgtccacagggctccttgaatttacctcggattgggtttccagccaagcaggtgcctcccatcgtgaggaggacactgctcccttgtattgggattacatttagggatggagagtgtgagcagcaataaggtcaggtaggggagaggatataatctggtgaggtgtggatggggtcctgcaccttcacctgcaaaaaagatgcagacagatgacacagaaggtgcttccaagtccatcctcgcattcccttcattacacaggcagtccacacgtagctcagtgcccagttgggagtactccaacgtgcagggaacagttggagcacaaacttgggccattctggtcagctcccaatttgggctttcattcctgaagccacatgagattgggatggatggatgctgggtgggatgtggcctctgcactggcctcctcttttcctcactttcacttcctttctcagggtcttggcttgttctttagcccaaagggagtggggtggacagattacctctgaaccttgggtgcctttgatttctttctttgtatttgatgtcattacgatgaacattgatgcctgctatgtgccaggactgagtcccggattcccagaggaaggaggcaccattcccctgagcctgctaatgggtcttccatccacccttctcattataaggcagagttcaggttttgagaccaggaaaacgtgaatttgactccactgggtcacctgccagctgctgacagccacttaattcctccaggcccaacatccctgtgtgtaagcacaatacacaattagggttgctgtcagccttatgcaaggggaggcttggaagtgcttggcagcagcaggtggtccacccagactgtctgggtaggcctcggtctgcttccctccaggtctgtgccaccttcactcaggctcctgcagaggcagtctgtcaccttgtgaccaggctagaaaacagcacctggcaggagggcatggggactaggcgggtccctgtctggagcccctgaaagtcggccaggcagcatctctgggatgggtggctggatgccagtgctcttgtcctggcatccctctgtttcctgcataggctcgtggtggcagacttccaggcctctccacattctctgtcctggtgatggtgggagtgtctccccctctgaaaggtgcccctggaggttgggaaatggccatgccctttgaacctcccttctggcccagggtctggctcagacagagtgcacagagtgtgtgttgaggagggtagaggagtggcagccctttacctatgagccagtgctctgcaggtctacccaagggccaacatcccaggggccaggccctaaggtgaacgtggcatcccaggtcccagcatcttctgagaagacatcatcccagtaccagggtccctgttggatagtgcctctgcccatctctcctctggctcccagcaggttcatggttgcagtggcctgtgcaggaggggtgcaggtgatggggccagggacttttgcaggaaggaactaggacattggccaaagaggctgctccctgaccccaattgtgtccctaatttactatgtgacctccacaagtcattcagcatctctggtcctgttcccccccccacaactatgtgatgggcacaacaataccacagtccctgtgactgtgttttattcaggagtcagctgtgggcctccctgacactccatccccaacaaagtccagtgtcaggagttagttggacctccacctcgatcttatattttccagcagcattttgggaaggaatatcctgaaaggtgagcctgcctgttatctcctcagagggttcaggaaaagccggccctctctatccccttttctcaccatgatcctccaggtctgttcacctaatcactaggcatgaactaattgaacatctgccaagacccaggtgagcttttgcatctagagagaactaagacacagccatggtcctgggggtctcaccctcttagatgggaggccagcaggagaggacatgtgggtcgggttcaagagtggagtaggaagttgcgagtggctagtgcccacctgggcatggtctcatgggcccttgccaggaatgtgcatgccatcctgtggcctttgtaaggcttttagcagagaagggagtgggattgagaaaaaaatccccatggccagggctgcaagaatggctaaggtccttggtggtaccatgggcatgtggcaatgaccggaggtttgagaagtagagtaggcagggtctggtggtcgaggggcatctaggggaaatcagaccgagttctagcttcccagtttgcactcatgggcagacagtggtgattttactgaggggagatgacctgaggaagagtaggatggaggaaacaccgggcctgcctgaaggtagatgccagacaaagggaggaaaagagaagcctgagaggaagcagcaggtacagatcaaggaggagaagcacaagagtgctggcccaaagggcaagaagtgtccagaagaagggggctacagaaaggtcaagttagataaaggccatagtacacttatccaatgtggccaccagaaggccagctggtcaagggtgttgctgaaggcagaggacagtgggtcaggagtgaaggtgatgatgtggatcgagagtgtagacaacaggcagaaggggagagagatggtgtggatagagggggtgtagggtcatagatggaaatatccccaagtttaggtggatgggcaggagatcattgctgagaagggatctcataagaaagtagaggtggagcagaacagagggggcaacgatgtgagggtggcagtgacacagggtcattggggagtgtgtggggacacctgtctgttgggcatcggctcatggcttagggcaggctactgggcaagcccacagacccctagaagagaggagctcctgccatgtatggcgcagttttgtcattcaccatgcactctaatttcacatactgagtacttggtatgtactggtcactgtgttggacacgggggacataaaatatggtaagacacagtcccaaaggggctaacagtactgtggcctcttactcaaaggcttgcacccagggttaagcttctaacaagttggaaggcagacataggcacctccatttgccttgagtacaaacagatgttcagagaggtttagtgactggtcaaaggtcacgctgccaggaaatggctgtgtccaggacagttgcaggtctcctgcccataaaacccacccaggccaccaggttcagtttcagccaggtggccttcagggttgaccaccctgttcgactcggcaagaagaatacaagccaaaggcaagcacgtactcattcttctgagcatcctctgtgtgcccatccctgttgtgggcatgggcggcagggaaggagacatgaattccaaatcgtgaccttgccttctgcagctgagggtgtagttggagaatttgatgtcccaggagagggatgtctcctgttccatggctgcctaggagagggcagaaagcaagccctcttgaaggagagagagaggggtaagggggaggtaagcagggacaactcttcccctccctcaaaggaggccactcaggaatcccagggaagccagacaaaagcctgtggaataaaggggcctctgagcctcctccccactgctgccatcctgactcagggatttcagggtgcagtcatcattcccacccccaaaggagaaagcccaggccggtggagcctggctgctgcaacttcttatacaagcagctctggaggccccatatctgagctggcagctccattagagggaggggtgggcattagtatggaatgccagcctagatggatggtcagtgccaggttctggggcataggaaagtccaggatcatgaccaggggtagctgatcaccaggaatgtagttgggactccatgcccgaatgctagggagactcagagctggatctgggccacaaagtgaggggacagtggctgttggtttatattgaggggaaaatggggccgacaggactaaggccctggggctgaagggcatagagctcttgctaaaatttgggaggctctgtttaaaggaaactagtgttgatagaatttccagagctgctgcctgggccaggtaagacccgcaggacccttctgtccaggttaggctcctgtaggtgcctaccctatctcctcaccttctcctagctagaggtcccctatgaggcatgaagctggtggggcagaggcccctgtcagggccttcatgtctgcctgggggctggaccacctggccggaaaaaggaagccgaggtagcagaagggcctgcctgaagatcctctgagtcttcctcctccttttctactccttggcccaggtggttgtataaattactattcacccctataaaaattgtttaactccatcacaaatatttggataatagggggatatctcaatctaattactgttagcattttggtttcttttcatttattctccttcctatgtgtgtgtcttggggagttcccataggggcatcatagagtactgattattgtgcattctgctttttcacttaccgtattcacctagtcagccagtgtcagctgctgtaccaggcactaggaaccaataaaaaagtgtgattcctacactcaggtagcttattgtccaggacagattggccatcaaatccagttaggatgtggtatgcagatatgatatcatatggttatgatatgatatggtacatcttcaaggagctgtgtcagggacatgatggagaaaccactctcccaggatcttgtcagcaagagggaaatccaggagtgcttcccagaggaggaaggtgttgacagaggtgaattctaaaggtttctacagttccttctcatgaaaccgtctggacctggtgcttttttcagtggcagatttttttatcatcagtggtaattaagtttctactcattatctagttcattaggggcactttatattttactaggaaagcattcattttctccaaatgtgtaaactctccacttttaaaatttattatgaatttatttgtggccaaacaaatgatttttctaagattttcatagacgttgaaaaaatgtatattttctatttaagggatataaggtcccatatataccaaatcaagtttttggttattcaagctgtcacttcttttgtatcctttgggggaggaggcttttactgtagttctaacagagatttagccttccactcaaattttctctataaatctcttcttttactagtttttgctttttatatttactatgatgtggggagaatgcagattttgagtgttctttataattttctctataaatctcatcttttactagattttgctttttgtatttactgtgatgctgtcgggagcatgcagatttcgagtgttctctcattatgaattgtgcccatcattacatggtgtccctctttatcccatttcagtgcttaaccttaaattccacccttctattattattatggccactctttattttactttagcttttgcactttcctggtatctcttggcattcttttattttccaccattatcattgtttaagtgtttttcttgtatatatacatcactgggtttttttgttggtggtggtgttgattgagacagggtcttgttctgttgccctggctggagtgcagtggcaacatcacagcttgcttcagcattgacctcctagtttgaggtgatcctcccacctcagcctttacagtagctgggactacaggcatgcaccattacacccagctaattttttggttttttttttttttttttttttttttggagagatggggatctcaccatattgcccagttatcactttatttttaaacccaggctgacctttgtcttttaatgggaattcatctgttcacatttcattaaacaattgatctactgtagttggttttatttcttttggcttattttacatttattggtttaccttgtgggttttttcctctggttattgatcactctggttattaatttcctttttcttcccttgttactctttccatttcattactggcatctaccccttctctggagttcctaatcaaacacatattctttagcatgtgattccatggggattttttttctcagcactgtcatctggagctccaatctgttggtctataagcttaggtctttctttctgcttctgtaaatctatttgttgtttgatttgattgttgtttttgttgttgtttattttctctcttcccctttctcctttcttttctcttcctttttcccttttctttcccttctcttctctcttctcttcagtctcttctcttcttctctcttctctccctcccctctcctccccttttctcccttctgtcatcttcttttcttttctttcacaggatctcagtctgtcacccaggctggagtgcagtagtgcaatcatagctcattgcagcctcaacctcccagactcaagtgtttctcccaactcagcctcctcagtagctgggactacaagtgcatgcaacaacacttggctaatttttgtattttttgtagagacagggtctcactatgttacccaggttagtctcaaactcctggggtcaagcgatccacccacctcagcctcccaaagtgttgggattacaggcatgagtctccatgaccagctcatttaatcttagtttgtgtgttaatcatttaaccttcatcattccccaaatctctctttaaaaataccctatagatatgtaaatcactgtaactcttatgtctcttcaacttttttatataaagtgacaactcaaaatacacttttccatttaatgttatttaatacaaaccattctattttttatgctagtatctccatttggccataaaacaatatatctagaaataaagtgtgagcttcaacagaaacaatgatctactgtttctatcaacttttgactatctataatcccttcgcttcccatctatcttcctcaaacaaattgaacttaattgtcaacttgaaatttctagagcttatgcaacttcaactcatttgtctttcccttgctttattcaactctactgccaaaattacaacctcggttaaatgcaactgtctgtgtgtctaatccttgccagcacccatgcagctgaacatgcccaaaagaacaatataacaatgattttcaacattttatatccaggccagaactctcctctgagtttcagatttatatatttaaatgcttacttaacatctccaattaactatttaatggaaatcccaaaattaatatatccacaactgtcaaattcttcacctacatcttctcccattttacaaaaattccacttttttccaatgaacatttaccgtattcatcattttgctctaatgtttcctcaaagtggtgcctaccttaatcgtattactaagtttttctaagcacttcatttttctgccctgctttgttttcctccttagaaccacctgatgcactgtatattttactaatacacagtttgtttctctcacctgctagaatataaattatataagaccagcgattttttatatcatgtttactttccaatgccataccaagatcagtacccgacactgaaacaaaggtagattattcagttttttaaaatgtgtcctgtggattactagaactgcaaaactcacttcaataagtctacgacacttaaaaaatacattcatgacaccttatcttcctggggaattacagtgatttctagtttttaaaagtaagaagacataaacttcagtttgaaaccaggactcatcatcccatagttagagctggtcttctttgtgtgctcagggactacagagaggtccggggtgttggcctcagcctcttggacaagggaagtgggcaccctatgagctcaggatccctgtccctagcctggataatggcagaatctggctcagccaggtccctggcctgcacaaagccagtggcaccaggtgaacgtgcccagctcagtgactgcctggagcaggtgtggggcagccagacccagtgggtgtgggcttgggagcctagccgcagaggatgagcaggacaagggcagtcagacagcccttagaaggcctccacccctgagctgcagaaagagatcccctcatccagctcctccccaggggcccactctggatcaacaggaaaatgtagcccctgatgtggttgtgcataactggacagatgggagacatggagctgaaggccatgtggataaccgcctgctggtatcccagttgacatcccagtaccacatatcgctgaaacccaggtcaccacatcaccaatggtcaagtcgatgtgaactgttgattgttgacgagtcccaggatcttttctgctcttgagcctgaccatgaggtagtagatgccaaagtcaggcaagcattgccaggcctgatggaggcacagctgggcctggtcggcaagagccaagccacattctaggggcttccaggatccgtgggatgagctgcttggccttgaacttttgtggaagggcagggtggggggtgtggagggagtaccaagaccacagaggctgaggcccctgacaagggcgccactgccctgggggtggttgccgaacccggtgcctgtctgctggaaggctacacctcgctggcggctgttccctgcatggtgcagcccctcctgggaagccagtggcagcccctgcagcatgcacccagctgctcctgctccgcaggtgggggtcgcttgcctttggtgagttggatgcagaactcgcagccagaggcgctaacaccagaaatgccctcacagcccttgaggttgagctgccgagggtgtggggctggtgtccactggggcgtggcctggctctcatggcaggattgcatgggttccttgaacagctcccagtgctggcctcagcccttcagggtcagcttctggggctgggagatttgaggacacaccttgacttctgtgacaaggtgtgtcacagaacacgggcttccagcccatctgtggatatctagccctccagcttctccaagctgctgagggctgcgtccaggccatccagccaggtatccacagcccatctcccctctctgagacagcctgattccataggattgcagagatgagacaccatcaacccctcctagatgcagcccacccctccagcagcagatctcactgagcagctcgcacagcggggtccaagccgcagaagtcttggggctgaaagtgcagccagagtcgcctggccctggcaccccgttaaatgaggcaccgcaggtaccagagcccgctgtgcagcagggattcgtccagcgggcgttgggccctggcgggcgagggagggtcgggcggcgtcggtcactggctcggcaggtggtcgcaggcctggattggccactgtcccagaagtgagccagcctccccggaagagcgctggagcgaagctgcccgctaggaccaccttggtcaggttgcacacctcctcgtccggttccttctagtctcaggagctggagtggggctggaggcaagtgagccccacctgcggggcaggagcagctgagtgcatgctgcaggggctgtcactggcttcccaggaggggctgaacagtgcagggaacagctgtcagcgaggtgcaggccacccttggcctttcaggagacaggcgcgggactcgggcaaccacccccagggccttggctcctccatcaggggcctcagctgctgtggccttggtgctcaggaactggagtggggccagatccgggacgccgggcactgtggaggctgtaggtggcggctgcggcccagaagcactgacgaaagcaccttgacagatcaagtcaaaatgttactgagggccgggcgcgggggcgcatgcctgtaatcccagcactttgggaggccgaggcgggcggatcacgaggtcaggagatcgagaccatcctggctaacacggtgaaaccccgtctccactaaaaatacgaaaaaattagccaggcgccatgctgggcgcctgtagtcccagctactcgggaggctgaggcaggagaatggcgtgaacccgggaggcagagtgagccgagattgtgccactgcagtctggcctgggcgaaagagcaagactccatctcaaaaaaaaaaaaaaagttattgagaaggccagttcattctctaggatgccagtggcaaacaaacatgaggatgaccagggagacgaggattttgagtgcttactttataaagtgtctataatatctgcagcagaagaatttaatggcaagttgttcagaagataagcctggaaatcttaaatgtcctatactcatttttaattatattgtatgttacatactctttggggcaagaatgatggagattatggaagtggaataagggctttccctctctgtttgcttcagaccacttctttgttaccattatcacaattggtacagttagctggatgttgtgttaaacacattaaagacatgttattggatgcgcattttaaccatatgggataggttttattaacagggtgtgaatatggctcaaacaatttccccagagtacgtaatggattagccaacactagtctgttttcctcccaagccctcttgactattattacatattcttcccatgagagaccaggagatgcctaaagaaagggatcgagggagcagaaggcgttttgtgaggaggagatatctgaatggtacttgagtataagttgctacacggttgtgtgctatgacgtctatccacaaagaacccagtttacccaataaaaccttcaaccaaccttcatatcttaatttttctttgaagtattcctctgagtgttgaagagaagtatgaaaatttgctccacagtaaactgcagagataaacagagatggctatgaaaatactacaactattattaaggaagacggctatttgccttttagtataaattgagtcaatgagatgcataaatattatttccaatatctgtgaatatttgcctaagacataatttattattattttcatttttaatttgtagatactattgtacatattgtgtacaatatgatgttttaaagtatatatattgtggaatgattaaatctagctaatgaacatatgcattgccttacatacaatttttgtgttgagaatacaacaattttaaatatttgtccaattcgcatttggaaaatacaattaaaataagcttaaaatgcctataattcacaatgcagtcataaaaattaaactgatgaaacacactaaagtcatttaaatgtatccttactcattgttcttgatgatatagtaaagcatcatcaaaatatagtagtctctattgttttagaatttgattttttagatctggtcataattatgctgtatagataaaactgtgtgttctaaacggatttgaagtcagaaacttgcactgccaagacaacactgtgtcttatcagctctgcctcaatttgcaaatcacgtaagctttctgaactccattttattcacttgggaagtgggaccaatacactaaatatttcagttaatacaaagtagaatacaaaaagaatcacactctagttccattccacatgagcacttcagctattttcctccagaaatcacctgtacaccataggaaagtaaattcatacccacctagttaacagtgtgagaatgtaagtttaaagcatgtttgactaaggaaacttaatcataataaaatggtttaatttccctgagcatgaaatattctccacaagaaatggcatgctatgtttaattggttctgggaatgattatccaatattagtcactttcatattagtgtcccctagagtggaaaataaataagatagtgattgcacttctgcatgtccatcttctgccaagacattttgctaatgtgcagtgtctgcaacttcccatttcttggctaagttcaagctttgttagtttagtgcttaggaaagcctcatgttctttcagaaattcttttgctctcattactttttgtgatattatggacaataatttgccttgggaacatgacaactgattccaacagttgccaatgttggggagggaggtgtcaaaaggtaggctttttcaatgtcaattttaacccagcagcaatttctgcagttgcaaataattctattttctttctggtcacttaagttctgtcaaattaaattagtgttcaaaactcatagcacagttttgcttttttattactacatctgcaatttgattagtgtgatatattttcatatatgaatgaatatcaattaaaggcaatgaacatttataggtaactttttcagccacagaggttagtaattttaacatgtaaaccatctgaattcatattgcaaccatatttttgtaatataagaaaatgtagattaaataagttttattagtattttaaatgtaataaaattattttctgctggctgcagtggctcacgcctgtaatcccaacaccttgagatgccaaggtgggtggatcacgtgaggtcactagttcaaaaccagccttgccaacatggcaaaatgccgtctctactaaaaatacaaaattagccatgcgtggtggcgcatgcctgtaatcccagcttcctgggaggctgaggcaggagaatagcttgaacccaggaggcagaggttgcagtgagccgagatcgtgccactgcactccagcctggtcaacaagaatgaaactcctttgtaaaagtattttcttaaaatattaaaatatagtttaatgtttcattaatatcatatgcccattaaaatgttgtattaaataactataatattactgagaataacttatgtttcagacatttcacttacattatttaaatcagacttcctaataacccacgtataaaccttggtatgaagtaactgatcctgagagatgtaaattatcttcccaaattcatgcatttatgaagtttatcaactgagttttctgacactatatgtaacatttttttctccatgccacgttggttcctggcattccaaagctcttgaagaacattgaaagaaaccaatggccttcatccgcatttcaaccaacaatgctacaatcacctttgttcacagtcctgtcttcatacaaaaagaaatgtttccattagtttccagcatcatctcacataattattattttggtttagaacactaatccactctcagaatttctcaaaaatacattaagttgctaacaatagtcagcacgttgcacaatagatctcttgaaattttactccttctctctgactgtagttgtgtatcctttgaccaacatctaccaaagtccattcccaaccacattagctgctggcaaaaaaaacattttactctctgcttgttaacttttttagattccacatatgaatgagactatgtgataattgtcttcctggcctagctcataatattctccaggttcatccatgttttcacaaacaacaggatttccttcttttctgtggctgaatgtatttcattgtatgtatatgccacattttctctacccatccccccgtcgatggacacaagttgattccatatcatgactactgtgaataatactgcaataaacatgggagtgcagatatctgttccatatactgattttatatcctttggataggtagatacccagcagtgggatcactggatcatatagtagttcaattaaaaaatttctggagaaccatagtacttagcggcctaatacttaatatttaatacatagagactgtactaatttattaggttagtgcaaaagtaattgaagtttttgccattgaatgtaatggcaaaactgcaattacttttacacgaaattaatatattcccaccaatagtgtacaagggttcccttatctccataccctgatcaacacgtttaattcttgtatttttgataataaccattataataggtgtgagatgacagcagagtggagctttagtttgcatttccataataattagtgatgttgaacattttttgcataagcctacttggccatttgtatgtcttcttttgagaaatgtctgctcagatcttttgcttatattttaatcagttcatttgccttcttgctattgagttgtttgaatttcttatatattttggatgttaattaccacaaaattcataacaatataaggtaatacatatgctaattagctagattcagtcacctcaccatgtaaatatacctcagaatatcatgtacaaaataaatacataaaattttatccttcaattaagaaattaaaataaaatgaaattttcagcatgatagacattcaaatatatgaatcacgtcatcccaacctctctttatcattttcagtagttacgggtgaaatctgagtcagggctgatgttcctagttccctactattatattcttaatacactgcagtttctcaatcatccttattaaagcagttaccaaaatttaaaaattaattttgagtgtactatgatcatctctggaaaattataatttgaagaagtgcttctatgaatgggataaaatatttcatttttttcagcattccacatttttgactcattgactcagctaaaccacataaatcttcacttttttctattttatatatcataatgcctatctttcagctgtgaaaaattatcaactatatttgtttattaactttgggaatatgaaattcagatcatgatcttctataaataaaatttagaagttttttttctaaccgaagcattcagacttgagcaaatgacaaatgtagaatattttaagtgttgacaaatatatacatataatatcaatgtttttgtgtttcgagtttctaagcaatatttgctagctgataaacttattttttatttactaataagaaataatttggattgcagaaatcaagatactctccttgcatgacattaagattaatagataaatgttatcacacctacaggcacatatgacaccaccagaactttacctaaatgattgttttccaacttatgtaattgtggttgtttataaacgtcttgtttattgttaatctttattataaacatcttgtttattattgaccttgtttataaactatctttactaattaggaaacttttttttctcttttctttttttttttcagagacaaggtctggctctgtcacccaagctggagtacagtggcaccagctccactcactgtaacctttgcctcccaagttgaagtgattcctgtgcctcagcctcccaagtagctgggactacaggcacgcaccagcacacgtggctaatttttgtatttttaatagagatagggttttgttatattactcaggctggtcttgaactcctgggctcaagtgatcaactattcctggcctcccaaagtgctgggattacaggcatgagccactgtccctagcctctgttttctttattgctttatttatctggttttgagttgggagatgatattaaacaagagttataattttccaaaaattgaaataaaaataattttaggctagaggaaaatgcaaacaatagcaacattaggatctattagcttatttgaattttgtaataaataaagatttgatataatgggaaatttaatatacttaatatgtaagtacactctcaattcttgaaggaaataataaaactgtatcaacatagaaagatataaaaaaatgctaagttgtcacaaaaaaaagaaattcacaaaaaaagaaattccaaagcagaagtcctggtatgttactattccagacaaatctgatatgagaaagcactaaagataattgaaacattaatttaataattaattaattaaaatagtacagtcctggatgtcttttttgtgctttctttaatttctttccagctatatataaatgtgtcttggtatgaatttaagtgcctgggaatgaatagtactgtcccccaggataataagttattagcaaattaataccttgcttctgttagttgtcaacatgttgcaagtaaacattgttgataggcactgtggatctactaagggtaagatatcatcctttcacaaaaggatagctattaaacctgactgtaggtaaagttaaattgcaactaaacatatgtagacatatactaagattttaaacattacacaatatttctgaccaataaaatataaactagagtctaaactgtttggttaagaatttcattgctagagtacccttacaagttctaactgaatttccaaaaatctaacattttgttctcaataaaataaaatgtgtttaataaatatgaagcaaaaaacaaaatcctaaacaaaagcaaacactgttgatcagtcaatttaacatggaatattattgctattatttttattgaccaataatttatttcctgacttttcttctcagatatggacactattgatgggagcggctggccatctggagtggcagttgccatcatgccagtagcgcttgggccgcatgggcagtgttgtcaggagcagcagcaggagcagcagtggcggtggtaggaccccgttccctgtgtccccaaggcatctgactgcgccgccgccccctaatggctgggcaggacccactgccaggtgcagaccctccatggcggcctcaatttcgcttcctaccacatctgggagcccatcagcgctggcagccgggtcttgcaggattggccccaggagcatcaggttcatttgtgcggcattagccagggcccccatgccacctgcacctcgcccatgcactactgcagggaaaacgcagagaggagtcacggccaaggctgcacactctatggagccagtggcagctggggacaagtgggagcccagccccttccaagttgccagggcaggaactccccaggcgcaactgcagctgcccaaggagggtctgcgacccaggcactcctgtgctcttgggagccaggagaaggcaggagccccaccctcccaggcacagctggagcctttcaagccacagctgcagacccaggcacctctgcactcttggggcctgggaaggcccccgtgaccacacaggctcggaagtgcctgcccccactgtctgggttctcctcgctgtcagcacctgctccaatcttcgagcaaagttgaggtcgagcacactatattgtgaccaatataaaatagatataaaaatacctcttacacttaaatccaggcattgccatttgaatgacttaagaatatgcagctaaggtgcttttaaaaatacaagctagtgattatactgaatttgtaaatcacgtaggatagtgagtcattttagaatattaattatttcagtccataaacctggatgtctttccttttttgtgttttctttaatttctttcattgatgtttgtaatttttgttatagaaatcatttacttcctcggttaagtttatttctaagtacatttttgtagctattgtaaaagaaatagcttccttaattttttttctgctagtttactatcaacatatagaaatgctactgttttttgtatgttgattttatatcctgcagctttattaaattcatttatcactctaagaagttttaggtagagaccttagtttcttccgtgtatgagatcacattgtctgcaaacaaggataatttgactgtctcctttccaattcagatgccctttatttctttctctaacctaattgccctggctaagactttcactatgtgaaatatgattggtgaaagtgggcctccttttcttgctccagttttcatggtaacatttttcaccttttccacgttcagtatgatcttagctgtagggttgtctttacgcccttttgtgttgaggcatatgttttccacactaaattgtttagaggcttttgtcatgtaagaacgtttaattttgccaaatgctttcattgtgtttattgatttaatcatatggttttcaatatatatccaaaggaaagaaaatcaatatatcaaagccttacctgcacccccatgtttattacagcactattcacaatagccaagatatggaatcaacataagtgtccatcaacagatgaatggataaagaaaatgtgacatacatatataatggaatactattaagttataataaagaacaaaatcctgtcatttgtggcaacatgaatgcaactggagggcattatcttaggtgaaataagcctggcatagaaaaataaacaccacaggccaggcacggtggctcacgcctgtaatcccagcactttgggaggccgagacaggcggatcacgaggccaggagatcgacaccatcctggctaacacggtgaaaccccgtctctactaaaaatacaaaaaaaaattagccgggcgaggtggcgggcacctgtagtcccagctactccagaggctcagacaggagaatggcgtgaacccgagaggtggagcttacagtgagccaagatagcgccactgcagtccggcctgggcgaaagagcgagactccgtctcagaaaaaaaaaaaaaaaaaaaagagaaagaaacaccacataactacatgttctcatttacgtatggaagcttagatagtagagtattggttaccatatacgggaaagagaaaggggagtatcagaaaaatttggttaacacatacaaaattacagctggagagaaggaataagttatagttctctacagcactgcagggtgactgtagttaaagggaatttattgtgtgttttcaaataactagaagaaaagatttttagtattctcctgcaaagaaataataaatgatttaggtaatggatatgctaatgactctgacttgatcattacacattgcataaatatatcaaaatatcactctgtaacccataaacctgtacaattattacatgccaattaaaaataattttaaaagagaaaaaatgaaataaaagtaaaggtacagaatttaactactttttcttctatgaaaccaggaagagtgaatttattagttttctaaaataaaaaaaaatcaaaatgaccaaaaaagagcaatatccaagaaaaacaacacttagtaagaatacttagaaaacttgggcactgtatcaccctgttcctagataccaatttacagatgaccacttaaatagaagtttattccagttaattcatttataatcccagagttcaaaattatgttgtacctacaataaatgagataacacgtttaaattatatggtactctgcctaacacaggttaataactcaatacaggttagcaataagcttttagtgtagtagtcatagtactatttctcacattgcaattttcttcattcagagacatgaatacaactttcttcatgactcctttttcatcaagatacctcttcaaattattctatttctttcattcagtatattagctgtgtatatcgatactgcattttttttttttctgagatggaatctcattctgtcacccaggctggagtgcagtggcatgatctcggttcactgcaacctccaactaccaggttcaagcaattctcctgcctcagctccccaggcagctaggaccacaggtgcacaccaccatgcctcgctaatttttgtatttttagtagagtcagggtttcaccatgttgtccaagctggtctcaaactcctgatctcaggtgatccacccaccttggcctcccaaagtgctgggattacaggcgtaagccaccgcgcccagcctaatattgcattcttggattttgaacactgaatatctttttgaaaggttacacctctttaccaattggtgctttggaaattattttccttcaagtgttctaagagtctaatgaagaatgaaggtcatgttttatcacttttgtccttaaagatttcagacatgctgaggctgagcttggtggctcacacctgtaattccagcactttgggaggccgaggtgggcagatcacgaggtcagcagttgaagaccatcctagctaacacggtgaaaccccgtctctacaaaaaccacaaaaaaagtagccggtcttggtggcgggcgcctgtaatccagctacttgggaggctgaggcaggagaatggctgaacccaggaggcagaacttgcagtgagctgagatcgcgccactgcactccagcctgggtgacagagccagactccgtctcaaaaaaaaaaaaaaaaaaaaaaaaagatttcagacatgctgaaactgaatgaagtatcattcgctaccagttagattagttctttctagttgtaggagtggatacatctttaatggtatattttgggttattgccttatttttgatgccatattctgtaaataattttttaaacctggcaaaactcggtcagcatagatttgtcaactttggtgttatattgtgtttgcttttaaaaactgcttttgaggccgggcatggtggctcttgcctgtaatcccagcactttgggaggccaaggtgggcggattacctgagatcaggagttcaagactagcctggccaacatggcgaaaccccatttctactaaaaacacaaaattagccaggcatgttgatgcatgcttgtagtcctagctactcgggaggctgaggcaagagaatcgcctgaatcagggaggcaaaggtagcaaccattgcactccatcctaggtgataagagcgaaactctgtctcaaaaaaaaaaaactgcttttgaatagagttgtaaatacaattttttatgaaaaaagaaattatcaagtgcataagttcataatacaaaaacaaataaaattcgaggcacaagttagtactaaaaaaattatgttcatttttccctaatacaacatgttttttcccttcatgaacaatttgtgttttactgagaagactcattatttatggcagaagttagactacagatgaatatgtactttaaacactctcagtagctttcttaattttacatatgctgctttatgcttctgtttattttcatttttccaatgtccatattctagtaaatttgaatattttaattcaagtttattgaatttaatatttaatattgcttgtataatttagtatttttaagactcaaaaaggtttatgaaaaaaagaaaaagagatcaacgtgttgctaatcatttaaagattattttaaaatctttgacctttatatgttaatgaataaaatgttagtagctattagtataaaataatttatgtcttttggacttagcatccagcatttctttttttaataaataaataattattctcctgtaatatattatgtttatctgggttttgaaaaatgatgtttcctaatatgagaaagccatttacatgtttaaatctacaaaggcaaatgaaatggtactaaattatttacataataacgtttagatggtgacccttataacattatttgtatacttcatacagagttgggaatatgcaatcctagaatatttctgggggcaaacccttcagtttgatgaacaaaacaagacttttaaataaaattaaacttttaaattacccaggttatggggccttttaattcaatggatatggagcataatgaattatccccttttcattgggtaataagttctcattcttaacttataatactcaaaataccctttaatttttaatttgtgattaaccatatcattatccctaggtattttagcttctatcttgaattctataataattttgaaacaggagaaagtattctttattaccatatgtgttaaacatcatggttttcaaatttaactgcaaatgtgtctttttcattgcttcctgatgacgcccttcaccctatccatattgtcactatcaagtggtaattacttttcaggttcacatatttgtttttttggaaaatcttctctgtgtcttataaagaatatgattgtaggcattcaaaaaccagtgaaatacacataattagcctgtggcctaactcatttctttaagaaactacactaattttacccacatactgatatttttattgccgcattatttctggagaaaataaatactgctaacatgatgttggtaagagagtaaaaaagtcttttctcgaaaagtgctcattgtagtattaacatatagtgtcaatttctttataaattcctcatacacattttattcttagagaaataaaaatgctaaaagtgaaatgactttgtttattctgcatattataagccacccatcttggtaatttagggtctttatagttagggtaagttgtgtcataccgaggtaacaaaacaaaaggtattttgtctcttttgggcctttcattattcagttatactgtcactttggctttttttgtaggtcaacctattgacctcagtattctgaaataatatgtttactatcttttgatcagcatttaaaatattagatttattgttactcttctgcctttattgggctggatgaataattgtttctctcactccacaaaagccaagttgcagagaaaaacacatagacattcagttgcaaagcaaagaaacgactattttctgcaattttaaagtgtacattgaatgaattaaaccatctttttattttcttttttgctcacttgcaaatattaacaacatcaagtgtattattgtaatgttatctaggtaaaaatctcaacaagttttcataattaccatttttaaatatataaataggggacctaactttaatttttaatgtctgaggccatgtctgttatttcactctttaaactcagttcgtaatgcagacacttagtaaatactcaaaaaatatgtgctgaataaaaaaggttaaatatgtaatatgtacaaaatctactggaaaaaatgcaccaacaattttatttggtataccagtttattgtagaatctttattgcctttaaataataatatacttttccagtgtctacaatgacttgtaatatttgtacacatataaaataatatttccaaaaatgtaattcagtaaggaaatataccttctaaattctagatttataatttaggggttaaattataaaatcattaaataaaatacaaatgacatatagtcaaagatccccttggaaaaaaattaagtggcctctaaagtgatgtattcatatatataattttacaatcaccctcagtttgctgttcctctggcattagaacagattgttgttgtttatttgctttaacatcaaaggtaaatgtttttgttcaaggacatatgtaaaaataaatgcatatggtttacaatagcatcatatttagtgataagcacataggacatgagaccatccgaaataaatgcagaaccaaatctctcatgcatatgcactcaaccactcatgtttattgataaaatgctaagtggaaaaacctgaattttgtaaatttgtctcctttgcctttttaaatatacacacaatcaaactctttgtgacttagtaatgaataagtaatactccattgcatatgtaataaaatgtgtggcataaaatcaatattaggtataaaaaatctatggcaataaggttagaaggaatgtgccatagcagcgattatctcatagccaaaaatataggtatttttagtctctgatttttttcattgtctacactttctacgaataacacagataacttttgtaacattttattctaaatactttaacatgaaagatacatttaaaaatactcattccatatacacactgatttttaaaatatttattatgatttctcatggagtttaggaatattcaaaatctactaaaagttatcatgttttatgatagctctcacttgctttaaaaaaaaattcttgataatttacaagtacgcagtgggtatccacctggggcctagatatcctcttggggactgatgtcatcctggagcctgatgtccacctgggactggctatccacctgtggccagatatctacctatggccgaatatccatttgggacctgaagtccacctctggccgaggtgtccatctgggacgtgatgtccacccgacacctaggtatcaacttggggcttgatgtctacctgtcctcagactgtgggcccctgagggtcagggaccacgtggacattttcagtaccatatgctgggcccaccagggcacctggcacacaggactaatgctaagggcagagttgctgagtgaataaatgggaggatgtcaaatgccccttcctgcttctggccatctcataatgtggagatcattcataagaacaggaactgcatgacctcagcatgactctcccctggacccagatgcatgagaacagcacagtgggcaccaggaacacagaacactgtcctcccacccaccctgtagccagcatcagcactgcagcctcaggcaggagcatcacagaacaaaacagggaactgcatttaggattcctcaagtcagtggctctccaggttcccaggaggcagacgagcaggatctgcaggctccaagggcagtgagaaggacctcagcagtctctcttgtcccctctttgcctccagttcctggggtgtaaagttcactctcgaggtgtcctcaccacagccagggcagcaatttcccccaacttccaaatgaagttcgatcgtgttccgggacttttgacacagggtccagtgcctgggcacattctgtcctatcccaaatcctcatccacccaaactaccaagcctctgtctgctccgaaggacccccagagtgaatagctttttccaagtgtctcagcacacacggggtcattcataaaaaaccaaggtcaacaaacactatccaagcatgtggaaccctgtggtttcatgctctaagcacctcacattatatacaggagaaaacggaggcttcgtctcctgtagcccctgtctacactagggcaggtgggatggtcgtagttccaggtgcccacagaggtggactgcaggaccccagttctgtcctttcaaggctgtgctgggcaaggccctggcccaggcagaaccctgggaagcttgcggattctcctgcccatcctctaggcccttgtctgagcctttctctaaactcagcacattgaatagggcttgctggctacatgtaggtcaagggtgtaacccccatatctctaattcctcacagagttcttgctatattctccgacccaccctgttctcagaccttcagactcagagaggtgatggactactgcctggtaactctatctggatatctaagagcaaaccctacatagcaaattgtgccaacactctatatatccaccacccacaaacccatcccaatcataatgcccaaacagaaactaaatacttggattagtcccatatgcagaaaaaggcaaattataaacaaaatattgttattgggttagtggaaaattattgctgtttttgacattatttttaatggcaaaaaccgcaataacttttacaccaacccaataggagagtgtgaaatgaacaggtctagtttgttgtgcttttctattttctgtttgttcatatttgttgctttctgtgtatctttgagagtttggaggaatttgtgaaaggaaccaggataaacattttttcctgctatttgaagaccacgttttttatctatgttacatctctattaatagctttttcaaaattctgtttcatctgcataccttatgttcttaattagtgttgctactaatatcaaaaattattttctcattttaatattttgtcttctgttgtttcttagtttgtttcttaaatttgttgtgctttttgtttacttgtatgctttttctaggttttcagaaggatgatttattagatttttagttttttccaaaaaatgtacttaaatttagaaatatacctccaatttctgttttaaatgcattctcaaaaacttacatatctaaaggtatttatcattatactacattgttttcataattcacctattgttttctctctaacttcaagattacttaataatgggcttagtgatttccaaatatctgaaaattttaattgttgctggctttgaggaatataatatgatattgatgatttagaatacattgattactcctttgttgtctagttcatgacctacatttgaaaacatgacaaaatttatatttctttgttgaatgtacatttgtatacttttagataaagttattgaccatgttttttatatccttttcagcttttttacttttgattttcaatattattgtactggcttaccaaagaactagttaaaattaattttctacctatttccctatcccatttgtctaaattaaaattacaaaattatacttttaattatacttatgttacagattttcatattttttgattaatgtttctttatcactgtttcttataaagtcatttttggtatcctgtgattggccctttaagtggtgatgaatagaaataataaagcaactgaagcaaggtgatatgaaaaaatgagaagacagaaacaaatcaatgtgtccgtttatgtgaagtttaactgtataagagcaataacaaaaaaaacccagaaagttgtttttcaaaactattcatagaaactgagattacacagagagagagagagagagagagagagagagagagagagagagacaggccccaggtaaagaccaggctcctcatagaactctggccccaggtggacactgaactccaggtgtacattaggcccccagttgatgctcaggccccaggaaggtaaccaggcttatgatggatatatggctccaggtggatacccagaatccagtgagaaatcagggacaagtgggcaccaggcctcagagggatacctacgaccctagtgacctcaggccccagttggacagtaggccacaggtgaactccagtcttcaggtggacatcaggccccaggggaaatacaggtcttaggtttactcctaagacacaggtggacacaggtcttaggtttacccctaggacccaggtggacaacaggccctgggtggccactggccccaagtatccagtttcctaagagctagggtgggcaaccccactgggcactgtggccaggcctgccatgtctccttgttcagctgccacattctgatggggagggcgggaggtgtcgagagaccacaatctaagttcttattacctgattttatttcacctccactgagtgctcactctcctctcacctaacggatttactctcatctgcaggtggtttaagtgtgaaggtttactgaagatttaaagagtgttatcacagttgggatgatttaaactaacagtacacgttgcattttaagaaaataattaatcctcagaggagatatgggttatggagccatgacaaattttcagcattacttcccttacttgttgtttccaaataaaagatttttgattccccattgatgttggatgagaacgctgagtgtgcaagcaaaatatcattttttaactaagggcccaatagtgtcttaaatatgcagagctgagtctgcaggtggagagtgatgggtttgttcaaaacgtggtatagagtggccttgggtctcacctgcctgcccttccatcctgtgccctcccagtgaggcacccaagccccaccttagggcacaccccttcacagggccacataggccccagtcctcacctatgtggtcatctccaaatggcacagcaacaccttctgtccaggcccaggccagggtcccagtatctccaggggggcctggcatccaggcatctgttgagaactggcccaatgttggggtctgggctagcctgtgggacctggatgttggggggcagctgcatgaggactcatgcctggctttatgtgtagcaccaggaaaggcactttaatcgtattcatttattgctcacaaaacctctgaggtgggtgccttccccacgtcacagatgggaatgacaagaaataataaggttaaagagcatgctcatggttgaaacctggtcaggaactcagaactggagtctatagacccctacctgtgacctctgtggccggaggaccctctctcaccgggtttgtgtttgcagcatgtcctgtccttccctaagggtctcaggttctgaggcatggtgagggctgctggagcccatcactgagctgcagaaggagatactaacgctggccatgccaccctccaggcaggcacaactggagttgaaaatcgagatggggcagggctgccaggaacagagggaggcaggtggagaataactcaccagggaggggtttccctgctacagctttccagggccatttccactttctgggtggcattttggggcagctcacacagtacacccacatagccagtccccagggtcacaatccccagatgttgttcatcttggtgacaggccctgtgcttctccaggaccgtttgtgtatgggcccttcccaggtaagcgtgatacgtcctggctgtcctcagtccagggcactgccagcattttcctttctggtcagggtcaaagctttgttgaccatctccaggatacgatggccagctggcccttggagagccagtcactccaggtgacacggtttggtactggacgtccgcggtcccctctcccacgccgccccatactgggccccgtatccagccgccaccgctgctgcagcaagaaccgccccactgcctccgcgcagctgccattgtttaaagggacctcagcctgacttccaggagctacgcaagacttggccaagtcaatgcgcatgcgcaaggagagagccgcttctccccatcacagcgattcccagggttgtcgtagaaaccactccctgaggcttcgcaaagcaggagccctccgtagcagggcttcggtgtcggggctccgaggctccggcctgacttctccacggggtacacaggaacgtctccggacgccaggacctgaaatgggccgactaggatgacgaaaccacaggcagagtccggggaagcagcgcggcatcccatcttcaggcctgcccggagggtgttcgggtgagtctccccaaaagtcgtgcccccgtgatctggaggacaggtctgcctgtgtgtccgtgggctgctctctcacccgagtgtcgttcgcgtggagagcagaaccctgcagcctcaagggttgcctgccggctgaggtgggggtgcttccatgacaccgctgtatgactgtgtgcgtgtgtgtgtgtgtgtgtgtgtgtgtgtgtcccattctcttctctctcgctatcactctctatttctttccctctctctgtcggtttgtatgtgtgtgtgtgtgtgcccttgtgcgtgtgtgtgtttggacgaatgtgccccgtgcaccagaaagcaatttcttgcatgtcagtcggtctttggtgagcctttttcggcgtctctccctgggtcctgtggccagttgtccatcgttttcctgtcggttccactttgggtttgtgaaggcctcgacaacgtgaggagatgcgtcgatccccgagcaattgaaatctcatccctatcctgagtggcctcttttctaggatcaagatgaccacactccagccaaggataaaagccccacaggagctcactgtcctgcaggagaggagcaggcccacgtccaagaagatggctgtatgttttcacggctcttctctgagaagtgaagccacaccacgatacagtcttgaagaggaagccaggaatgggagatggcaacaagccctgtcatggtggcctctctgaacaagttacccttttggcacccctccccttatgcccgtggcggtggcacagtgctgtatcctgcctgggctctggcccctgctctgtcctccctcttactctgtctcccttgtttctgaggggcctagatgcttctaggtctggctgaatgtcttcaaaaaagatcacttcccagtccatcagggagacagttggtggacatccttgtcatgattgtgtctctctccaaacctgtttctgcttgattgggcaggtttgatgaccctggagctcttagctttcatatgtgtctcagacagggaagctaccttggtctccatgtttcacctcatgggtagtggattgcctagaagcaatggtaagcgaccatgactggccttttcttctatgacgggcgcggtgtcgcatttcctctgcatctcctgtctcattcttgagggatgtcctctcctctgctcctgggtggactgactccctgaatcttttggccccctcctggattccaggtgttctttgattttgcttggcattgatggaaaggtcacttgtaccccccttcagttgggcacatgcctggacaccattgcttgtttcgccatcaccccatatgccctcggtgacacacatccacaccatctgctctgggatacaccagtgccacgcgtggtcgccttggttccacctcggaatcgccccgtccctgtttgcatgtgtcctggaaagcagtatcagcttgcaggagccccagggcttttagaagcggggcaggccactgctcttccaaaggaggagggaggcagagggctcatgggtcagtgaattttcagctgacactacgtcttgaggcccatgggaacattctgtgctgcagcgaggccctgcctggtcagcggatgtggtgagcccatcctttttcacctggaggggtccaaggtcggatccgaagaggcgtcctgagaccccagcaggcgcccttgagctctctcttcactggtggaagtcggctcaaggaggtcctgaagacaggactcctgagggtttggccctaggtcaccggcggacccctctcctacgctgccgctactggatcccggatccagccgcggccgaggttacagcaggagcgcgcctgcagcggcgcagcagccattgtttcaaggggacgcagcctgattgccaggagtggagcgcgagtcggccccaccaatgcgcatgcgcgaggcgccagaggattctgccatcagtgattcccatggttatcttagaaaccagtccccgaggcttggcaaagcaggagccctccgtggcagtgcttgggcgtcggggctccgaggcccaggcctgacctctccaggggtcgacaggaacgtctccggatgccaggagtctcaaagggcggaccagtatgacgaaaccacaggcagagtcccggggaagcagcgcggcatcccagcctcaggcctgcccggacggtgttcgggtgagtctccccaaaagtcgtgccccccgtgatctcgaggacaggtcggcctgcgtgtcgctgggctgctttctcacccgagggtcgttgtcgtcgagagcagaaccgcacagcctcaggagttgcgtgggggtgtgtgcttctgtgccactgctgtatgactctgtgtgtgtgtgtgtgtgtgtgtgtgtgtgtgtctcccattcgctcttctctctctgtctctcactctctgtgtgtttctttccctctctctgtcagtttgtgtgtgtgtgtgcacctgtgcttgtgtctttggacgaatgtgccctgtgcgccaaaaagcgatttctcgcatgtcggcctgattttggtgagcctctttctgcatcgctgcctggctcatgtggccggctgtcgatcgttttcaccgccgcggatccgctttgggtgtgtgaaggcctcgacggcgtgaggagatgcgtcagtcccggaacaactgaaatctcatctccatcctgagcggcctcttttctaggatcaagatgaccacactgaagccaaggacaaaatccttacaggagctcactgtcctgcaggagaggagcggacccacgtcagggaagatggtcgtatcttttcacggctcttctctgagaaatgaagccacaccaggatacaatcttgaagaggaagccgggaatgggagatggcagcaatccttgtccctgggatgctggcctctccggacaagtcacccgtttgacacccctccccttatgcctgtggcagtggcatggtgctgtatcctccctgggctctggcctctgctctgtcctccctcttgctctgtctcccctgtttctgagtggcctagatgcctcttggtctggctgaatgtctccaacaaagatcacttcccagtccatcagggagacagttggtggacatccctgtcatgattgtttctctctcccaacctgtttctgcttgattgggctggttggatgaccctggagagcttgagttccatagttgtctcagacaggcaagctaccttggtctccatgtttcatctcatcggtgggtggattgcctagaatgagcagtaggccactgtgatgggcctagtcttctaagacaggtggtgtcacatttcctctgcacttcctgtctcattcttgagaaatattctctcctctgctcccgggtggactgactccctgaatcttttagccccctcctggatcctggtgttctttgattttccttgacattgatggaaaggtcacttgtgccccccttccatctggcacatgcctgaacaccatcttgtgtttcgccattgccccatatgcctttggtaacaaacattcacaccatctgctctgggatatgccagtgccatgcgtgttggcatttgctccactttggaatcgcccttgtccctgtttgcatgtgtcctggaaagaggtatcagcttgcaagggccccagagcttttacaagtggggcaggtgactgctctttcaaaggaggagggaggaagagggctcttgggtcagtgatttttctgctgacaccatggcttgaggcccatgtgatcattctgtcctgcaacgaggcccttcctttctcagcagatgtggtgagcctatccttcttcacccagaggggtccaaaatcggatctgaagaggggtcttgagataccagcaggtaccctgaagctctccctccaccggtggaagtcagctcaaggaagtctttaagacaggactcctcggagtttggccctgggacccccgcagccccttctcccctgccgccccctactggaacctgcatcccgccattgctgtggctgcagcaggattccccctgccaccgcgcagtcgccattgtttaaaggggccacagcctgacttccaggagcgaagcacgagtcggcccagcaaatgcctatccgcgaggctctagctgattttcccatcacattgatttccatggttgtcttagaatccagtccctgaggcttggcaaagcaggagttctccgtggccctgcttcgttgtcagggctctgagcctccagcctgactcgcaagggttttaatacccttctcatcctcatctgcctctttgcgaggatcaagacgaccacaacccagccaaggacaaaggcctcacaggtgctcattgtccacccgcaggagggtgctcacagaccttcaagaagacggttttcactcctctcacactttgccctcattgagaaatctagccacagctagacacagggacagagaaggaagccagcaacgggatgcggcaagcatttctgtcacccaaacgctggccttcctggccaagtcacccgtttggcactttttcccagatgcccgtgatggtggcattgtgccatatcctgcctgggtgctggcctctgctctgtccttcctattgctctgtctgcccagtttcttggaatcctagaggcttcttagtgtggctcaacgtcttcaacaaagaacacttcccagtccatcagggagaaatttctttggggtccatttcatgattgcttccctctccaaacctatttctggatgattgggcaggtgtgatgatcctggagctctgggcttccatacctgtcttggacagggaagctcccttggtctccatgtccgaggtgatggctgcgttgtcggtccaggaagagtgggaggcgaccccaccgtggctgacctttgctttctaggaaaggcggtgttgcatcccacctgtgcttcctctctcattcttgagggccatccggttgctctgctcctggggaaagtgccttcaagcagtgaatcttttggttgccacagatgtgagggagccaaagggactgggttttgctggttttaggagaggtggcgtcagtggtacctacccggtggcagggtgtcgctgtggtggtttgtcgaaacctctcagcccctctggcaggcatccctgaatgtggcttggactcgggcacaggccctgtctggcaggttttcaggtgtgcttggcttttcctcagctttgtgtgggaggtcccagaagcccacggacgcacgcctggacgtcactgtcagtctcggcatcgccccatacggcctcagagacacacgctcactccatctgctcttgaaagacgtcagtaccacgtgtagtcacattggctccatctcagactcgcctctctctttgcatatgtcgcagaaagcagtttcgggatgccagagccctgggccttggagataaaggcaggccactgctccacccaggaaggagggaggcagtaggctcatgggtcagtgcattttcagccgacagtacgccttgtggctcttgggatctttctgtgccccagcgagacccttcccacctcactacattgtaaccccattcctgatcaccctatcagatccataatcagatccgaagaggagtccagaatgcccagccggcaccctgaagctccttctccaccgggaactgaagcagaagaccagaaaaccaatcaagaaggtcctgacgacaggactcctatgggtccaaccctgggtctcctgcagaccccctcctagtactcttcccacccgccaccttggactgcgccgctgcgccagtccccgcagcccgtcgtgtcgccgccattttttaaagggtccgcagcctgactctccggagcaaggggggagttggcctcgccagtgcgcatgcacgaggccagagtctctgctttggtaacagtgaccgcctctgttgcccagaagtgggtccctgagacttggcgaagtaggagccctgtgtgatagtgtgtcagagtcggggctgagaccagtcctggccagggtgttaacaggatggtctccggagatcgggattctcggagggtcgaccaccaggaagaaacctcaggagcaagaaagctcaggcagattgctggggaggcagtgcgagatcccaaactcaggccaggatttgcggagggtcaatgaggcccctctcccaatcttcacttcaccagccaccgccccagtccccgcagccgccgctctgccgtcatttattttattattatttttttttaatagtcggagtctcattctgtcacccagtctggactgcagtggcgggatctcagctcactgcaaactctgccgcctgggttcaagtgattctcttgcctccgcctcacgagaacctgggattagagggattaatcagaatcggggctaagaccagtcctggccagggcatcaacaggatggtctctggaggccgggattcacggagggtcttccaagaggaagaaaccgcgggcggaaggccgaagaagcagcgcgggatccctgcctcaggcctgcacggacggtgtgccagtgagtctcttcaaaaaaggagagatttgcttgtgtgcccatgggctgctctctcaccggtgggtcgtggttgcggagagtagaacccggaaaattcaggggttgcctgggggtaggtgttaccgtgccactgccctatgtctttgtgcgtttgtgtgtgtgcgtaggtctctctcttatttctctctctctcctctctcgctcttttgctctgtgtccgtctgtgtgtgcgtgtgtgtgtctgttgggacacatgtgccctgtgctccagagggcggtatcttgtacatcggcctttcttctggtcagcctctctcggcgtctctgcctggggcgtgtggccggttgtcagtcatttttccggtggctccaatttgggtttgtgaaggtctggcgaggtggggagctgcgtctctctcataaggatttaaatcaccttcccaccctgagaggcctcttttctaggattaaggcctccagcccccagccaaggataaaagcctcaccagagaggtcattgtctacctgcaggagctgtgtagagagacctggaaaaagatggttctcattcgtctctctctttcatctccttgagaaatctagccacagagtaacacaggttttcagaggatgggaatgggatgtggcaaggatctgtgagtgtgcaggctgtgtttcacatatcattaaacatagtctaatgagtgttctgcagatagctgacatttaagtttgttttattgaatcaaggaaaagaaaaaatgctgagaaaaaatgacacaacttccctgccacccatctgagtgttacaaatttaatagtaattttaatttatcttctcatgtaaaggtccttggcagtgatacctaatttcctaagatagccttgctttatttcgtatacttaagatgtcatgcatatcagagtatctggaaattcttcccaatgcccttgacatatgtgattaatcacattcccaaaataacataccaaaacaaacaacagaaaattatttgttacttaattccttcaaatttgtttatttaacttggggttccttcatgcacgaaacatttcatgtgtgtgtggcactcttctggtcacagatttcatcttaaataacctaagtattgaaatgcttgtgccctttgattaatttttactacataaatactttgattaaaagctacattgaggctgggtgcagtggctcacacttgtaatcccagctctttgggaggctgaggccagcagatcatgagatcaggagatcaagaccatccaggccaagatggtgaaaccccgtctcttcaaaaatacaaagaattagccaggggaggccaggcgctggctcatgcctgtaaccccacactttgggaggctgaggtgggtggatcacctaaggccaggagttcgagaccagtctgcccaacatggcgaaaccctgtttctactaaaaatacaaaaaattagctgggtgtggtggcaggcgcctgtaatcccagctacccaggaagctgaagcaggagaattgcttgaacccaggatgcagaggttgcagtgagctgagatcacaccactgcactccagcctgggcgacaagagtgaaactctgtcccaacaaaaaaggaagaaagaaagaaagaaagagagagagagagagagagagagagagaaagaaagaaagaaagaaagaaagaaagaaagaaagaaagagaaaccttgtgtatactaaaaatacaaaaattagaccctgaaggtcacatctgaatgagaaagacattatttggctcaaattgactgacactaaggaatagtgcagactggacaagtgaggtgacttacacctataatcccagcactttcggaggctgaagctggtggatctcctgaggtcaggagttcgacctcagcctagccaaaatggcaaaactctgtctctactaagacaaaaattagccgggcgtggtggtgcacatctgtaatcccagcttctcaggaggctgaggtgggaaaatcacttgaacctcgaaggcagaggttgtagtgagccaagatcgtgccaccgcactccagcctgggtgacagaatgagactccatctcagaaaaaaaaaaagtatgtaaatcactaatgtatcaaagaaaacagtcattcatgtattgcaaataaatactcaaccaagacaaaaaggcacgtcacatcttatgggaaaagacggaaatgacggtgagaggaaaactgtgacccttgaatgtaagacagaaaaaaatcagggcacgatgttaaggaattggaaataattctccatattaaaggaatacaagagacagaaagagaggagagagagacacgatagtcacagactgcaggggtgtggggtagatgggaatcaaggaggcagagagagcagtgggaatgtacataaaatcaccctccagagctgtgctgtccaataagtctgctgaacacttgaaagatggctagtccaacctgagaaatgctgtaagtggaaaacgcatttaaaaaaattctgaatacttagaatgggccagtgtgggggttcatacatgtaatcccagcattttggaaggccaaggcgggaggactgcttgagccaggagtttgagaccagtctgggcaacagagcaagacctcatctcttcagaaaaaaaaaaaaaaaataggccaagtgcagcggctcacacctgtaatcccagaactttgggaggccaagataggtggatcacttgagctctggagttcgagaccaacctggacaacatgccaaacccctgtcttaacaaggttttttgtattttaaacatggaagaaccccatttctactaaaaatacagaagcagccaagtgtggtgggccatgactgtaatcccaactactcaggaggctgaggcaggataatcctttgaacctgggaggtggaggttgcagtgagccgagatcgcaccactgcactccagcctggcaacacagtgagactctgtctcaaaatatatatatatacacacacacacaattttggagcgaagtttcaaaatcaatcagtaagcactacccaccaggtttatccttacataaagtgcccgctctgccttgaaaatcttatgctaagtggaagaagcccgtcatgaaatatcacatgtaattccatttaaataaaatgtccaaaatacatgaatgcgtagagacagaatgtagatttgtggtggcccagggttaggggagttgggggaaatggagggatatggggtttactttggggtaatgaaaatgagctaaaatttattgtggtgatgtttgcacaactgtgtaaatatactgaaatcattgaattttacactttaaatgggtggcttctgtgatatgttaatatttttcaataaaacttcaagaaaaagagtacctgtgtgcctccagagtccacatttttacacttgatgaagaaatcaagatattgtttcttcttcttctttatttttatttattttattttattttttgagacagagtctccctctcttgctcaggctggagcgcagtggcgtgatttccgctcactgcaacctcccagctaatttttgtatttctagtagagacggtgtttcactgtgttggctaggctggtctcgaacttctgacctcaaatgagtccaccatcttggcctcccaaagtgctgggattgcaggcatgagccactgcacctggctcaagatttagtttccattgtttcagatgccctaggaccattttattctactttaatttctgatgcatcatcgcagtggacattttacattagctcccaaagtattttactctgtttaagattttatcagctgggcacagtggctcacacctataatcacaacactttgggaggccaaggtgggaggatcagttgagcccaggaattcaagaccagtctctgcaacatagtgagatgcccatctctaaaaaaaaaaaaaaaatgtttaattaggtgggcgtattgttgcatgactatggtcccaaccagtaggtaggctgaagtgggaggatcacttgagcccaggaggtcgaggctgcagtggccatgattacaccactccattccagcaaaaatatttttaattacatttttttaagaaaacaaaatatacacttagtgacttgatacaaatgaatgacttttataatctacagaaaccaaaaaaataacaataatataaacccacagccattcttcttatgtgagtctctggtgtctctgagttgtaagaattgtgaattatgattaataacaaatatgcatgacaaggactcaataagggataggcattgataaactgcaaacaacacttactggagtaatgtctttaaagttgtacaagaagaagaaaaggcattgaaaaactgcgttggctaacaaaatactgaagttcacctaagtccattaatcagcacacgcacacacacacacacacacacacacacacaatggatgtgtaaaatggtcaacacagtctcccatgaatgtatcattttattaataggtctgtgagggtaagagatgaggttctatagatcctggaatcagggatggggaatctgtgaggtccctgaagtgatagatgagggtctgtagattggtgatgggtggtcttttggatactgatgaggtccacagaatcaattcttgtggatatgtagggtcagtgatgagggaatctggtgtcagtgatgggatgtgtgtggaatcaatgagaaagtgtggaatcaatctgtgaaggccagatttgtggtgtcatctctcaggctgacacatcctgatctgtgtgtcagtggtggaaattctatggggtcagagtgtgacagtcagatccctgacactgggtgttctgggtccggccaagtgcacagattcccttacctggtcctggctggagaggcccttctcacggactcctcacgtgaaaagtgggttgtcggcggtttttgcttttgctttgttttgtggtgggggtgggtgggttggctttttctttagggtttggttttgcctcttagagaccacagacacatgcagctcttaggaagaaatttttgtcttggcgatcgctaggtcctttggaccaagccatttaatgggaacgaagctgaccattcccttagagcagttcagatctagacggtcgctttaaggtgtccacaagggggactgcaagtggattgtggctttgagtggcaggtgggcgggaagaaacaactaagaaagacacacaagctgtcctcaggctgaatctatcacagctggaagaacagcctccctaacccatcaggcgccaatgggaggtgcctctgggctgtgagaggctggcggaggcgggacttccagacccagaaagtctgggcacagaagcctattactgtcagacgctgaggcgttgccgtgggaaccaagggcctttcgggtcagatcagagcctttctcagacaattctttccgtaactgacgagctcctgtccagcgcacgcctctatgaatgcttagtgtgccgtctcgggcagagtcttatttggtctgagagccacttgtttcttaaatccctgcgctaatcttgccgtctgctcctacgtagcccaggcatttgctgcatgctggtcctttctttcctgacaggggagctgcctctccagcttcctgggaggacagttcaaattatggaggaggggaggtgcagggcagcagtgcccaggggagtacaggggagttgggggagcaggggctcatttttctttgtagctcagattcccaagcctgtgactttgagaatctttgtcttccttgcaacgtttcaatctgaggctcttggggagagggcagagttggagccggatggaagcctggtggtgagaggagtgggtggagggaacatgaagaacgtgtcaggcggtgtctttatttctggcaccttactttgcctactggagtttcccagtctgttccagacgcactctcttgatcctgagggggcctgaggaggcatgttggttgccagtgtgtgctcccctgaactcgattggaattggtcccacaaactttttttttttgagggagtctcacactgtcacccaggctggagtgcaatggggtgatctcggctcactgcaacctccgcctcccaggttcaagtgattctcctgcctcagcctccctagcagctgggaattcatgtgtccgccactacacctggctaatttttttctatttttagtagagacagggtttcacaatgttggtcaggctggtctcaaactcctgacttcaggtgatccaccggtcttggcccctcaaagtgctgggattacaggtgggaaccatcacgcccgacaaatcccacaaatttaggcattatgatacatcggagccaccacgccccaccaattacacatatttaagcattatgatatattgctacttttagaatcacttggtttttatattgtgtttttcccccccatttgtttgtttgtttattgagacagagtcttgctgtgtcacccagcctggagtgcagtggcgcaatcttggctcactgcaacctccacctcacagattcaggcaattctcctgcctcagacttctgagtagctgggattacaggtgcatgccatcacactcggctaatttttgtatttacagtagagacagggtttcaccatgttagccaaggtggtctcaaacttctgaccccaagtgatccacctgcctcggcctcccaaagtgctgggattataggtggaagccaccgtgcccggcctcccctccttttcattcagggattttaaatgttttatttgctccatctgttatgtatgattgccttgacgatttcagcttgaatgaaaattacatatttttgcctgtgattattaatattgaaacatattaaaataatacatgttcataatgaaaatgaaacattacaaataaatacacaggaaaggcagtattccccctccagttccactcttgaaaataaccagttaacaggatgatgaacatctttccatgatgttctccaagattcatataattatttgcaataatacaatggcatatatgggccaggtgctgtggctcatgcatgtaatcccagcactttgggagactgaactgggtggatcatttgaggtcaggagttcaggactaggctgtccaacatggtgaaaccccatcgctaaaaaaaacacaaaaattatttgggcatggtggtgggcgactgtattcccagctacttgggaggcagaggcacgagaatcacttaaacctgggagatgaaggttaccgggagccgatatctcactacttcactcccacttcggcgacagagtgagattccatctcaataaataaataaataaagagaaagaaagaaaaaaagaaagaggaaagaaacaaagaaaaaaggaagaaagagagagagaaagagacagagaaaggaagcaagcaagcaagacacaaaaagaagtcgtgtgctcaggttgctaagatcgatggtaagaacaaatcctctagtggtaaaagtgtaagaaggaaaaagaaatttctgttagtcttgttggtttcaccccaagctctgaaaagtacagcacgtgtgtgataagttcttagttaagttgaaaaaggcattaaatttgtgcatggaaatcataaacagaaatgtgttctgattgacagcaattgggtcaatgctacgcaaggttcaggcatccactgcgggtcttagaacaggtctcctgcagataagggagggctactatataatgtttctttcttttttctttaattataaagtattctcctgtttatataacaatttgccatcgatatcactttaggtataaagatattaggatatctttatagtagataaaaactaactcattatttgtaagagttaaagtatcttccattatatgagcatttaaaatactaaagtacttttgccaccagaaatagtgcttctgtaaatattcttttacttatatctttaaattttacttctgctgaaatgaattgcatgaggaaacaaatgtttgtgtataaaatgtaatatatgtatatatatttaatatgtgtatatacaacttaatatatacacatacatacaataacataaccaatttttttgttgttttttgagatggagttttgcaccgttgcccaggctggagtgcagtggtgtgatcttggctcactgcaacctccacatcttggattcaagtgattctcctgcctcagcctcctgagtagctgagaatacaggcatctgccaccaagtccagctaactttgtccttttagtggagatgggttttcaccatgttggccaggctgctgtcaaattcctgaccccaagtggtccactgaccttgccctcccaacatgctggaattacagatgtgagccaccgtgccaggcctaacatatacaatttaatgtatatacaaatataggttgggtgcagtggctcactcctgtaatcctagcacattgtggagctgaggtagggaactgtttgaacccaagagtttgaaatcagcctgggcatcatggtgaaaccctctctgtccaaaaaacacaaaaatgagttgggtgtggtggcacacgcctgtgctcccagctactcaggagactgaggtgggaggatagctggagcccgcaggtcaaggctgcagtgagttgtgatcatgccactgcacaccagcgtaggtgacagagtgagcccctgtcttagacaaaaacgaatcaaaccaaatataaagtttatgcactacacacttgatttctttccaaagggttttacaacactatactttcaccagcaatatatgcaactactcatttcctacatagtcactatcacttgtgtgcagtcaaggaacttagtaggcttgaattgtccaaatcctgcacactccaaagaaaggtttgactctagcccagctcctgggaaatagcctttaagtccttggactctcctgcctatctgggagttaacaaggtgatttattgtggggaccttggaccatgcagtgtcagcttgaccttgggaagggggagacagagaaactaaggtcatccaaatgggtactcttgtccatgtgaccaacctccagtaaaaccctcaaccccaaggttcaggtaagcttctcatctgggagtattttctgtactttctgccacatatcactgggtgaattaagcactgtccacatgatgccactgggagaggacaactggaagcttgtgctttgtctctcctggactctgccctatgcacctttttctgctgctgattttaatctgtatccttttgttgtaataaactataactatgagtataatagcttgactcagttttgtgagttcttctaatcaatcactaaacttttgggaccccaaaacacaacgttgttgcttctttaattgaattctccatgttatgtaagaaacctatgtgcataattgaaaatcccactctaagaaagagatttccatgcagtctactcccccaccatttctccaatgctcccaagtctactttctgaataatcaaatgtttcaattttctaaatttagattataaactatttataatctatatatctgagtgcttatctctgttatataataggtagatcctcctccttctgttttttttttttttctgagacagagtcttgctatgtcacccaggctggagtgcagtggcgtgatctcggcttactgcaagctccacctcctgggttcactcccttctgctgtctcagcctccccagcagctgggactacaggtgcccaccaccacgcctggctcatttttttgtatttttaatagagacggggtttcactgtgttagccaggatggtcttgatctcctgaccttgtgatctgcttgcctcggcctcccaaagtcctgggattacaggtttgagccaccacgcccgacccctccttcttaatatatcaacttgatatattacctgatggcttcctgttctgatagctgatgacttggctgacactcacctcttaccccagtgcctgaaccactttccttatatggtgctctcattattttctttttcttttcttttctttttcttttttttttgagacagagtcttgctctgttgcccaggctagaatgcagtggcacaatctcagctcactgcaacctctgcctcccaggttcaagtgattctcctgcctcagcctcatgagtagctgggattacaggcataagccaccatgcctggctaatttttgtattttagtagaagcggcgtttcaccctcttggccaggctggtctcaaactcctgatctcattatccacccacctcagcctcccaaagtgttgggattacaggcatgagccactgcacctggcctctctcactattttcaatggctctgttggttactgttcacaacattcaacaattagacttatacctcatttatttatttatttttaattttttctatttttaggtttaagggatacatgtgcaggcttgttacatgggtaaattgcatgtcactggggtttggtgtacaaatgagatcatcacccaggtagtgaccacagtacccaatagttttttgacccatagcctcatgccaccctccccactcaagcaggccccagtgtctttgatcccatctctgtgaccatgtgtactcaatgtttagctccaagttataagtgagaccatggagtatttggttacctaatgctgcattaattcatttaggataatggcctccagctgcatccatgttgctgcaaaggacatggtttctttttctacggctatgtagtattccatggtgtataattaccacattttcattatccagtgcactgctgatgggcatcatatatgcaacttcacactatactactaggctacagtaaccaaaatagcatagtagtggtacaaaaagagacacatagaccaatggtataggttagagaacccagaaataaagtcacacacctacaaccatgtgatcttccacaaagtcaacaaaagcgaggaatggggaaaggactccccattcaataaatgattctggaataactggctacccacatgcagaagactgagtctgggccccctacctttcaccatatacaaacattaactccaaatggattaaagatttaaatataagacctcaaactataaaaatcctggaagacaacctaggaaatactcttctcaacatcggccttggcaaggaatttttggctaagattccaaaaaagcaattgcagcaaaaacaaaaatagacaagtggtacttaattaaaccaaaagctggaggccaggttgggcagatcacaatgtcaggagtttgagaccagcctgaccaacatggtgaaaccctttctctaataaaaatacaaaaattaggtggttgtggcgcacacctgtaatcccagctattcaggaggctgagggaggagaatcacttgaacccaggaggcagaggttgcagtgagctgagaacgcaccactgcactgcagcctgggtgacagagcaagactccgcctcaaaaaaaaattaaataaagtaaaataaaagtgtaaacacaacaagacaaactatcaacagagcaaacaaactacagaattggcgaagatactcacaagcgatgtatccagcaaaggccaaataatatccagaatctatagacaacttaaacaaatggaacttaagcagaacccttactctttagcaagttctgtatgcataagcctctctttgttcttattttggtggcctctgtttatttacacaaagagaagaactgctattcctgtaaatcatggctttgaaaatggtcacagtttgctgggcatgcttgctcatgcctgtaatcccagcattttgggaggccaaggtaggtggatcacgaggtcaggagatcgaggccatcctggccaacacggtgaaaccccatctctactaaaagtacaaaaaaattagccgggattggtggcatgcccctgtaatcacagttactcaggaggctgaggcagaagaatcacctgaatccgggaggcagaggttgcagtgagccaagatcataccactgcactccagcctggatgacagagtaagactctgtctcaaaaaacccaaactgttcgggataagtggctcatgcctgtaatcccagcactttgggaggctgagtcaggtggatcacaaggtcaagaattcaacaccagcctggccaagatggtgaatccccaactctactaaaaaaatgcaaaaattagccaggcaccatggcaggtgcctgtgatcctagctacctgggaggctgaggcaagagaattgcttgaacccaggaggcaaagtttgcagtgagctgagatctcaccactgcactccagcctgggcaatagagtgagaatctatctcaaaaaaaaaaaaaacatggagaaactccatctctactaaaaatacaaaattatccaggcttggtggcacatgcctgtaatcccagctacttgggaggctgaggcaagagaatcgcttgaacctgggaagcagaggtttcggggaggcggaggttgaggtgagccaagatcatggcattgcactacagcctgggcaacaagagtaaaactctgtctaaaaaacaaacaaacaaacaaaacaaaacaaagaaaattacgcacaacttatttcctggtttgtgataatctgtgaaatacattttgaaatgaattggaattcaatacagtactattcacaccccaaatactcctaatatttcctttcagagatgatgacctggcactcttcctaggacttgacttctccctacaggtccccagtacaagtatttgtgattctgagttaattcattgtctacatgtgtgacaatgcaatgctcttgttgttgtaaagtaccaagatgagtcaggtccaaactgcacatttgtagagaacatagtatatgtgcaattgagcatgtatgtggttatgatactgaaaataatacgaacataggccagagcagtggctgatgcctgtaatcttagcactttgggaggccgaggcatggagatcacctgaggtcaggagtttgagaccagcctggccaaccagcctggccaacttgctgaaaccccatctctactaaaagtacaaaaaattagctgggcgtggtggcaggcacctgtaattccacctactcaagaggctgaggcagaagaatcgcttgaacccgggaggtggatgttgcagtgagccaagatcacaccactgcattccagcctgggtgacaagagtgaaattgtgtcaaaagaaaaaaaaaaaaagaagaacattggccttgggcgtttctttaggttgcctcctgtgttctatttatagcatgcctttatcagggttttggggtttgggactaattcccaactttctggcaccgtaaagtgtttcgattcatctggtattttccctgacccagacatggaataaaccatttatttaaagatccttggtttcttttattgaaaagtattatttacaaagcaccaaaatcttgggctgggtgaggtggctcaggtctgtaatctcaacactttgggaggctgaggcaggaggatcccttgaggccaagagtttgagaccgtgcaagatcaggccatgcacaatggctcacacctgtaatcccagcactttgggaggccaaggaaggtggatcactgaaattcaggagttcaagaccagcctggccaacatagtaaaaccctgtgtcaactaaaaatacaaaaaaattacccagaagtggtggcacctgcctgtaatcccagctacatgggaggctgaagcaggagaatcgcttgaacctaggaggcagaggttgcagagagccgatcgtgccaccgcacttcatcctgggtgacagagtgagcctccatctcaaaaaaaaaaaaaatctttgcaagatgaatgctacaaaatgagggcaaattgttggctataatcggaagactttttctcgattgaatgctctatcccaaagttctatgagaggtggtttgtgtgtgtctattggctgccttgtggatagtatgtatgattgatcctcagtgctttgggaattatgtaaaatagtttatattatgaaagtaattcaacctagcattaattgtgctaagtgttgaaaacgaaaagtgttgactacatctgaatgaatgagtatctggcttaccggttttgtttttgttctgttttggttttttttgtttgtttgtttttgttttttgagatggagtctcactctgttgcccaggctggaatgcagtgacatggtctcggctcactgcaacctccacctcctgggttctagcaagtctcctgcctcagcctcctgtgtagcagggactacaggtacatgccgccacccagctaattttttgtattttagtagagacacggggtttcaccctgttggccaaggctggtctcgaaatcctgggttcaggcaatccacccaccttggcctcccaaagtgctaagagtacaggcgtgagccaccgcaccagcctagcttacactttacagcttgtttcttatgcataatagtttttgtttggttggtttttgtttgtttttacaaacagggctatgaaaccatcaagatttgtggatcatcaaaaaacaaaacatcctgataaaattgagaaacaatgtttaaaaagtttaaaatcgaattttgaactgtaacactgttacttcttatttaagaaggacaaggagccgggtgaggtggctcacacctgtaatcgcaacaatttgggagaacgaggcgggtggatcacgtgatcccaggagttggagaccagcctgggtaatatggtgaaaccttgtctctactaaaaacacaaaaactagcctggcacggtgtgtgcacctgtaattccaggtactggaggctgaggcaggagacttgcttcaacctgagaggcggaggatgcagtgagccgagattgcagcaccatgctccagcctggactatacaacgacactcgtctaaaaaaaaaaaaaaaggataagcaaattatggtgaaataattgccctataaaattgcagaaataggccaggcgcagtgactcacgcctgtaatcccagcactttggaaggccgaggcaggcggatcatctgagttcgagagtttgagaccagcctggccaacatggtgaaaccctgtctctactaaaaatacaaagtcagccaggcgtggtggcacacgcctgtaatcccagctactcgggaggctgaggcaggagaatcacttgagcccaggagatggaggttgcagtgagctgagatcgtgccactgcactccagcctggctgacagagcgagactctgtctcaaaacaaaaaaaaaagaaagaaaaaaaaagattaatcgttgtaaaaccccatagtgctttatagttgctgaaactgtcataggactcacattagagaccgtaacttcaatagtgatgtatcacattgccattatttcacaatcactcctattgagcaataattcaattcaaagatgctttaatgagatgtcaggtaataccaaagagtagctgattaatcaagtaagtttcctattcagatcaatgaaatcagttactgagagtaaggcctgacaataggacatgtttgttatttcaataatgactgcaaactagaagaagagatacttgtaaaatctttagacactgaccgtaccagaacatctattcttgctgctataaaaacttggtttggggctgggtgcagtagctcacgcctgtaatcttagcactatcatttcctcatatgatatggaaaatgccgacctctgcatcctaactctaaactaatttcccactcacttactaagcttcagtcacaccaggctgctttctgtttccggaacgctccaagtgctctctgatttttcagggtctttagtgtagctgtgcctctgcttggactacccttccacactgctggcttctcaccaccaaagctcgagggttatctctcagacacccatcctatcaatgctacgcgaagtatccctcaagttactgcttataccacctattgatttatttcatagtatttatcacaatataaaattacttcatttcccccctttaatttaaaatcttttttttttttctccagactagaatgtaaacctcatgtgggcagcagacatgtctgcttattttttttttttttttgagacagagtcttgctctgtcacccaggctggagtgcaacggcgcgatctcggcgcactgcaacctccacctgccaggttcaagcgattctcctgccccagccctccaagaaactgagattacaggcgcccaccaccaggcctggctaatttttgtatttttagtaggggagcagtcggactctggactatatttcctggaggatcctgcaggccgataccacgtctcgcgagattttggcttcctcttagccaggtggcagaatctttcgctgtgcgcaattagctgctgccgcgccttggagtctggagcaacttggccaggctggccccgagcggaactagagaaagctgaggatgaggaatccggcttctgtccttttgtgtgtggagggctgaggagaggagtttgcgtgtgtgattgcgatggttgccgtgggtcttcgtggtctgtgactgtggctgtgtggtgctgactctgggtgatcaggtgggcgcttgtgactgtgcgcgctcggagtggatgtgtgtgtcctggacgagccgcgttgtgtgtgcggatgtggacaaccgttgactgtgtggttggggatgcgtgtcccagggtgggtgtgtgactttgcgtgtgtgtgcaatactgtgtgtgcgtgagttgcaggtctgtagctgtgcaggtgcaacttgtgtggccccgtggtctgtgtgagagaggagagtgtgatcggctgtgaggcagagggtaagtggatatagggaggcatgtgtgcgattggaactttgtgtgtccccctgagagaaaaaaccctttagggagttagggcgggtccttggtaaaactcctttaaatagagaacagcctgaaaaatcaggctgcaggcacagagaaggaaaactagcacagggggttgtcctaaagacattcctcagctgcattgataagggaccgaggcccaacatagaaatgcctttgtcctttgtgtgaccagcgggcttccaggaaatagtcactttttttgtgggcatgtatacggtgggctctgttaaattttgaagggaaggtgaaggttaaagaaagagagagagttggcggctctatggaggggaccaactaaatgccagagcccactgccgcttacaggctggagcaggaggggtctgggcagtatggcttgttgcctgggagaatgttgataaggatgtttcttgggcctttccccagcaggatgtgataaggaagtcaggcggttgggtaggatgtttctctcagcccaaaccccagtggaatgtttccctctgaccagggtctgtgaaatggtgggggcttacaaaacggtgcagcttggactagcaggctctggcggccactttccttttctggacatgctttggactgtgagccgagcctctatgaatcatcacttcagcccctgattggtcctgggccaaactttcactttagcccctgattggtcctggaccaaattttcacttcagcccgtgattggtcctaggccaaactttcacttcagcccctgattggtcctaggccaaaatttcacttcagcctccgattggtcccaggctaaggtcccagggccaaacgaagtagtgctttctccaagacagcccacagaccagtgagcacattcctcccctgcccagttcacaaaacccccagattcagcctcctagttggcaaacctcttttgggtcccctctccgctggggagagctttcttcttttgcttattaaacttccgttccaatctcatcctttgtgtccacgttccttaatattcttggctgtgagagaaagaaggcaaagacaagagcctttatcctaacaactcaattgctggagagaagattcgtgcatattctatgtggcatcacacgccatagccctgggattgaaagccatgcagtttatcggatggtgtcaatctcagtccaaatatgtaataagatctttcactttgctgtattttaggggtaggaatgagattgggggtttgatcaatagtttgtacccataggaccagggatttgcccagtcatctgtgagtaaatgcttaggccagtttccatgtctgtattgaattaaatactcatacggttctgtgattttgtcaaatacagatttggtctttgtccctattttctggcatacaactcctaaactccttggaatctcctaagtgcttgctttttttttttttttttttttttttttttttttttttttttttttttaaatggagtcttgctctgtcacccaggctggagttcagtggcgcgatctccactcactgcaacctctgcctcccggattcaaacaattcttctgcctcagcctcctgagtagaccacaggcatgcgccaccatgcctggctaatttttgtcattgttttcttttttagtagagaaggggtttcaccatattggccagtctggtctcgaactcctgacctcaagtgatctgcctgcctcaggctcccaaagtgttgggattacaggcatgtgccaccgcacccaggctttggctttttatatgttagtgattgaccgatagcttcaggatgggggctgctcatcagaaagaccaaggcaggattagagggttgggactttcagcccctaccctcccacccctggggagtggaggggactgaggactaagttgatggcaagtggccaatggtttaatcatgcctatgtaatgaagcctccttgcaaacccaaaaggagtggattcggagagcttccagagagctgaacacatggaggttcctggagggtcgtgcccagggagggaatggaagctctgtacgccttcccccatacctcacgctaggcatctcttcatctatatcctttggaatatccttataatcaaacagtaaatgtgtttccctgaggtctgtgagccattttattctagcaaattaatcaaacccaaagagggggtcgtaggaaccccaaattaaacccgtcagttggaagttccagagggtgggacttgtgactggtgtctgaaaggcgggcagttttgggggctgagccctcaatctgtggggtgacactatcacatggtagatagtgtcagaatcgaattggtggccacccagctggtgtctgctgcagaactgattccttgcttgctgatagggagaaatctcctcatattttgaggccacagaagtcttctgggtagattgttgtggttttggtgtgaagcagaggaagaacacaggttgagtttttccaaatgggttcacattgggggtcctcaacctcaaatccatcaactccatcgctgaatttttatttatgtatttatttttatttatgaggtagggtctcactctgtctcccagactggagtacagtggtacaatctcagctcattgcagccttcatctcctgtgctcaagtgatccttctactcagccttccaaataagctgaaaccagaggcacacactagcactcttgcataattaaaaataattttcagtagagaagaagactcactgtgttgtctgggctggtcttgaactcctgacttcaagcaatcctccccctctgcctccaaagtgctatgattacaggcatgagctgcctcacctatcactgattttctctttctttctttctttctttctctctctctctctttctttctttctttctttctttctttctttctttctttctttctttcttcctttcttttttttttgacagagtctcactctgccttgccaaggttgaactgcagtggtgtgatctcggctcactgcagcctccgcctcccgggttcaagtgattcttctgtctcagcctgctgagtagctgggattacaggtgcccgccaccacacccgaccaagttttgtatttttagtagagacagggtttcactatattggccaggctggtcacgaactcctgatctcaggtgatccacctgcttcagcctccaaaagtgcagtggcaggatcagggcatacggcagtcttgacctctggggctgaagggatcctccctcctcagcctcccaagtagctggattataggcatatggcaccatgccgggctaatatttgtaatgtttgcacagatggggttttgccatgttgcccagtctggtcttgaactcctgagattcaacaatcttcccacatgagcctcccaaagtgctggaattacagggaagagtcactgcacccggcctgtcactgcatttttaaagggaaggaggactatagtgagattcactaaggcttacaaaaaaggtagaaacctagatagattaaaagacagagattataatatccttgagatgataatattcaaatttagctttcatagatagggaaatttgaagtacatcagactataaggtggcattttgtgcaactaattaaaactatgttgtaactaacctgcacaatgtgcacatgtaccctaaaacttaaagtataataaaaaacaaaaacaaaaacaaaaaaaacaaaaaaaaaacaaaaaaaaaacaaaaaaaagaaagagagcaattgcattttcattactgagtaatattaagcaacaatgaaaataaatagaaataaccaagaaattgttatatttaaatcctccctcctttattggaaagagaagtattgatatttttagattctaatcaaaacttcgcttttaaaaaaattgatgattctatggagatagggagggaataacctatgtttattgaacacctaatattccacttacccgaatgtcatttattctatattctagtttttttgttgagacagggtcttgctctgttacccagcctagagtgcagtggggtggtcacagctcacagatatataccaccatgcctggcttattattttattttattttattttattttttgttatttttgcagagacggtgtctccctatatttcccaggcttgacttgaacttctgggctcaagtgatcctcctgccttggcatcccaaagtcctgggattataggcataaaccactgtgctcaaccaatattatagtgttaatagtagaagtgtcttagtgtactggaaaactttttctaaattttgaaaaaatattaaaaaacacgttggttttatttggccaatactgatttctttgctccatcattatttattggcattattagcctgttgactttcaatttccttacatccctttcactccatttcttttattttgtaccccaaatagaaattctttttttttttagatggattctcgctcttggctcttgtgacccaggctggagtgcagtggtgcagtctcagctcactgtaatcttcaccttccaggttcaggtgattctcctgcctcagcctcctgagtagcctagattacaggcaagcgccactacaccccactaattttttgtattcttttttttttttttttgagatggagtttccctcttgttgcccaggctggagtgcaatggcacgaactctgctcactgcaacttctgcctcccaggttcaagcgattctcctgcctcagcctcccaagtagctgggattagagggtgagccaccacacccgactaatttttatatttgtagtagagacagggttttgccatgttggccaggctggtctggaactcctgatctcaagtcatccgcctgcctcggcctcccaaagtgctgggattacaggcatgagccactgtgcccggcattttagtatttttatatttatttatattttgatagacagtctcgctctgttgcccaggctggagtgcagtggcacagtctcggctcagtgcaacctccgcctcccaggctgaagtgattctcctgcctctgcctcctgagtagctggtattacaggcacctgccaccacgcctggttaccttttgtattttaattagagacaaggtttcaccatgttggccaggctggtcttgaactcctgacctcacgtgatctgcccaccttggcctcccaaagtggccttgcttgaggccaggagtttgagaccagcctggccaacatggtgaaacctgctctctaccaaaaatacaaaagaaaattagctgggtatggtggtgtgtgcctgtattccaagctactttgatggctgagtcataaaaaatcacttgaacccaggaggcagaggttgcagtgagctgtgatcacctcactgcactatagcctgggtaacagattgagacttgtctcaaaaaaaaaaaaaattcttggcaggacgtggtggttcacacctgtaatcccagcactttgggaggccaaggtgggtggatcacctgagatcaggagtttgagaccagcctgactaacatggagaaactccatctctcctaaaaatacaaaattagctgggcgtggtggtgcatgcctgtaatcccagctattcaggagggtgaggcagaagaattgcttgaacccaggaggcagaggttgcagtgagccgagatcacaccactgcactccagtctgggcaacaagagcaaaactccatctcaaaaaaagaaaaaaaatctttactttggataaatacctagaaatggaatttccaggttggcctttagatattattaatggatttaatatgaaaaacctttacttgaggatgtataaagctttaaaagacagggtccctattcttaagttataaataaagcagcatttgtaaggtaatattcagaaaacatcagataatatcctataaagtcctcctgttcatgctgatgacattgtatggccagttaaggatgacacttcattctgtcccctgcaaccacggtcctgacatgtctaaatgacactggccctatgagaacactgtggatgtgaaagcatttcctcaagttatctttttggcctgctggttttaatctaatgatgggatatccaaagtgaatctaaaggagtgacatgattgtgcatctgttggggggaatcagagacagctagagcaaaggcagacacgtgctgaactcatctgtcttaagagctgaagcaagcagcagtattgctagcagagctactgcacatctgcacatgtgctccaatggctctgatctgtttttttcccagtatgaacctaatacatgaggcaagttagaaaatcggagttggccaggcatgatggctcacgcctgtaatcctggtactttgggagccagcgtgggtggctcacttgaggccacaattttgagaccagcctcagcaacacagtgaaaccccgtctctactaaaaatacaaaaattagctgggtgtggtggcaggcacctgtaatcccagctatgggaggctgaggttgcagtgagccaagatcaggccactgcacttcagcctgggtgacagagcaagactgtctcaagaaaaaaaagggaaaggaaaggaaagaaaatcacagcttgttaacctcttgcagctaaacacatatgcacaaaaattattcagtaaaagcaaaacagttttggtgtatcttgagattttgttttatatccaaaggaagactatatcttttatctttgaactactctttggaaaatgccttctatataacaaatgttatagttttcttctaattgggtcttgaggtctctcaggagaatggctataaactctacctcactctaatggggctctaggggaggggcctgtgggtctttagagtagcctttcaccagaaatttctttttcctggaccacagcctaatgctcaagtatctgacccatgaccaggtgtctcacaggaaacttgtttatactggcagatgcccttgtaacttttgtctgacctgtgtgcagtttattcctaccatgatacccactcttttttttttttttttgagactcagtcccgatctgttaccaggctggagtgcagtggcacaaccttggctcactgcaacctccaccatctgggttcaagcaattctcctgcctcagcctcccaagtagctgggactacaggtgcacgccaccatgcccagctaatttttgtatttttagtagagtcagagtttcaccatgttggccaggatggttttgatcccttgacctcatgatctgccctactcagcctcccaaagttctgggattacaggcatgagccaccacgcctggcctttttttttttttttttttttttttttttgagacaggatcttgctctggtgcctaggctggagtgcagtggcaggatcagagctcactgcagccttgacctcctaggttcaagcaatcctcccacctcagcctcccaagtagctgggactagaggcatgttccactacatctggctaatttgtatatgatatgtatttttgtagagatagggttttgccatgttgcccaggttgatcttgaacttctgagctcaagcaattcacctgccttggcctcccaaagtgctgtgattacaggtgtgggttaccacacccagccaatgtacatttaattatcaaagtactatctatactattttatggaagtactaattatcaaagtgcaatagaggttttgttgttgttgttgttgtttttcttttgagacagggtttcactcttattgcccaggctggagtgcagtggtgcgatctcggctcaccgcaacctccacctcccaggttcaagcgattctcctgcctcagcctcccaagtagctgggattacagacatgtgccaccacacccagctaattttatatttttagtagagactaaaatggtctctccatgttggtcaggctggtctcgaactcctgatctcaggcgatccatccgccttggcctcccaaagtgctgggtttacaagtgtgagccactgtgcctggccaatagaggtttttcaactttttgtagatatttttgaaagatcctgtcttcctttaaaaaaagagacaaggctggatgtggtggctcatgcctgtaatcccagcactttgggaggtcaaagcaggtggattgcttgagctcaggagtttgagattagcctggccaaaaggcaaaacctcgtttctactaaaaatacaaaaaaaaaaaattagctgggcatggtggcgcatgcctatagtcaaagctaatacagaggctgaggtgggaggatcacctgagcctgggaggttgaggctacagtgagctgtgattgtgccactgcactccagcctgggtaacagaacgagaccctgtttcaaagtgaaaacaaaaacaaaaaaaatgaaacaagagaaaaaaaacaagaaagaaagtggtgagggggaagtgcctatttattaagcttttgttgtaaatagtaacttgcatatcagatgtttactgtaatattcttgaagctttgccaggcctgcagcttgctgtgtgcttttcaactctatttcatttatttgggaaataatatatcaatgtactttattcattcccagctctaaccatggaatactgggaatgtcccattctatgaaggaggtttgccggccacaacaggaatattcatgaacatggaggtcctttgttgaagttacactaatttttttactcttccccattctgagcctagccggtctgctcactatattcgctccatccttcagcacccttccatctcttgcttcatcttaaaaacctttcctttaatttcaacagtgctgcctgagtttgtcatttcaggggttgggcatgttccaggatctgtctatagacttctctcaggaggaatgggagtgcctggacactgctcagaaggacttatacagagatgtaatgatggagaactacagcagcctggtctcactaggtaagtatgtctatccccaaataactcatgaattttgagtgtagctttcacttgtctgggtgacttttcacctgctgcttagggaattgttttgtgttttgtagattaatatatgggcagctctttgggttcccttcatcttctccatgcttcagacctttacaccttcctctagtccttcatgagtactaagggactaactttgaattcaggaacagcacgagtatgtcttacttcttttctttctttctttctttctttctttcttttttttttttttgagatgaagtctcactctattgcccaggctggagtgcaatggcatgatctcggttcactccaactttcatctcgggttcaagcgattctcatgtctcagcctcctgagtagctgggattacaggcacctgccaccatgcctgaccaatttttgtgtttttaatagagacggggtttcaccatgttggtcaggctggtcttgaactcctgacctcaagtaatccacctgttttggcctcccaacgtgctgggattacaggagtgagccaccatgcctggccatcttacttcttttcttatagacaggtctctctatcccaaagcctgatgtgatttccttactggagcaatggaaagagctctggatggtttcaagggacgtaccaggaggatggtgcccaggtgagtaaggactgagcagatgaggaaggcactgctgtttagaacccagcccatcagggaggcagcactgtaaaggtattggttgaggaatctcttctgcaaggtcccatgtaagagttgtggcctaagacacatggagaaaagtcaagatacccccgtcacacacacacatttttttaattttttttaatttgagagagagtcttgctcagtcacccaggctggagaacagtgatgcgatctcggctcactgcaacctccgcccccgggttgaagcgattctcctgcctcagcctctaaaggaactggcattataggcgcctgccaccatgcccagtaatttatgtatttttagtagagacagcatttcaccatgttggctaggctggcctcgaactcctgacctcaggtgatccacctgccttggcctccaaaagtgctggtattacaggtgtgagccactgtgtctggccaagaacccccttttacctccacctcttcagtctgtgctaccctcttgtcatcgtttctttccatttcaaagaataacattcccttcttcagaagccatcctgtttcctctatcttggagctacttctttcactttaaaaattaaacctgtgttgctgccttaaaaacaaatcttttaaaatatatttatttttcatactgatccttgactttttttgccttgtcttttcttggctagttttcctttaatgcagccatttcatgcatgaatggatattcattcactattttttttttttttttggatacagagtctcactctgtagcccgagctggagtgcagtggcgcgatctcgtctcactgcaagccaataagaagcgcttggggatgacctccctacaagcacagcaaaacttttcttgcgcatttctgcgctggaacgcctacccgctccgccaaaccaaaactttactatcacccttagtgccgtgtcctgcactttcttggagatttgtaccaggcgctggagactctcccacctggtccatgcccgccgcccggtgagcactgagacccaaccttgtgcaccgccagtcttgttatcaacaaacaggctagtaaattataaaaaataaaataaaggaaatgtagctggccgtggtggcatgtgcctgtaataccagctactccggaggctgatgcaggagaatcgcttgaacccaggaggtgaaggttgcagtcagccgagatctcaccactgcactccagcctggatggcaagagcgaaactccttcttgaaataataaataaaataaaggaattggggccgggcgtggtggctcacgcctgtaattccagcacttttggtagccgaggtgggcggatcacttgaggtcagaagtttgagaccagtctggccaacatggtgaaaccccgtctctactaaaaataaacaattagtcaggcatggtggcgggcgcctgtaatcccagctatttgtgaggcggaggcacaagaatcgcttgaatcccggaggcagaggttgcagtgagccgagctcgtgccactgcgctccagcctcggcgacacagcgagactccatcttaaaataaaataggctggctgagggtgctcatgcctgtaatcatagcactttggacgccgaggcgggtggattgcctgagctcaggagttcaagaccatcctggcctatatggtgaaaccccatctctactaaaaatgcaaaaattagccgggcatggtggcgcatgcctgtaatcctagctacttgggaggctgaggcaggagaaccgtttcaacccaggaggcagaagttgtagtgagccaagaccgccacattgcactccagcttgggcaagaggattgaaactccatctcaaaaaaaaaaaaaaaaaaaaaaaacaaataaataaatataaaagaaatagacaaagcaaaccttaatgcatgaactcaaacaaatgctttcactgccaggctccatctttgcaaatctgaacctagaacaatgtgcacgtttctaactagcaattctggaggacagatcagggaggcagtgtgagcttgcttttctgcaatttaattgactggtcagtaaagtcagtgtttgcaggcattttcaatgttctgtagtgggcttcagttcctatggcagtgtggcaggccaggtttccaatagcaaccagaagagtttctactaaccattttctataattttgatgaatgcataagttaacgttaaagaaatggagaaactggtgcctgagtatcagggatggaatgtgaaaacaaacctattgaaaccccgcctgggttttctcagaccctaaagtctgatcgaataatgatagcattggtacacattcacttcggcctgtcttaagattcagaaactttcccagatgctagagaaatctttccagactctagacccaagttaaagattagatgttgattgaatgaaacactcctgcttgtaggtgcaatcccacatggagcttaagatgtatataagcactagaaaaaaaaacttgtaactttgagttgatctggtgagttacctggcgcttctccctgtaaatggctgcagaaataaacttccttctttcccagtctgtctgtgtcttgttattgagcaattgcggtggacctgcccagcaaagtcctcttttgtgtggttatctgggactccttttggagggaacattttaaactttccatttcagagcattctgttggcactcttacactgtttttctctgcctaccctgggacctgagttctcctggacgtgaatctccagccacagagcctagaagcccattcctccacattctgtgactgttccccaaacacagggagaatttgcagaaaataagcccaaaaatcttgccattctttgcaataaaaccccacattacaaactgtggaaaacaggattttagcctgaataggtttttcctctatttgaaaccctttacaattttggagggaagtttccaaatcaatcagtaagtaccccccaccccaggtttatccttatgtaaagtgccccctttgcacatgcaagattgaataaaccttgaaaatattatgctaagtgaaagaagccagtcacaaaggaccacatgttatgtaattccatttaaataaaatgtccaaaatagaccaatacatagaaacagaaagtagatttgtggtggcccagggttaggggagttgtggggaaatggagggatatggggtttacttcagggtaatgaaaatgatctaaaatttattgtggtgatgtttgcataacagtgcaaatatactgaaaacctttgaattttacactttaaatcagtggcttctgtggtatgttatcaatatttctcaataaaacttcaaaaaaaaaatagtgcctatgtgtctttttatgtattattcctccagagtccagtccatagtttttacatttgatgaagaaattaagattttgttttgtcttcttcttcttcttctttttttttttttttgagacagaatctccctctgttgcccagactggagtgcattggcacaatcttggctcagtgcaacctccaggttaatttttgtatttttagtagagacagtgtttcaccatggtggctagactggtctcaaacttctgacctcaagtgagtcccccaccttggtttccaaaattgctgggattacaggcgtgagccaccatgcccagcccaagatttagtttccgttgttttgatgccctagggccatcttattctaccttaatttctgacgcatcatctcagtggaaattttacattaggttccaaagtattttcctcttttgaagattttatcagttgagtacagtagctcacacctgtaatctcaacactttgggaggccaaggtgggaggatcagttgagagcaggagttcaagaccagtctctgcaacatagtgagacacacatttctacaaaaaaaattttaattaggtgggcatatttgtgcattcctgtggtctcagattactacgtaggctgaggagggaggatcacttgagcccaggaggttgaggctacagtggccatgattataccactgcactccagcctgggtgacagagcgataccctgtcttaaaaaaaaattaattggaattttttttagaaaacaaagtatacacttagtgacttgatacaaatgaatgaatttgataatctacagaaaataaaacaaataaataaataaaaacccaaagccattcttcttatgtgaatctctggtgtctctgaattataagaattgtgaattatgattaataacaaatatgcatgacaaggactcagtaagggataggtgttgataaactgcaatgcacacttactggagtgaggcctttaaagatgtacaagaaaaagaaagaaaaggcattgaaaaattgcattgcctaccaaaacgctaaagtttacctaagtccattaatcagcacacacacacacacacacacacacacacacgcaataggtgtgtaaaatggtcaacacagtctcctatgaatgtatccttttattaataggtctgtgggggtaagagatgaggttctatagatcctggaatcagggatggggaatctgtggggtccctgggttgagagatgagggtctgtagattactgatgggtggtctttgggatagtgatgaggtccatggaatcaattcttgtgagtatgtagggtcagtgatgagggaatctggtgtcagtgatgggatgtgtgtggaatcaatctttgaaagccagatttgtggtgtcatctctcaggctgacacatcctgatctgtgtgtcagtggtggaaattctatggggtcagagtgtgactgtcaggtccctgacactgtgtgttctgggtctggccaagtgcacggattcccttgcctggtcctggctggagaggcccttctcaaggactcctcacatgaaaggtgggttggtggtgggttttgtttttgcttttgttttgtggtggaggtgggggtgggttggctttttctttagggtttagttttgtctcctagagaccacagacacatgcaacttttaggaagaaatttttgtctgggtggtcgctaggtcctttgggccaagccatctaatgggagtaaagctgaccattccctcagcgcggttcagatctagactgtcattttgaggtgtcctcaaggtggcgtgcaagtgggttgtggctttgagtggcaggtgtgtgggaagaaacaactaagaagacccaggagcgctcctagcctggatctgtcacagctggaagaacagcctccctgacccatcaggcgccaatgggaggtacctctgggctttgagaggctggtggaggtgggacctccagacctagagattctgggcacagaagcctgttactgccagaccctgaggcgttgccatgggatccaagggtgtttcaggtcagatcagagcctttctcagataattatttcggtaacttgtccagcgcacgctgctatgaaggcttaatgtgccgtctcccgcagtcttctttggtctgagagccacttgtttcttacatccctgtgctaatctcaccatctgctcctacataccccaggcatttgccacatgctggtcctctctttcctgacaggcgggacgtctctccagcttctgtgaggacaattcaaattatggaggagggggctgatgcagggcagcatgctgaggggagtaccgggcagttggaggagcaggggctcatttttctttgtagctcagattcctaagcctgtgactttgagtatcagtgtcttccttgcaaagtttcaatctgaggttcttggggagagtgcagaattggaacccgatggaagcctggtggggagaggggtggatggtgggaacatggagaatgtgtcaggttgtgtctattcctgacaccttactttgtctgttggagtttcccagtctgttccaaatgcactctctcgaccctgaagggacctgaggggggatgttggtcaccagtgtgtgctcccctggactcgattggaattggtcccacaaagtgttatttatttatttatttatttggagggagtctcgctctgtcacccaggctgcagtgcagtggggcaatctcagctcactgcaacctctgattcccaggttcaagtgattctcctgcttcagcctccctagtagctgggactacaggtgtccgccaccacaccttgctaatttttttatttttagtagagacagggtttcacaatgttggtcaggctggtctcgaactcctgaccaggtgatcgacccaccttggcctctcaaagtgctgggattacaggcgggagccatcacactccgccagtcccacaaagttaggcattatagtacattgctacttttgaatcacttattttttacttgtgtttttccccctccttttattgattgattgacacagagtctcactgtgtcacccaggctgaactgcagtggcacaatctcggttcattgcaacctctgcctcccgggttcaagcgattctcccacttcaaccttccaagtagctgggattacaggtgcatgccatcactcctggctaatttttgtattttcagtagagacagggtttcaccatgttggctaaactggcctcaaacttctgaccccaagtgatccacctgccttggcctcccaaagtgctgacataggcatgagcctcctttcccagacttccctccttttccttcagggattttaaatgttttctttcctccatctatttaataatatgtgattgccttgaggatttcaacttgaattaaaattacatatatttacctgtctttattaatattgaaacatattaaaataatacatgttcataatgaaaatgaaacattacaaattaatacacaggaaaggcagtattccccttccagttccacccttgaaataaccagttaacaagatgatgagcatctttccatgatgttctccaagagattcatataagtattggccagcaaacaacagaatatataggccaggcatggtggctcatgcctgtaatcccagcacttcgggagactgaagcaggtggatcttttgaggttaggagttcaagactaacctggacaacatggtgaaaccccattgctacaaaaaatacaaaaattatttggacgtggtggtgagcgccttaatcccagctacttgggaggtggaggtacaagaatctcttgaacccgggaggagaaggttgcagtgagccaatatcgcattactgcactccaacctgggtgacagactgagattccatctcaataaataagtaaatacataaaataaagagaaaaaaagaaagaaaaaagaaaaagaagaaagaaagaagaaagaaagaaagagaaagaaagaaagaaaaagaaagaaagaaagaaagaaagaaagaaagaaagaaagaaagaaagaaagaaagaaagagtgttcctatttctccacatcctctccagcacctgttgtttcctgactttttaatgattgccattctatctggtgtgagatgatatctcatagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaattttgtttgagttcattgtagattctggatattagccctttgtcagataagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccgtcttgaattgatttttgttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcccacgtatgtttattgcagcattattcacaatagcaaagacttggaaccaacccaaatgtccaacaatgatagactggattaagaaaatgtggcacatatacaacatggaatactatgcagccataaaaaatgatgagttcatgtcctttgtagggacatggatgaaactggaaaccatcattctcagtaaactatcacaagaacaaaaaaccaaacaccgcatattctcactcataggtgggaattgaacaatgagatcacatggacacaggaaggggaatatcacactctggggactgttgtggggtgggggaggggggagggatagcatgggagatatacctaatgctagatgacgagttagtgggtgcagtgcaccagcatggcacatgtatacatatgtaactaacctgcacaatgtacacatgtaccctaagacttaaagtataataaaaaaaaaaagaaaaagaaagaaagaaagaaagaaagaaagaaagaaagagaaagaaaggaagaaagaaagaaaaagagagaagtcttgtgctcaggttgctaagatcgatggtaagaacaaatcctctagcggtgaaaatgtaagaaggaaaaagaaatttctgttagtgttgtttgttgcaccccaagctctaaaaagtacagccacgtgtgtgataagtgcttagttaagatgaaaaaggcattaaatttgtgcgtggaaatcataaacagaaatgcgttctgattgacagcaattgggtcaatgctacccaagtttcagacatccactgcacgtctcctgcagataagggagggctactatataacgtttctttcttttttctttaattgtaaagcattctccttttttaatataacaattggccacatatatcactttagatataaagatattaggataccattatagtagataaaaagctaactcattctttgtaagagttaaagtatctttcattatatgagcatttaagatattaaagtacttttgccaccaaaaatagtgcttctgtaaatattcttttacttatatctctattaatttttacttctgctgaaacgaattgtatgagcaaacaagtgtatgtgtataaagtgtgatatatgtatatatatttaatatgtgtatatacaacttaatatatacacatacatacaaaaacatatacaatttttttgttttgttttttgagatggagttttgctctctcatccaggctggagtgcggtggcgtgatctcggctcactgcaacttccactgcttggttcaagtgatcctcctgcctcagcctcctgagtagctgggaatacaggcatctgccaccatgtccagctaactttgtttttttagtggagatgggttttcaccatgttggccaggctgctctcaaactcctgacctcaactgatccgcccaccttggcctccctaactgctggaattacaggcatgagccaccgtgcctgacctcaagtgatccacccaccttggcctcccaaaatgctggaattacaggcatgagccaccgtgcccagcctaacatatacaatttaatgtatatacaaatataggttgggtgcggtggctcactcctgtaatcctagcactttgggaagctaaggtaggggattgtttgaacgcaggagtttgaaatcagtctgggcaacgtggtgaaacccctatctgtacaaaaaacacaaaaaatagctggatgtacttgcaggtgcctgtggtcctagctactcaggagactgaggtgggaggatagctggagcctgagaggtcgaggctgcagtgagttgtgatcatgccactgcacccccagcgtgggtgacagagtgagaccctgtctcagacaaaaacaaaaacaaaccatatataatgtttatgtgctacacactcgatttctttccaaagggttatataacactgtaatttcaccagcaatatgtgtgactactcatttcctacgtatttgtgtgcagtcaagaaaacttagtaggcctgaattgtccaaacctcgcaaactccaaagaaaggtttgattctatcctagctcccaggaaataacttctaagtctttggaatctcctgcctatctgggagttaacaacatgatttattgtggggactttggaccatgcagtgtcagcttgaccttgggaagggtggagacagagaaactaatgtcatccaaatggctgctcttgtccatgtgaccaacttccagtaaaatcctcaacaccaaggctcaggtaagctttttgttggggagtatattctgtactttctgccacgtatcactgggtgaattaagcactgtccacatgatgccactgggagaggacaactggaagcttgtgctttgtctctcctggactttgccctaggcacctttttctgctgctgattttaatctgtatttttttgttgtaataaactgtgagtataacagcttcactcggttttgtgagtctttctaattaatcactaaacctttgggacctcagaacacaacattgtttcttttttttttttttttttttttttttttttgagacagagtctcgctctttcgcccaggctggagtgcagtggaacacaaccttgtttcttctttacttgaattttacatgttgtgtaagaaacctatgggcataactgaaaaatcacaaactaagaaagagctttccatgcagtctacccccctcaccctgtttcttcagtgctcccatgtctacttcctgaataaccaaatgtttaaattttctaaactatttctaatctatatatctgagtaattatctctgtgttatataataggtagatcctgctccttatcaatatatcaacttgatatattatctgatggcttcctcttctgatagctgatgacttggctgacactcaccccttaccccagtgcctggatcacttttcaaacatggtgctctcaccattttctttttcttttcttttcttttctttttctttttctttttctttttgagacaaagtattgctctgtcacccaggctagagggcagtggcatgatctcggctcactgcaacatccacctcccagattcaagtgattctcctgcctcagcctccagagtagctgagattacaggggcgcaccactacgcctggctaatttttgtagttttagtagagatggggtttcatcctctcagccaggctggtctcgaatgcctgacctcatgattcgcccatctcggcctcccaaattcctgggattacaggcatgagccaccgcacctggccactctcactattttcaatggctctcttggtcacctttcactcaggagagtatctgaggcaggagaatcgcttgaacccaggaggtggaggttgcaatgagctgagatggtgccattgcactgcagcctgggcaacaaaagtgaaactctgtcaaaaaaaaaaagcagaaaagaaaagaaagcaagctcttcctccatatacctgtaaggatcattgtcttaattttcttcatgtcttaacatgattcttgccttgtcaaagatcatcctatctgaaattgaaactatttacctcttgccttttttccacagcacttaaaacttttatttttgagatggagtctcactctgtcacccaggctgaagtgcattggtgtgatctcagctcactgcaacctccgcctcccgggttcaagtgattatcctgcctcagcctcccaagtagctgggattacaggcatctgccatcacgcctagctaactttttttttttgtattttagtagagacagggtttcaccatgttggccaggctggtcttgaactcctttcctcaggtgatcagaaccacttcggcctcccaaagtgttgggattacaggcgtgagccaccacacacagccctggctaatttttgtatttttagtggagacagggtttcaccatgttggccaggctgatctcgaactcctgacctcaagtgatctccctgcctcggcctcccaaattgttgggattacaggcatgagccactatgttcggacttctttttaacaaaccatctctgttcttatattatgtccactagaatgtaaacttgatgagagcaggagatattgtcaattttgttcaatgctatttatccctagagcctagaactgtaccatgcacatggtaaggagacaaatatttgttgaatgaatttattgagcagctgttctcagatttttggcctcagaaattctttactctctgtttctttactcctgacctgaggtgatctgcccacctcagcctcccaaaatgctaggattataggagtgagccaccacgcccagccgcccaactcatttttgtatgtttagtaggcacatggggttttgcaatgttggccaggctggtctcgaactcctgacctcaagtgatcccccacctcagcctccaaaagtgctgagattacaggcatgagccaccccacccgactaaataaaccaaaaactttagataagtgaatttggaggaaatatttataacagataaaatagacaaacagataattctaatttattgtctctctgccttaataaaatattagacaataccctaagaagaaagaaacaaaatctaaaaattcaccattcacaaacacaaatagttagaaaacaaagtcaaaacctaagaacatgttgaccacttatctgtcctctgaaatcggctcttaaatgtgttgaacatagattgacttgggattaggaaatttttaaaatattttttaaagtttcactttttggaattgaaaattaatccagattatgtaatatacaacatttggaatttaccaatcaatactctatcattttatttttcactcttcaaataatttcttgttcaagagtttaaaatgcttttaaaattaatagattctgcaggctatagtctgcagagactgtctccacaaaaaataaaaatatatatacttttaaaatatatataaaatatatatttatttaaatgtacatgttttaagtatataaaatatatttttaaaatttcattttttcaccggattgtatggtaagcatatgtttagtctggcaggaacttgcaaaactgccttctacagtggctgtcccactttgcattctcagcagaaatagagatgagttcctgtcgctccatatcttcaccagcatttggtgttggtgtttgcattcaagccagtctaatagatgtgtaatgatatcattgttttaatttgaatcccctagtgacatatggtgttgagcatcttttcagaggtctaagaaatgtgctgggcatggtggcagacacctgtggtcccagctactcaggaggctgaggtgggagcgttacttgagccctggaagttggggctgcattaagccatgattgcaccactgcactccagcctgagtgacagagctaaaccctgtctcaaaaagataaataaggccaggtgcagtggcccatgcctgtaatccaagcactttggaaggccaaggcgggtggatcacgaggtcagcagatcaagaccatcctggctaacacagtgaaaccccgtctgaactaaaagtacaaaaaaatagccaggcatggtggtgggtgcatgtaatcccaacttcttgggaggctgaggcaggagaatcgcttgaacccaggaggcagaggttgccatgagctgagatcacgccattgcactccagcctgggtgacagagtgagactccatctcaaaaaataaataaataataaataaataaataattgacttaatttttagaacagttgtaggtgtacagaaaaatagagcagaaggcatactgagctctaatatccgcctcatactatagtacacacactttctctattatcatcttgttaatgtggtacatttgttatgtctgatgagccaatattgatattattaagttcatggcttatattaagattcactctttgcgttctaccatttatggtctttgacaaatgcttaaggacatatattcaccattatagggtcacacagaaaagtttcactgccctaaaaatcttctgtgttccacctattcatccttccctccactcaagcccctggccaccactgaactttttataatagcatctgcctagttttgccttttctagtattccatataattggaactctacactatgtggcctttttgtattggcttctttcacttagaaatacgtgtttaagattcctccatgtcttttcatgccttggtagttcatttctttttattcctgaagaatattccattgtatgaatgtttcagagttagtttatccatttctctattgtaggatatcttggttacttccaatctttgtcaatttgttgtaaacattaatgtgcaggatttgagtgaatataagttttcaagtcatttgggtatataccaaagaatgcaattgccagatcgtatggtaagcctatgtttagttttgcaggaatttgcaaaactgccttccacagtggctgtaccactttgcatttgtggcaacaatcaatgagagttcctgtagctccacatcctcaccagcatttggtggtgtcagcatttggatttgagccagtctaatagatgtgtagtggtatctcatcattgttttaatttgaattctctagtgacatatggtgttgagcatcttttcagatgcttgtttttgctgcctatataacaaagggtagatacagatgatggacttcagggaaagagcttgctatgacgataggaagctgcaggcagagatgatctcagggttaactggacaccaactgtgccttctcctgtcacataaaatgtggtctacctaagttttgactggaaacacagactatctggttgtccataaatatttctaactgaggcttaaggtttatgcatgtttcgaccaaaaggtgataccaccccaatatataagcaggtcggggtacaacaggtaatgactgtcagagatgttgagagtctacattgaatggtgtcactggctgcccatgcctttctcattaaggactttcacttttcatttgccacatgaaaggccactgagttaggctacatcttattttttctcttgagaatctctagtactgagaaatttttgcattctgggctacactgggttcataatctgactatatatattgtgtgtgtgtttgttccttccctaaaatgctcagttcagctgcagttctagaggtaaatactactaggtttccattttagagagttgaagatctgaggtctggagaggttagtgtgtagaaagttatgtttaataagtggcaagaccatgtggccaggtcagataagctgccttcagattttactctcgaacttctactggataatgtcttttcattatagaaaagaaaagagggaacttagatgtttttttcaaaatcattgactatagaatttctttcaagatatgatgaaaagcaataattgtctcattttatattacctataattattgctcaccagaaattgattatcgatgcagcaatcttttacgttcctgtctgctttattatgcatggccgggcttcattgtaaataagagatccaagattcagaaatatctttaacttgcaatgcttggtcacaggtatccatctgaaaaatattttgctcattagccatatggactcatatggtaaactacagccagagactcaaaatgtggaaaggagaaagggctatcagaagtcctgtgtctccttacattttgtgtttctattcatatgtatctagaatcatgagaaatttgagcaaatgggaaatgcaaagtcctagtccatgcatacccacatttcagttatctgcattattgcacatttaaatttataatgcatacataggatacaattcaataggtataaaaatgttaagtaatcttttctctcatgcaccccagtcattcagtgctcacttttgagtcagcattttaattctgttgtgcatactttcataattttttttttatctttttttttttttttttttgaggcagagtcttgctctgttgcccaggctggagtgcagtggcatgatctcggctcactgcaacctctgccttattgattcaagagattctcctgcctcagcctcctgagtagctgggattacaggcacgtgccaccacgcctggctaattttttgtatttttagtagagtcggagtttcactgtgttagccaggctgaacttgaacaactgacctcataatcttcccgcctcagcctcccaaagagctgaaattacaggtgtgagccaccacttccagccttctattcctttatatgtgaaaatcattttaacattccacatataagtaaggtcatgcaatatttttctttctgtgtttggccaacttcacttggtataatgccctccagtttcatccatgttgtggcaaatggaaagatcttgtacttttttagggctgaacacagaagttattttcatgtacaaggttgcagttgccatacacacaaatatgtatgtatgtgtcatagtcatatacaattttaaatacatatatgtgttctatgcatatataagtatttctctattttcacagaaatgtcagtctaaatcagtacctagggagggtcattgttttcttaatctacaaatcaagacaaagtatgagtggctgcaccctagtttaataagtcctctattattgaggatgttttcctgtttccttttgtcattgttgttgttgttttgttttgagacagagttccactcttttgtatgaagtggtgtgatctcagctcgctgtagcctcccgagtagctgggattataggtgcccgccaccacacccagctaatttttgtatttttagtagagacagggttttaccatgttggccaggctggtctgaactcctgacctcaggtgattcgtccaccttggcctcccaaaatgctgagattgcaggcatgagccaccgcacttggctgctttcaccatttcagactgagcttggagaagaacctgaagaaaaacatgactttaaaattttgatgaatggagaaatatctttccattcaccttcctttcctctatttcattcttattttaaaatatacaaacaaagatatggatacatcagttattaaagaaacatctatgtgatacctatccaggtgaagaaatagagcactatcaccactgagaagtcctctgtatgcccctaactgatcctaaagtcttccttccccttattagtaacagatacaacagatatccacattacctgtgggtatctgccatcctctccttggttctctttataattttattatgtattttctttcttttttttttttggagatggagcctcactctgtctcccaggctggagagtagtggcatgatcttgactcactgcaacctctgcctcctgtattcaagtgattctcatgcctcaacctcccaagtagctgggattacaggcatgggccatgtgccaccatgcctggctaatttttgtatttgtagtagagatggagttttgcatgttggtcaggctggtttcaaactcctgacctcagtgcctggccttattatgcatttttatatgcctaaattaaagtctgattttgcctggtttttctcttacataattggagtaaaagtctgtatcctcgtgcatttggccccttttactcaatattaagtatttaagattcacagtgagcattgtttctgcattctattaaaacagtacaccagccaggcatgatggctcatgcctataatcccagcactttgggaggccaaggcaggcagatcacttgaggtaaggagttccagaccaccctagccaacatggtgaaactccgtctctaataaaactacaaaaattaggccacattgtggctaatgactgtaatctcagcactttgggaggccaaggcaggtggatcacacggtcaggagatggagacaatcctggcaaacatggcgaaaccacatctctactaaaaatacaaaaaattagctgggtgtggtggcacacgcctatagtctcagctactcgggaggctgaggctgaagaatcacttgaatctgggaggcagaggttgcagtgagccaagtttgagccactgcactccagcctcggtgacagaacgagattctgttaaaaaaaaaattagccaggtgtggtggtgtgcacctgtaatcccaattattcgagaggctgaggcaggagaatcagttgaacctgggaggtagtggaggttgcagtgagccaagattgtgccctgtactccaacctgggcaatagagtgacagtctcaaaaaaaaaaaaaagcccaggcccagtggctcccacctgtaatcccagcactttgggagtctgagacaggtgcatcacctcaggacaggagtttgagaccacccttaccaacaagggtaaaccccctctctactagaaatacaaaaatttactgggagtggcggcgtatgcctgtaatcccagctactcgggaggctgagacaggagaattgcttgaacccgggaagcagaggttacagtgagccgagatcgcaccactgcactccaacctgggtgactaagcaagacgctgtctcaaaaatatatatataaatttatatttatatacataaaataaatataaaaaaaataagtaaaaataccgtacaccagtgtgtatcccttcattgttggtggacatgtgggttgtgttcatttttgtcagttacaaatgatgctgttgtgaacatgtttgtatttctatttggttaccattagtgtgtatttatgtacagtataaagcaagaggtgaaaccataggttacagggtaaacatatcgtcagttttaccaggtattattggtttcatcccaatgttaacacaccaactgtcagtcttacaatgtctgataattcccaaatctttgcattcttcttgacatttaattttgtcaaaattttaatttgagtcttttggtgggtatgtggtgatgattgtgatattaatttactgggccttttcttctctgtaacaggccctgtcaagatatatgtgtggtgtggcaggggtaggagcccctagaggtagcatgggctctggaatccttaatcatcctatgtgaaaaagttgatggggcagtgatttttctttctttctttttttttggggggggggacagagtttcgctcttgttgcccaggctggtgtgcaatggcatgatctcagctcactgcaacctccgcctcccaagttcaagtgattctcctgcctcagcctcccaagtagctgggattagaggcatgtgccaccacacccagctaattttttttatttagtagagatggggtttcaccatgtttgtcaggctggtcttgaactcctgacctcaggtgatccacccacctcagccccctaaagtgctgggattacaggcatgcaccactgcaccctaatatttcctgggtgcagtgttgtagccagggtgcaaagccacttaatgattctgtcatccaaatattatatcttctcccttccccttgagatatgctcattcccccatacaattaaagaatctcaattactcttgaaggggcataaaatcctctctgtctaatcatgggtccttccaaattatttgttggctgtgtttaaaatatgaaaaagagaatgtagattttgttttcttctttctgcttaacctgaacaaaatgtcatagatacctcttaacctgttgctaaaccaaggagagtcacttgaataatgaacaagactggagggacgccacatggataatttatcattacactatcatcacatacatggaactcatcaatgaagcttatgaaaaaaattgagtcatttgtggaaaagtgtaaagagaatataggagatgtctcaagtgaagagaaaaaagctgcagaaaagaattacaaaaaaagagtgttaagatgcaaacacaaattcagagattcaggagcacaaagggctaagttaagggaaaaaagagttaccaatattttcttattcattatggagagcaggatgaattctttaaaggtcaaataattgtgagtctgatatatctgatgataatttgtatttctaatgttgtaaatggttgtgaatttatggtcattattcctgtttcctttagactagtgaccatgagtttgattgacaaaaacccattgggttagtattgttatctatgtgtgttcatcatgctatgtgttaaaataagtccatcaatttttatcttgtgtttgttttcatttcattttagtttaggttctttgggacagggtcttactctgtcgcccaagctggatgtgcagtagcaagatcacagctcactgcagcctctacatctccaggctcaggtgatcctcctacttcagcctcccaagtagcagggactacaggcatgagccaccgcacctggctaatttttgtattttttgtagagatggggttttgatatgttgctcaggctggtctcaaactcttggactcaagtgatctgcccaccttggcctcccaaagtgctgggatgactggcatgtaccactgtccccgacctgttttcattttattaattggctgattcatttagacacataatcatcaagtcaaatctcactctttccttagcatttcccttcagtttagcttagaatatctattcctattttaaaacacatatgattattcaagtgtggtggcacatgcctgtaatcctagctactcaggaggctgaggcaggagtatcacttgaacctgggagagtgaggttgcagtcagtcgagatcgccccactacactccagcctggatgacagagtgagactccatctcaaaaaaacaaaacaaaacaaaacaaaacaaaatgttttctccagatcatttttacatttaattattcagtctgctttaactataccttaatgtaaaaaattcagtaaatttaactcctacacactattagttaatgtacctaacacggtttattgaataagccagtccattcccaacagcatcaaaagtaattacatttcccaatgtaaattaatacagccattatggaaaataatatggagattcatcagaaactaaaaatagaattactgtatgttccagcaatccctcctgtggttgtatagctaaaggaattgaaatcagcaaactgaaaagataactgcactaccatattcactgcagcattattcataatagctaagatatggaagcaacgtaggaggccagcattggatgaatggataaagaaaatgtgatatatgtacacacacacacacacacataaaggaatactatccactctttattttatttatttattttttatttattttatttcattttattttggacgtagtttcactcttgttgcccaggctggagtgcaatggcatgatcttggctcactgcaacctccacctcctgggttcaagcgattctcctacctcatcctctcaggtagttgggattacaggcatgcaccaacaagcctggctaattttgtatttttagtagagacaggtttcctccatgtatgtcaggctggtctccaaatcccgacctcaggtgatcagcccacctcagcctcccaaagtgctaggattacaggcatgagccaccatgcccgatcttactatttgctctttatctttcctttgagatgaagtttccctcttgttgcccaggctgaagtgcaatggtgcgatctcagctcactgcaacctctgcctcccaggttcaaatgattctcctgcctcagcctcccaagtagctgggattacaggcacccgccaccatgcccagctaatttttgtatttttagtaaagagggggtttcacaatgttgctcaggcttgtctcaaacacctgagcttgagtgatccaccggtctcaggctctgaaaatgctgggattacaggcgtgagccacggcacccagccaaaaacacagatgagtgtattaatagtctgaagcactgtaaaatattgctgagaaaacagatcactaatatcatcattacagagcacaaaataagttctgctattattaggaatatcatagctctgactaacacatacttggaaaactcattctattagaaattaaattatactaatactattgacaatcacttttatagttgtcattgcaaactcaaagacaagaagtaaattcatcaccagaaaacataaaacaagtacttagccttactgctgagaagcctgtaattgcattttactgaatggcacctcagttcttgggataaaatttgaaacggcaactggaaggacagctttaactttaaaatggttttatttttagggttgtcatgttgtaaaagctattctcacatagctaagctgttggaaagagaccaggttttgtgaaagtttttcatcagatgtttcacgttgtcctcactgcaacctcaaacagtggcaaatgctttgtaagctgctgtaatgcaaactcagctgataaattaataaaattctgtttctttaggccgggcacggtgactcacatctgtaatcccagcactttgggaggccgaggcgggcggatcacgagatcaggagattgagaccattgtggctaacacggtgaaaccccatctgtactaaaaatacaaaacattagccgggcgtggtggcatgcatctgtaatcccagctacttgggaggctgaggcaggagaatcgcttgaacctgggaggcagaggttgcagtgagccaagattgcacaactgcactccagcctgggggacagagagactccgtctcaaaaaaataataatgaaaaatgaataaataaaattaaaaaaataaaattctccttctttaatgtcctaagccagaaaatatttgttaacattgctaacaggaatgaatggacgtgaatggaccacccaaagattctcctatttcagggtcaacttcaaagagaaaacatcaatttcacagtgtttcttgcttacccaggtcaagagttaccaatatcaagacatccaactgcacagagattggacctagagcagcaggagggcgtatacaaatcacagataccagacggaattgcgagagggagcagaaaaatgattcatctgtatcaggtgtggtctgcaagttgtaggatgtagaatatagcttgtggataaagagaattagaaaaaattaatgcccattcaagtttattttatgaactagccaaaagtcgcacatggatattcacagtaggtagaatgattagagcagaagtagcacttttggcacatagttattgggattgaaggggaattcattttagctttaactttaaaatagatttaattacttttattttaattaattattctaaagcttttaattttaaaaaagtttgtaatttttattttggcaaaatatacatagcataaaatttgccattttaaccatttttaagtgcatagttcagtgtcactaaatacagtcacctgattgtacaaccatcaccaccatccatcatctctagaagtttttctttttcagtttcccaaactgaaactctgcattctttaaacaatagcccttccttaatctcttttcccattaactgggaaccttcattctacttttggtttctatgaatattacatgctacatacctcatataagtggaatcaggcagtattagttttttgtatccagcttctttcacttagcattatgtcaaaatccatccatgctgtagcatgcgtccaaatgtccctttttaatgctaagtaatattccactgtatatctgtaccacattttgtttatccattcctctgtcaatgaatgcttccaccttttggctatcatgaataatgttactatgcacatgaatttgcaaatatctgttgaagtccctgctttcaattcttgtgggtttaaacccagaagtggacttgctgactcatatggtaattctatgtttcatttttatttatttatttatttatttatttatttatttatttatttgagatggagtctggctctgtcacccaggctggagtgcagtcgtgtgatctcagctcactgcgaccccccacctcccaggttcaagggattctgctgcctcagcctcctgagtagctgggattataggcacacagcaccacacccagctaatttttgtatttttagttgagatggggtttcaccatgttggtcaggctgatcttgaactcctgacctcgtgatctggccacctcgttgtcctaaagtgctgggattacaggcatgagccactgagcccagcctatgttccatttttttaaaatttaggaactgctgtactcttttccaccatgactataccactgtagagtccaccggtaatgcacaagagtttcgatttggctacatcctcaccaacacttattattccctggttttttgatgattgccatcttaatgggtatgaagtgctatcttattatggttttgatttgcttttccttagtaatcagtgatgttgagcatctttcatgggcttgatggccagttgtatatcttttttgggaaaatttctatgtaagtcctttgcctattttttaattgggttgtttatttattgctgagttgtaggagttctttatatattctggatattggtcccttatcaaagatattatttaaaatattttcttccattctgccggttgtcctctgattgcacaaaagttttaaattttgatgaagtccaatttacttatttttttgttttgttacttatgcttttggtgtcagaaagcttttagtttataattttaaatatattacgtctcctgcctcataagtaccactggacaaggtcccttttatgtactcagcttctgtcagaggtaaatgtattttgaagtggaggacaaagataattgcacaattggcatggagaactaaggtaattatgaaagttccagatacaaagagagagagctcaatatgccagcagttctctaccaatccatcctagaggtcttctcttgggattgcctaaataatgcaggggatggttgcaagatacacaagtgttccagaagcgtgtaaacaaggtacagagaaaaggatgagataaaataagatgatataagatattaggaaagccttgttcagaagattgcctacagaggcaaaagggacagtttcattttgctgagggaaacagggtggtaagaacacttgtggggaagacccccacttaccctgatacagagagaagctgtaaaataacttaatgggagagcattaggctgagatagttcccatggcctgggttcctacataggcaaaatgaaaagcttagcccatcaacaagtggcccgctgagtattagctgtgtaatgagagacctaccaccaggatacttcaaataatgcaactgcccaaatttttgccaatcaaataatttctctactctacttctatattcaccctataaaagccttccctacaaacacctccagtagatcctccaaccactttcagtttggagctgcctgatccatgaatctctgtttgctcaaataaactctttaaaaatttaatatgcttaagtttatctatttttttctcatttttaaaaattgaaatgggatcttcctgtgttgttcagcctggtcttaaactcctgaactcaagggattcacctgtctcagcctcctgagtagctggaattatagacgtgtgcctccacacccagcttacatttatctttaaacaagggtttgacccctttctgaaatatatttgtgtgaagacctgtaccctcagtgatatggcaagctcattttagaccatcgagcacttttgtctctggaccacaatttgccctttgtgacctgctctcctaaaaaattcaagtgtaattcaagttagtttaccctctgctgatcaggggaggttgatctaggtgcaagttcaagacaggcactcactccttcattcataccccaaatctcagcatcacacaatacacccatgtaataaacctgcacaggtaccctccagaatctaaaatgaaagttgaaattcattaaaattgtaatttcatcttattaaaaaacaaagataaatttgcttctttccaattttgatatatattatactgacatacacactgtattctatggtgaattatatcgattgaatttcacattttaaactaacactgagttactttgagaaactctgttgggtcataatgtgttatgtttttaatatattttaatacaatttgcaaaaattctgttttaaaattacatctatgttccataaataaataaatatgtaaaaaataataaatgtttatattattcaagtgaagattatagcgatctttttgaatatctacttaacctcagctagctttaaattcagaagtagcaactccatagaaattcaacttatttctaccttattactcatacttgtctccttgaagaagcttcattgctgtcatccagtttagactgggatgtcataaatctctagactgagtagtataatattcactattaaaataaaatcaaattattattataatgttatgacacctccaaatacaaaaagcaagcccatggatgttaggttaaggtatagagacaagtattcctacttactatcttttagggcagacatatcccagccaaggtgattgcaaaatgaaatggaaactatatggtggaaggggacttgagactcacacagattggattttcattccaaccctcacatacacaagctgcatgactctgggttgattgcatattctcttagattttcaatttcttcgtctgtacaatggaggttaatgcctatgggctacggctgatgtggggataaaagaaccaacagggatgcatgggcagggcctggtccatggagcagctggcatcaacaaatggaagctccttcccatcttgtatttgtgtgcactacaaaatccggaatatgtgggtataaaaagtacctttataagagacataattggaaacttttgcaaaaagagtttggaaaggtgtcacatcttgtggcatgaggagttgtgggcatacacttgaactttgtgctgtgagatatccacagaacttcagtagcttaagagaacagtttagatgtcatcttattcatctaccatagaacttcctctttttttctgagatttctagacaataacttttacagctctaataatgcagttctctcccagttgtttggactattctaatagatacaaagcagtatttcaccagcagatgctactgcagtttgtatgatgatttcaaactaagaatccatttaaagttatgcaatacttttttggaaatagagtgaaagtactttaagtttaaaatcctataaaataggtttacagtaaataattatctgttgcaatgtctatcatactatcttatattcacacatgtgttggtgtcctaatacatatgtatgagagtgaaagttacctgaggtcagagactctgccatatgttccctgcaccactgttgcctatctcagcacatgatatacagtagatgctcaataaatactttaacttaaaaaatgcactaagaataaatcttattagacatcaaaatatgtacgagtacaatctagggacatggtcaggggctcaaaattcaatcttatttatttatttacttatttatttgtttatttggagacagagtctcactctgtcacccaggctggagtgcagtggcacgatcttggcttactgcaaccttcgtctccccggttcaagcgattctcctgcctcattctccagagtagctgggattacaggtgcacaccaacacacctggctatttttttttcgtatttttaatagacagagggtttcaccattttggccaggctggtctcaaactcctgagctcaggcagtctgcccacctttgtctcccaaaatgctgggattacaggtgtcagccaccacacagccacaaaatgttttaaagtagcttcaaaagccctttgcaaataggtgttttcataacaagatgaaaacaagaaaacattgagcttcatataatagaagggttctgcctggatttgcatgtggccccatcatttgtttgctgttgggccatggtcaggttacttagctgctctctgcctccacataggctttatgcctgtgcatccttcatctacaaaatgggaataataagaacatctaacaattagaagtggagaaaatatatgtaaaggtctttgaaaagagcttgtcaaagctcaataattgtcagctatcattcaataataatcataatcataaaaatatatgactcaaagaaagattgctacctcatatccagcttccccaaagaatatcagacattggacctgtgaaaggaatgacattgagatgtattttcacatcgctaagttggttttttctctttgccattcaatttctgcagtccccactctaagtccatggtccacctttttatttttcctcctaaaatgtcttcacttcttgtaaaatttacttttccttaaaaagggcccttttcatcctctcactcttttgcccttcccagaagttggttaatgggcccaaaaatacagttagatggaaagaacagaagaatttctagtgttcaatagcacagtagggtgatgatcattaacaataacttatatatttcaaaatgactagaggaaagatgtggaatgttctcaacacaaataaatgataaatgtttgaggtgatggatatgcaaattatcctgatttgatcactacatattgtatgcatgtatcaaaatatcacatgtaccctagaaatatgtatcattgtcatgtatcaataaaaacagaaaggcctatttctctttccttcctccccgcattccctgctgccccagatatgtgttgttcctggtgctctcctaccccacgttcagtcagcactgagccagcaggaaggatctcacagatcatatcctgagatcaaccctttcaggtaataatcctcctgcttttagtcatttatatcctttggttcgtatatattttgagtcaaatgccttctaactactgacttacataatatcccttggtttttaaagataatacaaagtggattttagtaacaatcttgagtcgtcacagaagctaatgaagttggggatgccatgaagccatccaagcatatagagcccatttccctgggtcccttttccttagctcaaggccacaaaaaatcagaacttgaattccagcccacatttgcattatgtctaaataactatgagttataaatgaagctaacagttaaatatattctattctcctacttcgataaatataccgccataattacccacaacgtcaaagtcgagtgtagaattctctgatttcttggtgctctgcacgggaatgtggtagtaaagggagagctgatcctcagccccaagctaaacttttttctttcatcgtagctagccctgtactctcttgagaagccttgtgtacccctgtatgggggactccctaggccccatgcaagctccatccacaattctcaccccttcagacagcagagccttgggcaccatttggacaagcacagtttgcgctttgaaatggacccagagaagaggccatgcaggctcagacacatttggccaggagcctgagtccccagtgtgtgccctagaagagagggtgagagctctgggtgggccagggtacagtcagtggagggccagagaggcaccttctcaagcgcaggattcagggcaggagtcctcttgcccagatggaaggctatgactgcttagtgcaatggcgcctgcgtcatgtcttctcagttcacctttcattcagtctctgccaccgtgggaagttccatggaagcgcaggcttcccttgtgctgccagccaactcaaactacactttctgccttagggcatctccattattgtaggatttttcctgagcacaaatacagcccagaaacacttgcaggttaacagcctcaggggaagacctcaaccagtgtgggacaggtgggcaaatgctccaggctcatgtttcaggtggacagttctggataactttctggagcctctcagaaggtcctgcagaaaaaactgcatggcaggagcctcaatagcaagccattattttgacttttctttcttgcctgtctcactcttcccacttctgactcctgcttcttggaatcacttcccaaataaaccacccacacccaagtccttactccagctctgcttttagggatacagacacaccttggagatattacacgttctaggtaaccacaatagggcgaatatcacaacagtgcaagtcacacgaaattttttgcaagtcacacaaaattttttgctttctggtgcatataaaagttatgttgccaggcatggcggctcatgcctgtaatcccagcacattgggaggccgaggtgtgtgcatcacctgaggtcagaagttcgagaccagcctgaccaacatggtgaaaccctgtgcctaccataaatacaaaaatggtggtgcgtgcctgtagtcccagctactcaggaggctgaggcaggagaattgtttgaacctgggaggcagagtttgcagtgagccaagattgcaccactgcactccgacctgggaaacagagccagacaccgtctcaaaaaaaagttatgtttaaactactgtagtcaattaagtgtgcaatagcattatgtctaaaatacaatgtatataccttactttgaaaatatgtgattgccaaaaaatgctaaccatcatctgggccttcagcaagtcatcattttgctgctggatggtcttgcctcaatgttgatagctactgactgatcggggtggtggttgctgagggctggagagggagtggcgatttcttaaaataagatgacaatgaagtttgcgcattgactgactctttctttcacaaaagatttcactgtagcatgctatgcagtttggtagcattttacccacagtagaatttatatcaaaattgcaaccaatcctctcaaaccctgccactcctctatcaactaagtttatggaatattctaagtcctttgttgttctttccacaatgttcacagcatcttcaccaggagtagattccatcccaagaaaccaatttctttgctcattcataacaagcaataataatacattattttatacataatatatataattatataatatacatattatatatttattatattatatattataatatatataatatgctataatatataatatgtaatataatataagcaaaaataatatcgcttggtttttaaagataatacaaagtggattttagtaacaatcttgagtcatcatagaagctaaagaatttggggattccatgaagccatccaagcatataaagcctattcccctgggtcgcttttccttagctcaaggccacaaaaaatcagaacaagaattccagcccacatttgcattatgtccaaataattatgagttataaatgaagctaacaaatagttaaatatgttctattctcctacttcaataaatatactgccataataacccacaaggccaaagtcgagtgtagaattctgattccttggtgctctgcacaggaatgtggtagtaaagggagagccgatcctgagccccaggctaaacttttttccatctaattccatttatttccattaagattgcagcaattcggccaggcacggtggttcatgcctgtaatcccaggctgaggcggacggatcatctgaggttgggagttcaagaccagactaaccaacatggtgaaacaccatgtctactaaaaatagagaattagccagatgtggtggcacatgcctataatgccagctactcaggaggctgagacaggagaatcacttgaacccaggaggcggaggttgtggtgagctgagatcatgccattgcactccagcctgggcaacaagagcaaaactccatctcaaaaaaaaaaaaaaaaaaaagattgcagcagttcactcacatcttcaggctccacttgtaattctagttctcttgctatcttcaccacaactgtggttacttcctctgctaaggtcttgaacccctcaaagtcatttatgagggtcagaatcaacttcttacaaactcctattaatgctgctatttttacctcctctggtgaatcataaatgttcttagtggcatctaccatagtgaatcctttccagaaggtttccaattgactttgcccagatccatcaaaggaatcatgacctatggcagtaacagccttataaaatatatttctcaaataataagacttgaaagtcaaaatgatgcctcaatccattgactacagaatagatgttgtgttggcaggcatgaaaccagcatgcgtttccctgtacatctccattagagctctttagtcaccaggtacattgtcaaaaagctgaagtatttgaaatgaatcttttttctgagctgtaggtctcaacagtgggattaaaatactcagtaacccatgtggtaaacagctctgatatcatccaagtgttgttgttccatttatagagcacaggtagagtagatttagcgtaattcttaagaggtgtcctaggatttatggaatggcaaataagcattggcttgtaacaagaaagtcagcctgtcctttaaatcttttttatttttcttgagataatgtctcactccattgcccaggctggattgcagtggcatgatcttggcccactccagacttgacctccttggctccacaatcctcccgcctcagcctcctgagtagctgggactagtagcatgcaccaccatacatggcttatttttatttatttattttgttagagacagggttcaccatgttgcccaggctggtctcaaactcctaagctcaagccattctcccacttcagcctcccagagtgctgggattacaggcatgatccaccctgcatggcctctaaattcgtgttatggagactcattttcatggttaaaatatcctgaattgactgtggcctgttgggaggtgggatggagggagctacttaaggaaaatgaaaaagaaagggaagcacaccagaagcaagaaagtgtcatcaatttttacatcaaggactccatgataaagagaaagtacaggtggcctgttatcatggctgaccattggactgtggactgcacctgcatctaccaggttcttctggataatcccagttttaaatttttgacctgatattcatgaacacagtgctactggtcagacctttgtccaggtttaagcttcagaacataatgtcttcatgcagtgggaggcctggttagggttatgattctgccctgggacatctgccccttctgacctggaggtaaatttgtcatctactatttacctccacacttgaacagccaatgatgggctgagcacagaggctcacatctgtaactctagcactttgggaagccaaggcaggaggatcgcttgaggccagtagttcaagaccagcatgggtaatatagtgagacctggtctctgtaaaaacaaacaaacaaacaaaaccaaggatggtgggtggcagggagcagttcaacatgggaaaccattaacctgagagctagaaggacccttaggccagcccccattaatagatgagactctgccctgagattatagtccaaggtaatgcattgagcttttctagaaatttgaaaataatcaatcctaaaacccccaagcatactgctattgtttgctattgaataatgttttctagtctgggtgtggtggcacctgcctgtaatcccaacactttggaagatccaggcaagtggatcacctgaggtcaggagttcgagatcagcctggccaacatggtgaatccccgtctctacaaaattacaaaaaattagcaagccatggtggtgcatgctggtaatcccagcttcttgggaggctgaggcaggagaatcctttgaacctgggaggcagaggttgcagtgagatgagatcatgccattgcactccagcctggactacagagacaaattccatctcaaaaataataataataatgttttctacaagcaaggggttactttatactgggaactggtgtgaagggattcaccatgtgtaagcttttggattgatgacagttatttctagatcatggaggtgggaatgcttgttgatcatcttctatgttctttgttatattgattgattttttaaattagcatttttataacaataaagtcataaaaacaagtaactaaaataaagtaaaataatctaaaaaggccaagcatggtggctcatgactgtaatccaagcactttgggaggctgaggtgggtggatcacctgaggtcaggagtttgagaccagcctggccaacatggtgaaacctcatctctactgaaaatacaaaaactagccgggtgtggtggcaggcacctgtaatcccagctactcgggaggttgaggcaggagaatcacttgaacccaggagaagctgcttgcagtgagctgagattgcaccattgcactccagcctgggtgacaagagctaaactctgtctcaaaacaaaacaaaacaaaacaaaaatctaaatgtaattgagttgaatatttaaacttttaactgacatttcaaattagattctaattccatttaaaagagcatctcatagaagcaaatgtactcaattatattaactctgtggtttcatttaagcaatttgttttgtgaagggacacaaatccaaccagattttaacagtgtataaatatgtatttattaatttaattacaatgacaatactctcaactccccatttgaataaaggagagcgtgtgatctgtgttctgagacagtgtgcactataggtgtgtggaaataccgatgccctcagctgtgtggtaggctcagtgggacctggagtgcaggagcccctgggccattcacctctggccacaaaagtcattgctcatttacacccaacttctatagaaatattattttcagtggttgttatgatgcaaaagaaaagaagcagggagatttattaaactgttacatataagttatgttagtaaataaagtctactttcttctggcttaactaaaaatctatactagtatttatgtcttttggaaattagagatgccaatttaagtattatgaagcaaagcaactgattattaggtaagacagccaagtacaactgcagaattgtagaggttatgggttacatgtataagaatatttcatagcaaaaatcttttaagactctgtgaagacactccacagtgaagcagaaattagaacagaattaataatactgtgtatgctctcagttcaccaatttatcaaaactagctttatgattcagaagggtgtctgcacttttgcaattggaagaaaagaaagaatattttattttttgactctttagattttcttcactaacagtatttccaaggctaagtaagggagttgcaagtaacaccaagagaaaaaagcagtcttgagcagctttttaaaaatagtcttaaaatatggaaaatgaagccaggtgtggtggctcactcttgtgatcccaacactttgggagcctgaagtgggagggttgcttgaggacaaaagtttgagacaagcctgggtagcatagcaagatccccatcattgcaaaaaataataattttaaaaaaaattatctggatgtggtggtgcatgccttagagtcccagttacttgggaggatgaggtaggaggagctcttgagcctaggagttcaagtctgcagtgagctatgattgcaccacagtcctcaagcctgggcaacaaagtgagactctctctctctctctctctctttatatatatttatatatatataatatgtggaacccatatatatatggaaaagggaaggggccaagaatatcaaagacattattgaagaagaggaaagattcgtcctgccaaatatcagaacttttataaagctacaacaattaagacagtgtggtcttcactgataaactgactaatgaaacagaatagagagctcccaagcaaatctccacaaatttaatcttcgatatgtgatgtaggtgacatggcagatcagcaaggaaagaaaggacttttcaataaataggatagaaaaataatggttattgatgtaggaaacaaaatgaaattatattcctacttcactctatatacaaacattaaattccagatggacagaagacttacatgtcagaaacaaaactttaaaacttttagtagaaaatgtaagtgaatgagacacaaaaagccacttaacaattaaaaaagattagacattttgactatcacaaaattaagaactttttacatcaaaattggaaagatagtctgggcatggtgtctcaaacctgtaatcccaacagtagatcacctgaggtcaggagtttgaaaccaggctggccaacatggtggaacctcatctctactaaaaatacaagaaattagccaggcattagtggcagacacctgtaatctcagctacttgggaagctgaggcacaagaatcgtctgaacccgggaggtggaggttgcagtgagccactgcactccagcctgaataacagagtaagactctgtctcaaaaaaaaaaaaaaatagaaattaaaaaataaaagtaaaaaagtgaaaagataaactataaattagaagaagttatttgcagtacctaaaacctacaaaaggttaatatcatatcaactaagtgctcatatgaattatttttgaataaggagctcctatgaattaattttaaaaatagcaaaccaacagaaaattgggaaaaggcattaatagggatttcacaaaagagaaagcccacaaaatataaaaattttctcaacctcattagtaatcagaaaaatgcccaagatactacacatctattctctccacaaatattgagaagtttgatgataccaaatgtattagtccatattcacactgctgataaagacatacctgagatggggaagaaaaagaggcttaattggtttaagggctccacatggctgaggaagcctcagagttatggtggtggatgaacagcacttcttacatggcagtgacaagagaatatgagaaggaagcaaaataagcaaaaaacccatcagatcttgtgagatttattcactatcacaagaatagcatgggaaagactggccccaaagattcaactacctccccctgggtccctccccgaacacatgggcatcctgagcaatacaattcaagttgagacttgggtagggacatagccaaaccatattattctgcccctggcccctccaaatctcatgtcctcacatttcaaaacctatcatgccttcccaacagtcccccaaagtcttaactcatttcagcattaacccaaatgtctgctgtccaaagtctcatctgaaacaaggcaagtctcttctgcttatgaccctgtaaaatccaaatcaagctagttacttcctagatacaatgggggtacagatagttgagaaaatacagctgttccaaatgggagtaattgtccaaaacaaaggggttacaggccctgtgcaagcccaaaatccagcaaggtagttaaattttaaagctccaaaatgatctcctttgactccatgtttcacatcaaggtcatgctgatgcaagaggtgggctcccacagccttgggtagttctgcccctgtggctttgcagggtataacccacctcctggctgttttcatgggctgatgtcgagtgtccgcagctttcccaggctcatggtgcaagttgtcagtgaatctacaattctggggtctggaggagtgtggccctctcctcaaagctccacgaggaagtaccccagtagggactctgtgtaggggcttcaaccccacatttcctttctgcacagccctagcagaggttctccatcagagcatcacccctgcagcaaatttttgtttggacatccaggtgttttcatacatcctctgaaatctaggtggaggtttccaaacctcaattcttgacttctatgcatgtgcagactcagcacaacgtggaagctaccaaggcttggtgcttgcactctcaaggccatggcctgagttctatgttggcccctttcagccatggttggaggggctgaaacacagagaaacaaggctctatgctacacacagcacagggaacccggcccagcccagaaaaccattttttcctcctaggcctccaggcttgtgatgggaggggctgctgtgatgacctgtgacatctcctgtagacattttccccattgttttggggattaacattcagcttctcgttacttatgcaaatttctgccaacagctggaatttatcctcagaaaatgggattttcttctctatcacattgtcaggctgcaaattttccaaatttatatgctctgctttctttataaaactgaaggcctttaatatcacccaagtcacctctggaatgctttactgcttagaaatttcttccagcagataccctaaattatcactctcaagttcaaagttccacaaatctctagggcaggggcaaaatgctgccattctctttgctaaaacacaacaagagtcacctttgctccagttcacaacaagttcctcatctccatctgagactacctcagcctggaccttattgttcaaaacactatcagcatttttgtcaaagccattcagcaagtctctaggaggttccaaattttcccacattttccagtcttcttctgagccctccaaactcttccaacctctgcctgttaccaagtttcaaagtcgcttgcacattttttggatgtcttttcagcagcatcccactccactggtaccaatttactgtattagtctgttttcacactgctgaaaaagacatacccaagtctgagaagaaaaagaggtgtaaagaaaaagaactgtaattggatttacagtcccacatggtggaggaggcctcagagtcatggtaggaggtgaaaggcacttcttacatggcagcagcaagagaaaatgaggaggaagccaaagcagaaacccctgataaacccatcagatctcatgaggcttattcactatcacgagactagcacaggaaagactggcctccgtgattcaattacctcaccctgggtccctcccataacatgtgggaattctggagatagaattcaagctgagatttgggtgtggacacagccaaaccatatcaccaaatatggagagactgtggatcaacaagatcatctcaaactaatacaggaggtgagagtttaaattagaacaaccactttggaaagaaatttggattatcttataaatttgagcattctcatatgttatggcaaagtaattcctctaccataggccctggagaaactcttgcccatatgcaccagaagtagtaaaaaaataaatgctcatgtaatgccattcataatagcaaaaatctagaaataagccaaatgttcattaataggagaatgggtaaactgatagaagaatgggtaaataaattatacccttaaaaactaaataatatgtcatttaaggcaatcatatgtatgcaataaaacaatgtttttttaaaggaagggaatcctaaacataaattcagggtagtagttaccctcgggctgaagggtgaaaatcaggaaaaaggacagaggaggagcagatgttagggtcagaaccctagttcttgggttcataagtgattaccatattgttcaaatacatttactcagaggcccaggcacagacaaggatgaaataggagccaaggtatgctatgagccaaggattatgattaatccaattttgtgcactttaagccatttgaaaaacagaaaagcaaaacaacaaaataatttttaagaaattgaatatagggtgttttgctctgaatgtgtccccctaaaattaatcaccaatgtcataggattaggaagtagagcttttaggtagtgattccttcatgaagggagagtcttcacgaatgagtttaggatccttacacaaggattggagggagtgggcttcccctgttttgcccttctgccttctgccatgtgaggacacagtgcatctcctcctgaagacacagtgcagaagataccatcttggatgtagagaccaggccctcaccagacaccaatcctgctggcaccttgatcttggacttctagcttatggaactgtgagaaatacatttctgttcttcagaaattacccagcctagtgtattttttatatagtagcagaaactcattaaggcataatgcctcttgtcattttcttctacaattttctttgctgcctctttagcactggggcattttatatttgatccttcatcatatctcttacttttggtttttcacatttctgttccaagtgtattcttagacacatattttccaatatttgttagcatccaggtcagaaagtccagaataccttcttttaaggcttccgtttctgcaacaatgaagtattaacgcctcctgtaaactaggtatttcctttccaattgtaactgccatctggaggcaaagtagaattctagtctatgagtgtggggttgatttttaatgtatctagagtatggtaaaatgctggtttttaatcacacagatacattgattgcttggcacactagggtaccagttgctagttatctctgtattgatccatgctgttacagagggaaagtacagaccatgaagttggaccagctgtcatacccacaacatttggggagctttgattttttttaacctttagctgcttaactgtcacatctagaagctcaggtgaaaagcacccttattgtggggactttcccttagtgctctgtggcactaaagagcagacctatgtagaagcatttaagtattttgtgcatcaacaggaaaattaaaggaacaaattcttattgtatcctttagtccctgacgacaaaaccacagtgacagtaactaggtcatggcattgtattcagagagggtcagccttggtatttgacagtgagtcccctgtaccccactgtcaagactcactgagcagacgggaaagttcaggtggaacatgcagtaaagagcaaacacggtggggggcgctcactgtcatacactgccatgcctgccatggtcagcagacctgtcttctatttgacaacaggcaagttgagaaacatttttttggagagtttcttgattcttcccagttgtggcaggatggactgacttagaggagctcaggaaggttgttaaacaacacagaaacgcaacatgaattgtactcctcagcaggcctatgttagagcagcaggtccttgaagcctcagccactcctgggacacagcataatgcccctaatgatttcaaatttggtggagagtgggctgctaatcccagtgtccagggacaaaaagagacataaacagcaaaaagttataaaataagtgggcctaacatctgcttattgtgggaggtagggatttaaggtataagaatttagctgcatgtggaagctcacacctgtaatctcagcacttgaggaggtcaacgcaggaggacagcttgagcccaggagtttgacaagagccaggaaacatactaagtccgcattcgttcaaaaatgttttgaagaaaagtagttgagtgtggggacacatgcctgtagtcctaggtacgtgggagcctgagacaagaaaattgcttaagcttgggagattgacactgcaatgagctgtgatcacaacaatgcacgccagcctgtgagtccggagacccgaaccagcacccttaagcagggtccacctccacctgtagaaatcggcccaaggaggtcctgaggaaaggactcccgggagtccggctctggggggcccgaagccccactcccacaacgccccctactacatcccagctcaagcaaacaccgtgactgccacaaaaacccccgaccacacatcgcaaaacctgtttaaaggagccacagccggactttgaagagcaaagcccgactccgcatgggaaatgcaaatgcgcgaggcgccagcccattctccagtcacagtgactccaacagttggctgaggaccactccttaaaccttatcaaagcaagagcactttcggacagtgcgtcggcgttgaggatctagcatgaccaacccagggggtcgaaaaaacagtttcaggacaccacgatacactgagggctaaccaggaagcagaaagaacagacggagtcctgtgaaagaagcgcaacatcccagactcaggcctgcccggacggtgttcgggtgagtctccccagaagtcgtgcccccgagatctcgaggacaggactgccagcgtgcccgggggctattcgctcacacaagtttcgttcccgacgagagcagaacccggcagccacaggggttgcctgggggccagtatttctatgccacccctgtaggactgtgggtgggggtgtccaccgtgactggatgtgtcttctaggaaacgacagtcttgaagaggaagccgggaatgggagatggcaacaatccccgtccctggaacgccggcctctctggacaagccacccgcttcgcacccctcctcttatgcccgtggcggtggcacggcgctgtatcctgcctgggctatggcctctgctctgtcgtccctcttgctctgtctcccctgtttctgagcggcctagatgcctctcggtctggctgaatatcttctacgaagatcacttccccgtccatcagggagacacttcctggagatccgtgtcatgactgtttctctctccaagcctgtttctgctggattgcgcaggtctgatgaccctggggctcttggcttccatacgtgtctcagacagggaagcttcctcggtctccgtgtttcacctcatgggtgggtggattgcctaggatgagcgagcgctaggccggcgagactggccttgtcttctaggacaagtgcatttcccctgcgcttcctgtctcactcttgagggacatcctctcctccgctcacaggtggacagactccctggatcttttggctgtaacgaatgtcaggaaacaaagggactgcgctgggactggggctggggctgcgtgcaggggaggttgcgtcagggctagctgggtggtggagggttgggggtggggtgactgttgcagaaacctctgtggtcctctggcaggcatttcaacatgtggcttggctgaggcacaagccccgtccaggttcccaggtcttctttgtgttcccttggcactcagggaaaggccacttgatcccctttctaccgggcgcatgcctgggcaccactgttgctttcgccctcgccccacatgcctccggtgacatacattcacgccatctgctctggtatacgccagtgccaggcgtgatcgcattgtctccacctgggattcgccccgtccctgtctgcacgtgtcctggaaagcggtgtcggcttgcaggagccccagggcttttagaagcgggccaggccaccgctctttcaaaggaggagggaggcagagggctcacggatcagtgaattttccgctgacagcaggccttgagggccatgggatcattctgtgctgcagcgaggccctgcctgcctcagcagatgtggtgagcccatcctttctcgcccagagtggtccaaaatcgcatctgaagaggagtcctgagaacccagcaggcgccctgaagctccccgtccatcggtggaagtcggctcaaggaggtcctgaagacgggactcctgggggctcggccctgggacacccgtggccccctctcccacgcggccccaaactggaccccggatccagccgcagccgcggctgcagcaggcgcgccccctgccgccgcgcagccgcccgtatttaaaggggacgcagcctgcctgactgccaggagccaagcgcgagtcggcccagccaaagcgcatgcgcgctgcagcgaggccctgcctgcctcagcagatgtggtgagcccatcctttctcgcccagagtggtccaaaatcgcatctgaagaggagtcctgagaacccagcaggcgccctgaagctccccgtccatcggtggaagtcggctcaaggaggtcctgaagacgggactcctgggggctcggccctgggacacccgtggccccctctcccacgcggccccaaactggaccccggatccagccgcagccgcggctgcagcaggcgcgccccctgccgccgcgcagccgcccgtatttaaaggggacgcagcctgcctgactgccaggagccaagcgcgagtcggcccagccaaagcgcatgcgcgagccgcgcgccgctttttgcttcacagtgcttcccacggttgtcttaggaaccagtccccgaggcttggcaacacaggagccctccgtggcagcgcttgggtgtcgggcctccgaggctccggcctgacctctccacggggtccacaggaacgtctccggctgccaggagtcgcaaggggccgagcaggatgaggaaaccacaggcggagtccgggggaagcagcgtggcatcccagcctcaggcctgccaggacggtgttcgggtgagtctcccgagaagtcgtgcccccgtgatctcgaggacaggtccgcctgcgtgcccgagggctgttctctcagccgagggttgttcccctccagagcagaacccggcagccacaggggttgcctgggggcgtgcattgctcggccaccgcggtaggactgtgtgtggggctgtgtctcccattctcccttctctctctgtctctcaccctctgtgtgcttctttccctctgtgtgtgtgtgtgtgtgtgtgtgtctttggacgaatgtgccctgtgcgtcaaaaagggatgtcttttatgtggaccggtctttggtgagcctctttctgcgtctctccctgggtcctgcggccagctgtccatcgtcttcgcggcggttccactttgggtctgtgcaggcctcgataacgtgaggggatgcatcgggcccggagcagtggaagtctcatccccatcctgagcggcctcttttctaggatcgagaggaccacactgcagcccaggacaaaagccccacggtagcacattgtccggcaggagaggagcagacccacgtccaagaagatggttttacctttccacgccccttctctgcgaaatgaagccacaccaccacacagtcttgaagaggaagcctggaatgggagacggcaacaagccccgtccctggaacgctggcctctctggacaagccacccgcttcgcacccctcctcttatgcccgtggcggtggcacggcgctgtatcctgcctgggctatggcctctgctctgtcgtccctcttgctctgtctcccctgtttctgagcggcctagatgcctctcggtctggctgaatatcttctacgaagatcacttccccgtccatcagggagacacttcctggagatccgtgtcatgactgtttctctctccaagcctgtttctgctggattgcgcaggtctgatgaccctggggctcttggcttccatacgtgtctcagacagggaagcttcctcggtctccgtgtttcacctcatgggtgggtggattgcctaggatgagcgagcgctaggccggcgagactggccttgtcttctaggacaagtgcatttcccctgcgcttcctgtctcactcttgagggacatcctctcctccgctcacaggtggacagactccctggatcttttggctgtaacgaatgtcaggaaacaaagggactgcgctgggactggggctggggctgcgtgcaggggaggttgcgtcagggctagctgggtggtggagggttgggggtggggtgactgttgcagaaacctctgtggtcctctggcaggcatttcaacatgtggcttggctgaggcacaagccccgtccaggttcccaggtcttctttgtgttcccttggcactcagggaaaggccacttgatcccctttctaccgggcgcatgcctgggcaccactgttgctttcgccctcgccccacatgcctccggtgacatacattcacgccatctgctctggtatacgccagtgccaggcgtgatcgcattgtctccacctgggattcgccccgtccctgtctgcacgtgtcctggaaagcggtgtcggcttgcaggagccccagggcttttagaagcgggccaggccaccgctctttcaaaggaggagggaggcagagggctcacggatcagtgaattttccgctgacaccagccttgagggccatgggatcattctgtgctgcagcgaggccctgcctgcctcagcagatgtggtgagcccatcctttctcgcccagagtggtccaaaatcgcatctgaagaggagtcctgagaacccagcaggcgccctgaagctccccgtccatcggtggaagtcggctcaaggaggtcctgaagacgggactcctgggggctcggccctgggacacccgtggccccctctcccacgcggccccaaactggaccccggatccagccgcagccgcggctgcagcaggcgcgccccctgccgccgcgcagccgcccgtatttaaaggggacgcagcctgcctgactgccaggagccaagcgcgagtcggcccagccaaagcgcatgcgcgaggcgcgcgccgctttttgcttcacagtgcttcccacggttgtcttaggaaccagtccccgaggcttggcaacgcgggagccctccgtggcagcgcctgggtgtcgggcctccgaggctccggcctgacctctccacggggtccacaggaacgtctccggctgccaggagtcgcaaggggccgagcaggatgaggaaaccacaggcggagtccaggggaagcagcgtggcatcccagcctcaggcctgccaggacggtgttcgggtgagtctcccgagaagtcgtgcccccgtgatctcgaggacaggtccgcctgcgtgcccgagggctgttctctcagccgagggttgttcccctccagagcagaacccggcagccgcaggggttgcctgggggcgtgtatttctcggccaccgcggtaggactgtgtgtggggctgtgtctcccattctcccttctctctctgtctctcaccctctgtgtgcttctttccctctgtgtgtgtgtgtgtgtgtgtgtgtgtgtgtgtgtgtgtgtgtgtgtctttggacgaatgtgccctgtgcgtcaaaaagggatgtcttttatgtggaccggtctttggtgagcctctttctgcgtctctccctgggtcctgcggccagctgtccatcgtcttcgcggcggttgcactttgggtctgtgcaggcctcgataacgtgaggggatgcatcgggcccggagcaatggaagtctcatccccatcctgagcggcctcttttctaggatcgagaggaccacactccagcccaggacaaaagccccacggtagcacattgtccggcaggagaggagcagacccacgtccaagaagatggttttacctttccacgccccttctctgcgaaatgaagccacaccaccacacagtcttgaagaggaagcctggaatgggagacggcaacaagccccatccctggaacgctggccactctggacaagccacccgcttcgcacccctcctcttatgcccgtggcggtggcacggcgctgtatcctgcctgggctatggcctctgctctgtcgtccctcttgctctgtctcccctgtttctgagcggcctagatgcctctcggtctggctgaatatcttctacgaagatcacttcgccgtccatcagggagacacttcctggagatccgtgtcatgactgtttctctctccaagcctgtttctgctggattgcgcaggtctgatgaccctggggctcttggcttccatacgtgtctcagacagggaagcttcctcggtctccgtgtttcacctcatgggtgggtggattgcctaggatgagcgagcgctaggccggcgagactggccttgtcttctaggacaagtgcatttcccctgcgcttcctgtctcactcttgagggacatcctctcctccgctcacaggtggacagactccctggatcttttggctgtaacgaatgtcaggaaacagagggactgcgctgggactggggctggggctgcgtgcagtggaggttgtgtcagggctagctgggtggtggatggttgggggtggggtgactgttgcagaaacccctgttgtcctctggcaggcatttcaaaatgtggcttggactgaggcacaggccccgtccatgttcccaggtcttctttgagttcccttggcactcagggaaaggccagttgatccccctttccaccgggcacattcctggacagcaatgttggtttctcccttgccccatatgcctccggtgacatacattcacgccatctgctctggtatatgccagtgccaggcgtgaccgcattgtcaccacctggcattcgccccgtccctgtctgcacgtgtcctggaaagcggtatcggcttgcaggagccccagggctttcagaagcgggccagttcactgctgtttcaaaggaggagggaggcagagggctcacgattcagtgaattttccactgacagcaggccttgagggccatgggatcattctctgctgcagccaggccctgcctgcctcagcaaatgtggtgagcccctcctttctcacccggagtggtccaaaatggcatctgaagaggagtcctgagaacccagcaggcgccctgaagctccccgtccatcggcggaagttggctcaaggaggtcctgaatacgggattcctgggggctttgcccggggacacccgcggccccttgtcacaggcgccccgaaactgtaccccggatccagccgcagccgcggctgcgcaggcgcgccccctgccgccccgcacctgcggttatttaaagctgacacagcttgcctgagggccaggagcccatgcgagtcgacccagccaatgcgcatgctcgagtggctcgccgcttttcgcgtcatagtggttctcacggttgtcttaggaaccagtcccttggcaacgcgggacccctccgtggcagcgcttgggtgtcgggcctccgaggcttcggcctgacctctccacggggtccacaggaacgtctctggctgccaggagtcgcaaggggctgagcaggatgaggaaaccacaggcggagtccggtggaagcagcgtggcatcccagcctcaggcctgccaggacggtgttcgggtgagtctcccgagaagtcgtgcccccgtgatctcgaggacaggtccgcctgcgtgcccgagggctgttctgtcatcggagggtcgttcccgtcaggagcagaacccggcagccgcaggggttgcctgggggcatgtatttctcggccaccgcggtaggactgtgtgtgggggtgtgtctcccattctcccttctctctctgtctctcaccctctgtgtgcttcttttcctctgtgtgtgtgtgtgtgtgtgtgccagtgtgcgtgtgtgtctttgaacgaatgtgccttgtgcgtcagaaagggatttcttgcttgtctgccggtctttggtgggtttctttctgcgtctctccctgggtcctgtccagctgtccatcgttttcacggcggttccactttgggtttgcgaaatcctcgatcacgtgaggggatgcgtcggccgggagcaatggaagtctcatccccatcatgagcgtcctcttttctaggatcaagaggaccacactccagcccaggacaaatgccccacggtagcacattgtccggcaggagaggagcagacccacgtccaagaagatggttgtacctttccacgcctcttctctgcgaaatgaagccacagaacgacacaatcttgaagaggaagccgtgaatgggagactgcaacaatctgtgtccctggaatgctggcctctctggacaagccacgcacttcgcacccctcctgttatgcccgtggcggtggcacggcgctgtatcctacctgggctctggcctcctctctgtcctccctcttgctctgtctcccctgtttctgagcggcctaggtgcctcttggcctggctgaatatcttctacaaagatcacttcccagtccatcagggactctcttcctggaaatcggtgtcatgactgtttctctctccaaacctgtttctgctgggttggttaggtctggtgaccctggagctcttgtcttccatacgtgtctcagccagggaagcttcctcggtctccatgtttcacctcatttgtgggtggattttctagaattagttgtaggcgacagtgactggtcttgtcttctaggacaggagaggtgccgcatttcttctgcacttcctgtctcatcctttagggacatgctgtcctctgctcctgggtgtactgagtccctgaatcttttggccccctcctgcatcccaggtgttctttgattttccttcgcattgatggaaaggtcacttgtgccccgcttccgccggccacatgcctggacaccattttttgtttcgccatcgccccatacgccctcggtgacacacatttatgccatctgctctgcggtacaccatgccacgtatggtctcattggctccacctcggaatttcccctgtccctgtgttcacgtgtcctggaaagtggtatcagctttcaagtgcaccagggcttttcttttttcaaaggagaagggaggcatcagtgaattttcagctgacacctcgccttggggcccatgggatcattctgggatgcagcgaggccctgccttcctagcagatgtggtgagcccatcctttctcacccggaggggtccaaagtcggatctcaagaggagttctgggaccccagcaggcgcccagaagctccacctccaccccggaagtcggcttaaggaggtcctcaagaccggactcctgggggtttggccttgggacgcctgtggcctcctctcccacgctgccccgtactggacccctgatccagccaccgccagggctgcaatgcgagccgcccttcctctgcgtagccgctattgtttaaaggggtcgcagcctgactgccaggagcggagtgcgactcggcccctccaatgcgcatgcgcaaggccctggcgcatgctccagtcacagttattcccacggttgtcttagaaacccgtccctgaggcttggcaaagtaggagccctccgtggcagtgcttgggtgtcggggctccgaggctccggcctgacctctccacggggtcgacaggaacatctctggctgccaggagtcgcaaagggccgaccaggatgacgaaaccacaggcgaagtccgggggaagcggcatggcatgccagcctcaggcctgccaggacggtgttcgggtgagtctccccagaagtcgtgcccccgtgatctcaaggaccggtctgcttgcatgcctatgggctgctctctcacctgagggtcgttctcatgtggagcagaaccctgctgcctcagaggttgccttggggtgtggtgtgtttctgtgccagtgctgtatgactgtgtgtttttgtttctgtgtgtgtgtgtgtgtgtgtgtgtctcctattctctcctctctctctgtctcttactctttccctctctctgtcggtttgtttgtgtccttgtgcgtgtgtttgtttggacgaatgtgccttgtgcgccaaagaagctatttttgcatgtcgtctggtctttgttgagcctctttctgggtctctgcctgggtcatgtggccggctgtctatcgttttctcggcgtttccactttgggttcgtggagacctcgaccacgtgaggagatgcgtcagtcccggggcaattgaaatctcatccccatcctgagcagcctcttttctaggatcaatatgaccacactccagccaaggacaaaatgctcacaggaggtcatttttctgcaggggtggagccaaccaaagtcaaagaagattgttgtatcttttcacagctcttctctgagaacgaagccacacaacgatagaatcttgaagaagaagctaggaatgggagatggcaacaatccctgtcactggaacactggtctctctggacaagtcaccagtttggcacccctccccttatgcctgtaccgatggcatggtgctatatcctgcctgggctctggcctctgctctgtcctccctcttgctctgtctcccctgtttctgaggggccttgatgtttcttgatctgtctgaatgtcttcaacaaagaccacttcccagtcctccagggcgacacttcctggagatccgtgtcatgattgtttctccctccaaacctgtttctgcttgattagccagggttgatgatcctggggctcttggcttccatacgtatctcagacagggaagctagcttggtctccatgtttcacctcatgggtgagtggattgcctagaatgagcagtaggtgactgtgactggccttgtcttctagggcagggacatgtcgcatttcctctgcacttcctgtctcattcttgagaaacatcctcccctctgctcatgggtggactgactccttgaatcttttggctgtaatgaaagtcagggatccaatgggactgggctggggctggagctggatgcaggggaggttctgtcagggctacctgggcattggaggattgggggtggattgaactttgcataaacctctttactcctccagcaggcttttcaaaatgtggcttggactcatgcaataagaaatttaccggttgaaagggcccctttttcaatggcactctgggtaacatcgcttcagcacaatcatatggtagagaagccttatcaaatttgctgtccctcagggctcttaaagatgcttgataaattattagggaaataagaaacaaattgaaaggaaaaggaaatccaaggacctgccccagaagaatcatagatatgtttgaatacttattcattatttgccccagatagaaaatgtttgttaatcaaaaggcaaaagttataatgaggaagataatattgcctggggcaatgttgagacaaataaggtgaagatcaaccaaacgccctgagtcctttggcccaaatccctgctggggacccaaatacttttgatatagcatcttgctacctgaggaacgcaaggagaataatactcataagcagagcctctgttttcccataggactgactctaactatgtgaagaactgctacatattctacagtgcttaataggcggtgcctatctaacaggagctgtttggcttgtggatagcagttccaagatgaacaaatgacattgtgtttgaaagccactgctcttattaaagaagagtcaagcaaatgtttttattttgagttatttatagtttagaaaaattgggtgaagtgtgtttttgtgagcaaatttatttttctctaggttatccgtaatttgaaagctgtgagtattctgattaggtgacaatatagttatttgcttaagtacatcttttattgtaaaatgggacaaatggagacactggttattttacccaggctttgactagaataacttaattttaggtaaatcccaacaaacccaacttaagaggagtctatatgaccaattaattgtttctgcactttaagcaaatactcaggctgtactagtcccttctcacactgctataaagatattacctgagactgggtaatttataaacaagagaggtttaactgacagttctgcatagccggggaggcctcagaaaacttacagttatgatagaaaggaaagtaggcaccttcttcaaaaggtggcaggagagactgtgtgtgtgtgtgtgtaaaggataaaatgtcaaacacttatacaatcatcagatttcataactcactatcatgaaaacagcatgggtgaaacaactcccatgatacaatcacctcccaccaggagggatgacaatttgaaatgagatttgggtgagcacacagagtcaagccatatcacaagccaaccataataagcctaaaacttatttttcacacaaattgttctcactatgacttctcctacagattgtttcaagggaaaagggtaatgcttgttactaaatgtcagctctggcttttattttattgagtacaaattgaatcataaaatttttttattttattttattttcctttaagttccagaatacatgtgcagaatgtgcaggtttgttaagtaggtatacacgtgccatggtagtttgctatacctattgacccatcctttaagttccctcccctcacccctcaccccccaacaggccctggtgtgtgcttttctgctccctgtgtccatgtgttctcattgttcaacttccacttatgagtgagaacatgtggtgtttggttttctgttcctgttttagtttgctaaggatgatggcttccagcttcatcaatgtccatgcaaagggcatgatctcattccttttatggctgcatagtattccatgatgtatatgtactacattttgtttatccagtctatccttgatgggcatttggactagttccatgactttgctattgtaaatagtgctgcaataaacatatgtgtgcatgtgtctttagagtagaataatttatattattttgggtatatatccagtaatggggctgctgggtcaaatggtatttctggttttagatccttgaggaatcgtcatactgtcttccacaatggttgaactaatttacatgcccaccaacagtgtaaaagcattcctatttctccacagcctggtcagcttctactgtttcttgattttttaataactgccatccgactggtgttagatggtatctcattgtagttttgatttgcatttctcaaataatcagtgatgttgagctttttttatatatttgttggccatgtaaatatcttctttggagaagtgtctgttcatgttctttgctcattttttgattgggttatttgtttttttcttgtgaatttgtttaatttccttgtcaattctggctattagacctttgtcagatgggtagattgcaaaatttttctcccattctgttgtttgcctattcactctgatgatagtttcttttgctgtgcagaagctctttagtttacttagatctcatttgtcaatcttggcttctgttgcagttgcttttggcatttttgtcatgaagtctttgctcatgcctatgtcctgaatggtattgcccaggttttcttctagtgtttttatggtttggggcttgacatttaagtcttatgtttaaggtttaaagtcttaagtttaaggtttaaggaagggttccagtttcagttttctgcatatggccagtgaattttcccagccctatttatcgaataggagattctttcttcattgcttctttttgtcaggtttgttgaagatcatatggatgtagatgtgtggtgttatttctgaggtctttgttctgtttcattagtgtatatgtctgttttggtacaagtaccatgctgtgttggttagtgtagccttgtagtatagtttgaagtagtgtgatgcctccaactttgttctttttgctattccaaacaattgaaaaggagtgacttccccctaactcattttatgaagccagcatcatcatgatagcagaatcaggaagacacacacacacacacacacacacacacacacacacttcaggccaatatccctgatgaacatcgatgcacaaatcctcaataaaatactagcaaaccgaattcagcggcatatcaaaacacttatctaccacaatcaagtcagcttcatccctgggatgcaagactgttccaccatgcacaaataaataaacataatccatcaacataaacagaaccaaagacaaaaaccacgtgattatctcaataggtgcagaaaaggcctttgataaaattccacaccacttcatgttaaaaactctcaataaactaggtattgatggaacatatctcaaaataataagagctatttatgacaaccctacagccaatatcacagtcaatgggcaaaagctgtaagcattgcctttgaaaactggtacaagacaaggaagccctctctcaccacttctattcaacatagtattggaagttctggcaagggcaatcaggcaagaggaagaaataaagggtattcatataggaagagaggaagtcaagttgcctctgattgcagatgatatgctgctatatttagaaaactccataatctcagccccaaaaccccttaaactgataagcaacttcagcaaagtctcatgatataaaatcaatgtccaaaaatcacaagcattcctttacaccaacaatagacaagtagagagacaaataatgaatgaactcccattcacaattgctaaaaaaatgaataaaatacctagaaatacagctaacaagggatgtgaaagacctcttcaaggagaactacaaaccactgctcaaggaaataagaggacatacacaaatggaaaaagattccatccccatggataggaaaaatcaatactataaaaatagccatattgcccaaagtaatttatagattcagtgctattcccatcaaactaccactgacattcttcacaaaattagaaaaatctactttaaatttcatacagaaccaaagaagaccccgtatagccaagatgatcctgagaatcctgaaagttttcatagttataataatcttctaatgagtacaggattatcatttttcttcatattttcagttggtgacctaatgaaatagcgtattttttctcttttgacacacaagtactcttctgatggtcaaaatagtaagttatttatctctccttgtttcacttcaaaggaaaccagaatcatggcattctgaaagttagagatgcaaatctccattatttggcatcccactggacccgatctgtttttcattgcaaatgtcctgctgctaagactatgcaaggaccctccctctaggcccagagactgttgcagaggagatgggtgcatgagattgtaagggctggttatgagggatacagttagctcagacactccaaatcaaggagggtacacaggtgcctaaacagcttgtaaaacaaagaactttgctttctcagctattatgtggcacctttttatccaccccaaccatgaaaaatgtcctgcttcctggaattaaaacaaaataattattaagaggataaagatacctcatgaccaagcctcctgggcataatactcccagttataagttttgcagatatatatatatttagatatataaaattattttttagaaaaatgtatatgttttgtatagttaatcactgtaagtctgtaatgaaaaccaagattatagtagctcaatgcatagaagtgaaagaaaagtcaatttttgtaaactcgccattggctttttgtttttggctctttactttaaatatatcttttaaggggtaatgaatgcctgtccgagtccattcctgtctttcctagaacgcttacttgtctataagtatttgacttcaagtccctccaccatagagagtctcactgaagggcaggatggacacagggcaggcagatatgccacccaagcagtgctaggggaaaaaaaataatagccattgatgctgatgctggcaaatattggccataaatggaagaatgtaagccaaaaataaaattctaagcccttcaaccatctgaatgtacccctcctctcggccataggaattccagattgaaactgaaaatcttgttcaggccatgatggaagagagcattggacatgcctcattatatttctctagcattaacatcaacacagaccttaagacatcaacatcagacctaagagtctgatcagaaatatttaacatctattttctctgaagcctgctacctggaggctttatctgcctgataatatctaggtttctccaactccttatcttaacccagacattcctttctactgataataactctttcaaccaattgccaatcagaaaattttaaaatctacctataacctggaagtccccacttcgagttgtcctgcacttccagactgaaacaatatataccttacatgtattgactgatgtctcatgtctccctaaaatgtgtaaaactaggctgtgccctgaccatcttgtgcacatgttctcagggtctcctgagggctgtgtcatggcccattggtcacttatatttggctcagaataaatctcttcaaatattttagagtttgactctttttgttgaccagtcactccctagtaagtttaggagcagggatctgacagcaaccatatcatgctcagaaacagcattctctcatccactgtccccaggctctgcagaacccagggtcctggtatccataacccaaggaaatgggaaggagtcatgagctcttgggctttctcattctctgaaaatggacaattgataactagccgtgattttgtttagaagtataaataaatgtcacatttctaagcaaaatcaagtctagtttcaaatgtgtgaaaggaaaatagaaacttgggaccccaattcactctgccaaaaggagaaagttaagctgaaagctgagtcatgtgagaagctgactttccttttgctcttaagcacacagctccagatagaaggtaaaatattcccacaggtaggtgctctgtcctcatcttaccttatgtgaagtgctgatttactgagcataagatgaataccaaattgactattcccctgccttatccttttcttttgcaatgtgtggattcagtaatgtgaccatacccttcctctttcccctccagcaaactcttcccctttaagtattgaagcctcagcatcatttttggaaaaaggcacagaccacagattgtttctattattctgtgttttttccttccaacttgtccttaatcttggcaaaataaacttctaaattgattgatacctgtctcagatacttactcgtttatgaatattagaagcagtttgtgttctcgtcgtatgtgttattacagctatccctttttatccaaccttttactatcaagctcaataatctaataaaatcagataactttttaggtgagtccctttctatataaactcttgctattcatactggagctacattcatttggatagtgctctccctcctgagtcaagcttggtgcctgactctccctatccaaatcagaagccaaatagacttggaaggttcaggcagtcagtgtacacagaacacacacgaccttttcgtttagccatcgctagttatctctagtaggtgtaataaggagaaatgtttacttttcaaatacattgctgtggtgttttaatttttacaagcatgtttacataactaatttttataaaatacacctgttgctggatacctcttgttcctatcttgataaccatcaccgagatttgcaaaggaggccttgctcaaatatttggaaactaatgccctcagggagatgtccaccagccttgttcctctcattcctatttaaagattgtaatgtcattgggtctttccctagggtggcccctggttttccaggctggacactcctgtgttgaagatgcatcgactcacgtactgcattaatgttttagattttactgtgaagcaaacaattcactcctcagaccctcagtcacccaagtccacatctggacttgaggtttggcttctctggtcctaactgggacttatctgaccctgacaggagataacttcagtagggactttccctaatagcaaacatgcacacttcaacttggcttgccctgaaggtaacatttactcattataatggtaaaaaaaaaacacacccctgggtggagatttcagacattactaagacgtgtgatatatgtactagcgtgtatgaccatacagcatgtgcacccaggagaccacccaaaacatgtttgctagtaacaccccttcacaacccctttcatgaataatcatataagaccctcataagggagcttccccagtgccgatcaacgctgtttctttttccaagcagcccgctctgacttggcttttagagggtactctctctttaaataaactctgcagctgcttcactgtcactgattacttcttggctgaattctttccttcaagaagacaagaactgaagaccccacaccttccggtaacattaccaactctttctcctttttctctggagctggtgctcagatggtgagagccctgagctaatagtcccagggtgggagcctgtttgcccctgtctggtcctcagcaatgtccttggtcagcttcctggcaagagctgtcgattaccagagggaacaagtgatcagcaccagagtcgatcacttcacagaggagctgaagtggacagggtcagctcaggcctcacggactagggcgggaatgtcccgtgacggcaggtcagtgtcttagcttcctttgaggcacctcttcatagactgcagggatcatttaggtaagaatatagcctgctgacttttacaccttgctgaaaatctttgctaatagcaatctgttagctgtgaaaattaccattgttttttatttttcgttttgttccttattactgaagatattctatggagcgttaaagcctcctgcggtaagaaactagtaaagaaacatactgtttgcaggaaggaaaattacccacaattcttgttctctaaggtgcgtggttatcattccaacagccattctcagcaatgaactgaagaccctcagatgtgtttcattcccttagtattttaatcctctcctccactctcaattgccacttctcccgtgaatgaggggagaggggttgggagggacatctcctgtcttgggcccacagattttaaagttcaagtcagaagctccagtgatttcctgtatgtagtagtcaggggcaagacagatctgtggttggtagtctttccttctctgtacatctgccagcctctctcctcaagctggggcttcatggagtcccagaactttgaacctgaagtagtgtcagcagccatgttgcagctggagtcaggccaattgttggtcttgctccctcgtgactgggacacttggaagagccaaatgggcaggcttggagagcgtgtacttttggaactgaagtgtatcttaaaccatttcattgcaactacgtgtgtgtgttgggaggatgcataacagcctcactgaggggtgactgacatataatagaaggacttgtgcacccgtgaaaccatcactgttatcaagacagcgagcatgtccatcccccataggttttcttgtgctcctttgtgatcccttcctcctgcctctcctgccatgctccaccccaagcaaccactgatctgctttctgtcacaatatatagattggaaaactacttataataccagttctaacctcatcaagcaaatactttctttttgtcagttgaacttttcattgtgtgttcaacattcttgattcagaaagagtgagagagaaaggctggtgtgggcccttcctgggaggcctggccctatccacagctccagtgtggctcacgtgccctggagcccctgcccacaggacagtcctgactgctcatccacaagctttgtggtatcctctaccattcctaggcaggctctgtacagtgcagaactttctcccagtccttgcaccaaaataacaaatgtcagagatagtacatttggagccagtggctgtgcctcacctctagatgcctgtaatactgagctgctaagcaagaggtccctcccttcttgcccttttcttggggcctcatcccttgtgctctgctcttcctcacacaggatatatcttctgattgctcctctcccacctcctgcagtccctggacccccatggcaatacaaacagactcttctatatcctcagtccattgcaggaccacagctctgacctggctgtcctctgttttccaagccctgcacctgtggagttgggaattagcacccacttgaccccattgtggcatcaggcccaccctccccaatgcaggaagagttccagatgttggggagctatggcattatcctgcacacatatcatgtcctggcctgggaaagtgatgatgatgatattttcccacaaaatagacaataacatcatgaaagtgccttgttcattttctagcataaaatatatatcaaagcagtggggtttagtaggcatacgtagatttaaaagctcctcagaaggcagggaatgatttcttcaacagaaaaaaaaactaccccaaaaggagaatctcaatactttggttgatagtaaattaagaatccctcaagaaattcagtaggagagggaaaagataagtcaccaatgggaaatatatttgtcacaatataacaggcaaaggactcatgtccagagtgcatgaaggatttctacaaataaaataaagaatccaacagaaaaatgaagaagagaaaggaataggaacttcatttttaaaaaagagaaaagaaaaaggaagtaaggaaaaacaaatgaacatccaaatggccagaaagcatataaaaatgcccaacctcataaaccatcagacaaatgtgatccacaatgagaagccaatacacaccgaccagcacggctaaaattaagaagactgttaataccaagtgttggtgagaatgtgaagtaactgaaacatttatacactgctggtggaaatgtgaaatagcacaactactttggaaaattatttgggaatactgctaaaggtgagcacccctatgatcctgaaatcccactccaatatgaaaacccaaaagaaatgcatcctgatagaggcactcttcatagtagcccaatgttaatcatggaagaatggacaagtatatatcatatcatggaatttttatggtaatgaaaatagattaataactgccatgcacagttggtgaatcccaccaacataatgttgagtgaaagaaacctgatacaaatgaatgtatactacactatttcatttctgtgaagctccaaaataagcaaaacgaacctatagtgttataagtcagtagagtgattatcttagtatttgcatgggagctctggtaatgttttatttcttgatctaagggctggtgtcccagatgtgttcactttgtgataattcatcaatctgttttcttgggagctgtggcttatctgtgcagatatactccaattaaaaaaatcattcaactcaatgacaacaacaacaaaaaaaactcgattttttaacattttgtggagtgtttattatgatccagtcagcgtactaaatacactattttatttgatccttaaaataacttaaacaacttgatttaaatatgggcaaaggacttgagaagacatttctccaaagaagatatacaaaaagcacatggaaaacccttgacataattagtaatctgggaatgcaaatgtaaaccacggtgggataccacttcacacatgttagaatgactattatccaaaaataaaacaaacagaaaataacaagcattggcaaggatgtggagaaattgaaacccccatgcattgttggtgggaatgtaaaatggtgcagccgctgtggaaaacagtttgatggctcctcagaaaaccatacacagaattaacatatgatccagcattgccactttcaggtatatacccaaaacaatagcatgaaacacataaagagacatgttcatagcagtattattcagaataactaaaaggtggaagccatgttaagtgttcattgacagatgaatggataagcaaaatgtggtatatccatacaatgaaatattattcagcttttaaaaggaaggaaatttgatacatgcaacaacatggatgaatcttcaggacattgcgttcagtgaaataaaccagtcacaaaaagacaaatactacaagattgcaattacatggatacctagaacagtcaaattcatacagacagaaagtagaatggtggttgccatgtcccaaagccaacataaagcagcagttgtggacagcttcagtttcagctgaacttgactgtatgttgtgctgaaaccagggtaatctgatgtccaacactcagagccagttaagacttttgtttctggtgacctggggagctgacagtgcttttcaggcacacctggggtaactcttatttcccaaatgggttggcagattgttgtgggtgccaggtctttgatggactggatctagacacgaataaatagcctgctgggattttgattcggattgtagtcaatctatattgaatctgtgttttaagagtataacctcttaacaatattgagtcttctcactcatgaacaacatatatctccccatttatttatggcttctttaatttatcatagcaatgttttacagttttctgtgtacaggccttttacattttttgtcagatttgttcctaagtactttacattttgcatgctattgtaaatgttgttaatttttttattttaatttcttcattttttacttgacaaatacaaattttatctattcatagtgtacaatatgatattttgcaatatgtatacattttgggatggttaatccaaccaataatatatgcattacattttaattttcaattaagttacaaagctctcattaaacaatttttgtacactaatttgtcctgaaaccttgataaacacacttattaacttcttgtacattccactgaattttctacacagacagtcatgtcgtctgtgaataatgaccatttatgtctttctttccaaactgaatgtcctttatttctgtttcttggctgattgcacagtctacagcctccaatacagtgctggatagaggtggtgagggcaggcatccctagtgtgttcctgatgtgaaggggaaagtattcagtcttccacaatcaagtgtgatgctagctgaaggacttttggaattgccctttatcagcttgaggaagttccctctgttcctaatttgcctcagtttttatcaataatggatgttggattttgcaaaatgttttttctgtattgattatggtgatcatataattttttagtttgtttatgtggtaaattacattgatttatttttttactcttaaatcaaccttgcatttctaggataaataccacttaattatgatgtattacatttctattatatttaggattccatttgctaaacttttgcatagaattcttgccctatgttcatgaggattattggtctgtagttttgttttcttctaatatccttgtctggccagggtatcagggtaatgctgatttcatagattgagttgggaagtatttcctcctcttcagtttttggaagagtttgtgaagtcttgttattacttctcccttaaatgtttggtaaaattcactactatcaccatctgggcctgaatttctttatagggaggtttttatgttattctttttttttttttttgagacagtctccctctgtcacccaggctggagtgcagtggtgtgatctcagctcactgcagcctccacctcctgggttcaagtgattctcttgcctcagcctcccaagtagctggtattccaggctcatgccaccacgcctggctactttttgtatatttggtagacaagaggtttcactgtgttagccaggatggtctccatctcctgacctcatcctgacctcatgatccgcccacctcagcctcccaaattgctgggattacagggatgagccacggagccaggatttttttttttttttgagggagagtctcgctctgttgcccaggctggagtgcagaggtgtgacctcagctcactgcaacctcgggggaacccacccctgataattcaatgtgggtacttttctattttccctaagtgtcagccagtctgagaaataaagggaaagagtacaaaagagagaaattttaaagctgggtttccaagggagacatcacatgtcggcaggttccatgaggccccacaagccgcaaaagcagccagtttttattagtggttttcaaatggggagggagtgtatgaacagggtgtgggtcacagagatcacatgcttcacaaggtaataaaatatcacaaggcaaatggaggcagagtgagatcacaggactggggtgaaattaaaattgttaatgaagtttcgggcacgcattgtcattgataacatcttatcaggagacagggtttgagagcagataaccaggtctgaccaaaatttattaggcgggaatttcctcatcctaataagcctgggagtgctacaggagaccggggcttatttcatcccttatcgacgatcataaaaggcagatgttcacagagcggccatctcagagacctccccctaggaacacactctctttctcagggctgttcttcgctgagaaaaagaattcagtgatatttctcctctttgcttttgaaagaagagaaacatggctctgttccgcctggctctcaggcagccagacctaatggatatctcccttgttccctgaacatcgctgttatcctgttcttttttcaaggtgcccagatttcatattgtttaaacaatttgtgcagttaatgcaatcatcacagggtcatgaggcgacatacatcctcagtttatgaagatgacaggattaggagattaaagtaaagacgggcataggaaatcacaagagtattgattggggaagtgataaatgtccatgaaatcacaatttatgttcagagattgcagtaaagacagacataagaaattataaaagtattaatttggggaactaatacatgtccatgaaatcttcacaatttatgttcttctgccatggcttcagccagtccctccattcagggtccctgacttcctgcaacaccccccatcccaggttcaagcaattttcctgcctcaacctcccaagtctttggggttacaggtgcctgccaccatacctagctaatttttgtatttttagtagagatgaggtttcactatgttggccaagctggtctcgaactcctgacctcaggtgatctgtctgcatcaacctcccaaggtgctggtgctgggattaaaggcataagccactgtgcctagcctatagggaggttttaaaacaacacttttcatcatttctaggccttttacctaagatcaagtgtaaaaaatgaatttgagtttctttaatagatacaggggttttcaagttatccatttcttcttgggtgaactttggtaatttgtctttgaactaatttgtcaattttatccatggtgttgaatttaattggcataaaagtattcctagtattattttactatccctttatatctgtagaatctttagtgatgtcacctctctcataccttctactggtaattctctcttttttccctgatcaatctggctgaaaatgtatcaatgtcattgattttcccaaagaacaagacttgggattcattgattttcctctaacctattttctttcactgattcccactttgatctttattattccatttttctgcttactttggatttaatttgcttttttttcccatctttaagtgaaaactgaagtcactgatttgagtcctctcttcttttctaatataatatttaatgacataaattttcctctaggtactgttttagtgacagcccatatattctatgttgttttctattttcattcactttgaattgctttctaatttccctttagatttctcctttgacctatgggttatttagaagtgtattagatgtcagatatttggggattttcaaggatctttctgtcactgatttctaatttaattctaattcgtcatatgcagtatgttccacagagaacacactgtgtatgatgaatgcttttgaatttattgagacttttaaaaatcagccacaatgtggtctagattcataaatgttccatgtgcacttgggaaaaatctgtattctgctattgtagagcgaagtgttctgcaaatatcaatcaagtcaagttagctgatagtgttgttcaaatctactatattcttttttgtttgtttgtttgtttgtttgtttttgagatggagtctcattctgtagcccagtttagagtgcagcagcacaatctcggctcactgcaacctctgcctcctgggttcaagtaattctccctgcctcagcctcccaagtagctgggattacaagcgcttgccacatgtccagctaatttttgtatttttagtagagatggggttttgccatgttggccagactggtctcgaactcctgacctcaggtaatctgcccacttcggcctcccaaagtactgggattacaggcatgagccactgcacccagcaaaatctactgcattcttactgattttctgcccacttgttctattaattattgagagagagctattaaaatatctgatagttatgcatttttctatttctctttgatgttttattagtttttcttttattcattttgaaggcttattaggtacaaaaacatgaaggattgttatatcttcttcgctgaccacatcgtcagtatgaaataacctttaattcctagaaataattctttgctctgaaatctattttgatattaatatagccactctaaatttcttttgactagttttagcatggtatatctttttccatctttatacttttaacctatttgtgtctttatatttatagtgcctttcttataggcagaatatagttgggtctttgtttttcaatgtaatttgacactctctgccttttagttggggtatttagactatttacctttaatatgattactgatatgattaggttgagccactcaccttgcatatgttctctattcatctcatctgttttttatttcctttttccattttcctttgaattaatcaagtatttttatcataccattttatctcattttatctctcttgttaaacagccacatttctttttttttttttgagatggattctcactctgtcacctaggccagagtgcagtggcatgatctcggctcactgcaagctctgcttcctgggttcacaccattctcctgccttagcctcccaagtagctgagactacaggtgcccgccaccacacctggctaattttttgtatttttagtagagacggagtttcaccgtattagccaggatggtctcgatctcctgacctcatgatccatcctcctcggcctcccaaagtgctgggattacaggcgtgagccactgcacccagcctacaattcttttttgttttaattgtaaaccttaagataatacattttatttgaagtaaggtgctgaagaggtgttatttgtgtagggtgttaaaataatggtaagctatgagaaggggaaaagggcactgaggctaaggagttagtttaaaaaaaaacagaccagtacacatgggaatgtttgtgtagttttgtactggggtggttagatttggcagtcgctgaagctatgtatgtaggcaaagactgaatgagagatgaatctggaatggcaatttcaaattagtcactagaagacctcaaaccatcccctctacaaccccagttctgtagatattgaaagaatggtggacccggggcccactctctctgaacttgactcctcacttccctatgaaagctggctttgctatgtgccctgtgatatacatctgtttgtccccactttccaaaagtatgaatcttgtctctggtttacctccaatgcctagaaaaatatgtggcagaacgcatgcttcagtaaataatcttttaatcactgaatatttcaagaattccacataattctataagacattattaactattgtaaatttttaagtggagaaaaagtactatgttgcctttatttcatgaaagcaaccttaagagttggcatgaacacatctatccatctacttgtgtttgtgctcatatactcatatcccacttactatggatgaatggaatgatctatcatctaaagtcaatatttctttttcctaacttccaatccaaggacattattccagaaatacttccttgtatgtcctacattatcaattttgccctctctgtggatgatttccattggcatgcaaacatgctgttattttttctcttcttatagaacattaaacacaacgatcttgactctacttcctctacaattacttgccttttctccattcctttttttgagtgaagcttcttgaaattgttgcctgtgcttactgcattcaacccctctactttgttctctcagaaatcccttttggtcaagctttctccttatcacttcacccaaaggactcttgtgaggtcatcagggctagccactttactaaatccaatggctgtttatcaggtcccattttatgtcaactttcagcagcatttgataaagttggccaccattttcttgaaataatgttttcctttggctttgtgaacatcatactctcctttactggttgcttttcagtttctttttctggttcctctttacccttctttatttttatttcaataggtttttgtggggaacaggcagtgttttgtatataagttttttagtggcaatatctgagatttttatgcatccatcaccagagcagtgtacactgtacccaatgtgtagtcttttatccctcgaccccctcccaccctttcccccaagtccccaaagtccattgtatcattcttatgcctttgcatcctcatagcttagctcccacttacaagtaacaatatacaatgtttggttttccatttccaagttacttcatttggaataatggtctccaattccatccaggttgctgtaaatgccattatttcgttcctttttagggttaagtagtattccatggcatgtatgttgtgtatatatatatacatatatacatgtatatatatatacatgtatatatgtatatatatatacacgcacatatatacacacatacatacatatacacatatatatcacattttctttattcactcgttgatcgatgagcatttgggctggttccttatttttgcaattgtgaatggtgctgctataaacatgcatgtgcaagtatctttttcatgtaatgatttcttttcctctgggtagataaccagaagtgggattgctggatcaagtggtagatctacttttagttctttaaggaaccccccaccctgttttccatagtggttgtatttgtttacattcccaccaacagtgtaaaagtgttcccttttcaccacatccacaccaacatctattttaattttttgatctttttattatggtcattcttgcaagattaaggttgtatcatgttgtggttttgatgtgcatttccctgataattagcgaggttgagtattttttatatgtttgttggccattagtatatcttcttttgagaattgtctattcatgtccttagcccactttttgatgagattgtttgttttttcctgagcagctacaattctttggcttgttattttagtggttgcttatggatttatagtgcatgtcttccactgatcacagtctaccttcaagtgataatatatcactttagtataagaaacctacatcgtatacttcttccctcctagtctttaagctatgactgtcatccattttattttacatgtcataaattccatagtaatttattatttttgtttaaacaataatattttaaagaggtttaagtaataataacaaatcatatatttgtccatgttgttactatttctggtgctcttcattcctttgtgcagatctagatttcaatatggtatccttcttacttttactgcctaaaagacatcctttaatttttcttgtagtgcaggtctccaggtaagaaagtcttaagtctttacaagtctaaaaatgtatttatttcttcatatccgttattctctttttggtagtatctagttggctgtgacactaatccattaaactttccatttcaattatggtatttttcaaatctagatttctatttggtaatttttcccaatctacttgattattttcatactcatgctctttaatccccttgtttctttacgtgtaagacacactttatgtgatgtttggtgactctaatatcttaagtctctgtaggttttttcctctgtacattgttcctgctggctcttgcacattatacatgtttgtaatttttgaataaaaacttacattccatgaagctgtcttccattttgcttttgccaggcacctggaaggcattaaaaacctgatgtcactttaaatttgcagcttgagactttttaggattatacagcttgtgtgtgaagccaccagtgaaagggctgcccatggttatgtattaatgtatcctcactctcgggcgagatgttttccctcaggatggacaattttgtctactgttccaggggctgcaggggatagaggtggcaggagacaggggaggcagacaggttgattcatagttccctcctacactaaacctatctttttggtgtcctttttttttttttttttttttttgagacggagtcttgctctgtcgcccaggctggagtgcagtggtgcgatctcggctcactgcaagctccgcctcccgggttcacacgccattctcctgcctcagcctcctgagtagctgggactacagacgcccactaccacacttggctaattttttgtatttttagtagagacggggtttcactatgttggccaagatagtctcaatctcttgaggtgtcctactttttgatgtcttctcctaatcctcctaccttggacaggatctaaactttgtctgctattctgctgccctatcatcatcccagactatgaaaagcaagtttcagtatgacacttggcaactatcttaagggtgaaaaatggcatctaattacttctttgggtttctactttcactttttaattttaattttttttgcctttgtgaactcttaattattttgcacctcattgatacatttttttaaaatggttcttgatatgtattccagaaatttttgttgttttctggtccttgtcagcccatgttgccggaaataaaattatttcaacttgttctttaacaatttacagtatccatatattccttcctgttccagaggcaatagagtgagaacacacacttaggagccaagctggcctgagattaagatccaccagcaatgtgacctcaatagcctatttacattctgagcctcagtttttcatagggttggtgtgataattatatgaggtaatatatgaatattacttaaaacagagactggtaaggatggactttcttgttattattatctgaaaaatttgaaaaattatgagcctgagtaacagttatacatcttacccattggttcactaacctctggcccctggctaccccagacccctctaccatgcagtcacccacacccatgcttacactgatggagaggagtcatctatgagctattcactggatgacaggcccagctactgtcacagatgcactccaagtccaggacagaatgctagcagatagctgctggtctgagaaatgtcatcatcatataagcctgagtgaaaacacaacccctttactactaagaaatctaaaaacaaacaaacataaaccaacataattttaaattttgtattttttatgatgtcatttgtcccaacagccatctgacatcaatagtcctgattactaaaaatctcaacacattatagaaatgttcttctcctttttgaaaaccatgtttatttttcccccacaatacagtgctatctgcaaagccttgaactgataacatagctcaggggctaactctatcttagcagagtagcagctgaaaaaagaaagcaattcttaacaaacagggagatcaggaatgctcacttcaaaaacattatttattcagggcaagtgggcaagtggtatttctgatgtgcaaatgaagcttaaacttcagctttaatttataagaattaggaaatgcagattaaatctctgatgccacattgtgaattcagtaaaggttaactaatctacgatgcaaagacaaactttagctatcctacacttattattctggaaatttaatgaaaattaaacaagaagactaacagagtataagaattgtccccccgtcttaacactgctgtttccagcctctgttgcctgaaacactgcagaatacttcagatttttttaaccccaactttttattgagtaaaaccaaagtactaaactaataaatgtgaaaaaggatgttgggcttaaaaagaaaaagcctcaagacatcgagcctcttagatattttaaaagtgaagaccgagaaggaatgcactgttgctaaatagaattataggattatggtcaatttataatcttttcaacatgggatttgaatgttctgatattagatacgatgtacgtactttatttatatagtacctcctgagaagaaaaaaaatcaatattggtttatacagtattttgcatgctattcacgtatgcagtgatgtatacgatatcagagctagaaaatggcttagatacgatttgtattcagcgctgggcgggtccggccccgccaagccccgccccgacaccacccccccccctgccccgcctcatcccgccccctccgacccgccccagccgcaccccttccccctccgccccgccccgtcccctccaccccgccccgctcggcttcgtcacctctgccccgcctcgacccctcccctcctccctgcctcgtcccctccgccccgtcccgccccctgaggcatgcgcggtgctcccggcaggcggggctggctgttggaggaatgtgcgaggatctccgtggccggtgtctgaagtcgtcagtttactgcttgtaatgaacatagtgatcactgggaacctggaagtagagactcctttgcgccgtcccgccgtccctctggctgctgcgaatccccccgccagcctccaggaccccgggctggctcaacgcccccaccggccccgccgccccagggcccgctacgcgcccggcataatgggagaaaaatcaggacggaaaggcccagcccctcgccatgcagacgggaagctcggcctgcacatgtgaggacccttacgccccttggggcttcaccccctttgctggctccaatagtctgggtcggggcctccttgtcctgtgggggcctctgggccacaagaacacaggcccgagccccggcgagctcgcgggcctcccaccagccgtgctcaggctgcacttctgcaccccagccctgcacctgcgggaccacctgggtcacttttccattctgataaagtccccgtacttcgtggctgcaggctcctcaagccccaggtctgtgcagggatgagcaaaacagcagaatatccgcgctacatctttctggagcacccattttactaccagatttggaaggaacaaagttaagtaatttccaggataagtaattaaaattttatgatgaaaaggctggaaactcttctcctggtaataactgtcagacatatctgtgcctgaaatgtcagactttctctgagaaaaaaactgagaacctgtttcccattattttaaataggaaacattatagggcacagcaagtcaatagaaaaaaacctaccaatttcctaattcacagtgtggcagtaggtttaagttgcacgtaagttagcaggtaaaatgcttaaatgttaccacgtggtcacccacatttgatatggttgttaacatgcagttgccttggatgcagtagctttggcttgagaccagcaacatcacacgtgaacctctcctttgtcaacacaccaaagctttttgaagtgaccgtcatgatcctgatggtctaccagttgtttctggaagcaacatgtggcttttccagcaaagtatttagtttaaaatgttgtaatttttgaaagctcaaacattatctctacaaccatcagccgaaaaatttgagacaggttcttgctcttttgcctgaactgcaccatgataggggctccagcgatccacctgcttcagcctccccagaagctgagaccacaggtgtgtgccaccatgcctgttaatttctaaattttttgtagaaattacatctccccacattgccgaggctggtcttgaacttctagactcaagcaattttcctgacttggcctcctaaagtgctggaattacagacgtgagtcaccgaccgcacctagcctgaaaaatgttttgtgagataaatagctgctatacagtttagatattaaaaactaagatgtgttctcccaggaaagtaataattttggatatattctgtgtcacatcctgtatgatgaaatagatggcaaaagaatcccatttaatttaaagatggaagctgtaacttcaagtaaatttggagctgaggagtcctttcgggctatgaccccagaattctggggttctctgtactgatattttgctagtgtccacacacaagcattccttaatgctgtgcgttaaacaaatagaccttctttgaccccagatttctctccatttaccattctgtttctctgctccatgcaactacctcacctcatgtcctctcttgaacccactcctttctagcttttctccagggtactttgctgaaacgacttttatctcagtcatttagctgcatttgacacagatgatacaattaaggagttcctccttgaaactctttcttctggattttaaagaccttccgtcctggattccctctcacctttttcttcatcctcctgctcctcctctaccagatctctagtgatcctctcagaatgatcccacatagtctcatagctttaaataccatccatctgttgataaccactaggcttggggcctcttccctgaggggagcaccaagagtcttccctgactcttttcccttcgcccccaacccccatgcaaccatacagcaagtcctgtggctcttgagtgcaaccagcaacctgattcaccatctccatttccacaaccagtttcagtcatcttcctctcctactggtctactgccaaaaatcctcctactgccaaaaatcctccaacctccctgcatcctatcttgccctcctgcagtccagcctccactcaagcatccagagtgatctcttgaaaatgttaaaacatgatataagcatacccccacccctgtgtaaaccctgccactgtctactcattgcagtagaataaaagttcagacaacctggtgcctgcctcttaagcctcatctcctacccttgcttgttcttgctatgtgggtcagattttccggtctccagagctgaaaacaatcttaactgacaggcattagatcatagactctatctacagcataaggcatggaaggaaaagtctgagagaatgaagggccagaaaagttcatttaaaaaaaataaaaagcacaggaaactggaaacataactaacctgtatgtatatactcaaaagaacatggcagcaaaatgaactctttagaaactgagccaacagacttgcaaatgaatagaaatacctttggtcctactctgaaaacaaaaagaatccttagtgaatatacaagaacaaaaattgtacacatttctgggtcataatgcaataaaactagaaataatcgaaagagaatttaaagatgttcagcttcctgaaaatgtcagattatccttttaaacaaattaatgcctatgtcagggtgcaaatccaaaacacaaataccttgcctataaaaatatattttttcaagcaacagtgtatcaggatgtaaggagagagctcactaactcagaagctcccagagtgaccagatgtgttcatgggaaccggagcactgccctggagtcatttgacatcaccttattacaaacaggaacagccatgatggggaatgctcagatgccagtaataagtcagaggattccctcctgaacgggacctcccagtcctttttggcacagggttccaggtgtgaccacaaatccatgggtgagggctttcaagatcaacctgccctcaggcagtggagtggaaactggaactagcagctacagtggaaaaaaggaatgtcctctcagaatatgtcatctgccccatgcaaagactctggatctcagaagtcctcctggtaaggactcggagccagacaacttcatttcctgtcacctgggctgctctccctctgacagctatggaaattggtgaagcacaggaacgtattggaaatggcaatgatgtgcaatgccaatgtgtggaagtgtacaagttaagtaatattttaaaaacagaacacacagcagtttgcacaatctgatcaaagctctgtcatgtatgtttctaaacaagtttggaagagaatttggaaatggctgaatttttttaataaagctcatgtttttagtttgtttaaatgtaaaagcatacacttagaaacaagttagtacataagaatttttaatcttagctatctggaagcttcaaatacctagaatgaggcatttcccaaaggtctctgtaacttgaattttaccgtagtttgaaaactcttgccaggcatactggctcacacaggtaatcccagcactttgggagattgaggtgggcagattgcttgagctaggagttagagaccagcctgggcaacatggtgaaaccccatctctacaaaaaatttaaaaattagctgggagtggtggcactgccgtttgacacagctactcaggaggctggggtgggaggatccttgagcccgggaggtccaggctgcagtgagccatgattgcatccctgtacttcaacctgggcaacagtgccagaccctgccccctcccccaaaagaaaactattagttcatagtgcagttgatgaaataatgtacatccacaaagaaaggagcaaccataatatgtatataattactcagtattaaaatattgtatatagtattacatatataatattgaatacctataatgaatggggcactgctttaagcactgtatactcattatcccacaagaattccttctcgggtaggtcttagtatattcaatttaaaggctaattagtaagcaatacatagaattgaacaagaagctaaaacatagaaggctctcgaaaatacaatgtggaatgagtaatgcaagttacagagatacatagcacatttatagaaagtgtaaaaacttacaaagttaaacactatattatttagataaacaatatattatttagagatgttattatgtaataaaagtataaaagtcagggaaataatatgttttgtaaagcttcagatgaatgattgtcctagatggggaggcaaatggttacatttccaaagggccaaccatgaagacggcttcaaatgtagtggtgtaggtgatggatacaatgtatttattttacttttatgtgagtctgtgtgtatgtatgtgtgtgagtgtgtgtgcaattttgtatgtataaatatgtagtaatttttttttgagtttgggtgtttctctgtctcccaggctgaagtgcagtggcatgatcacggctcactgcagcctccacctctcaggctcaagtgatgcttccacctcagcctcctgagtacctgggactacaactggtaaatattttgctattatagattcggctatcatgttctgttcagtgcctatttcaatagcctctctgccttaattcaccttcatctgcagtgggacacagtacttcttctctaggctacccatggggtaccccaacagcgttgccaccacatacaatcttcatagagctcttaactgcatccagctttctccaggagctcaggatgccccagaccctcatcgcagacagcattgccctggagcttatggctggagatgatatcaccacagacatccccaacccagccctgtcctgggagcaggattctggcctccctattaggcctcagaaactggctgaccacctggcttcacaaacctgtgtgttttcagggaaaattttgatctctacaaaccatgacatgtagagagggacacacatctgattcagcagtccctgatccgctgatccatggacacatttgcccacaaggaataacctagaatttctctctggtggaggtcaggggcattacatgagctgagtagagcttagtttttaatcactagacataggcaaggtgtttaagttattacgcttccaagcagcatggtcctcactcactcaaggtgagataaatattgctgcaaaggaacaacagctgcattgttggagttttgcttttgaggcgtgtgtgtgtgtgtgtgtgtgtgtgtgcatttgtgtgtgtgtgcgtgagttgatttctttcacaaaatacattttcacatacttccttactccaatctacattgccccttccttttaaataaatttttttgaaaactaataagcctattttatttatttacattttttatttacgtttctttacaaactgtttgctattagtctacagtgaaaagtcaacactttataaaataagattagcatttaaaagcttctcaattctaatactttgaaaggctacacccattttcagaaagtctgggctattcaaaatattttacaaaattctgaaacttcgaaaagctgcaagatttggagacagcaagatgaagtgttttttctaacagccagttttgttcactttattattaaatatgcactttttaaattaacagcttgaattctagaatatatttttgaaaatcactaatgatttttgtaaaaatagaaaatctgttgtacctttatcttaaaattcacttcttatctattttctagatttgatgttttgtcattttaaaggatactagacaagaggatctcaatttggatcactatattgggctcctaatatcctaatataattttaaatcatctcaaacaatgcattattaccatatacatcagcatttcccaaactgtgctataagctatgtatacttttgctatttttgagctaaaatatgcttacaaatatataaaaatataaaaatatatttaggtgttgttatgcaataatgcacttttcaaaaagaaacgatataccagtctcaagaatacccggaagctgcatgaaaattcttgattccttttatatatagtgacagaaaaagatgtaaatctaacaattggttatttttattgtttaaagttttttctataagcacatgtgaattaagtattcattattccatattcctcatgtcaccgacgctgggtgcccacagcactgtttttctaacactgcagctgtgggactgagggtggcagaccagacacctgcactgagccacattcgtcacacagttggaccagccctgagccgggggcagaaacatcctgatgtgaaaagctgtttgctaagtacaatgaccacacgtttcgtctattttgaatacaccatcacaacaaactctacactcttgacagatgagacaggcagatatgatctttgaacacaagtgagaaagacgttcacacagactcccatcctccctcacatgactggaggattaaaatggtggtggggggtggatattcagctcaggggcagattagtgacactctcacagctattttaagatacgaaatatttatatgatcctattccaaaccctaatacataaataatgaactcagaactgtacacaaagggaaacaaaaaaccactctgacagtgtccaggtccctcataaacttcccagaagtcaaggaggtcaaggctggtctcaaactcctaggctcaagcgatctgcccacctgggcctcccaaagctctgggattacaggcataagccaccaaacacagcctagtacgttctttcgatatgtttggaatgaatgtgtttccaaggataaaagcttacaatgacatctttcttacctgtaagatacccgaagagcagagagagggtccccaggctggctaagcatccagaacactgggggagctttaaaaacatagatataaattattgtatttcaccccttacttactgaatcacaatcccagggatggaagcacccagagatctgtctttttagaacttctccagctctccaagtggtgctgacaatcaggcagattgagagccagtgcttcaggcagctcatcccagacctcgggagcaggggagtcacccagagctatgtcagactgaaggttctggtgcatcaggggtggggagggtcttgagagttggcctttccaacaagcttcccagaggggctgctttgctgatcctcaccaggctttgagggtgcacagcactcttcctctaggtgtgtgtccacatacctggcacatttgttgttgcattgccccaggtataaagtgcagggtgccccctctacaccttcagccctgctgtctcccctgctgacccccaaatctctggggcttggacttacctttataaagggagctctcagctcaggggtgggccctccccactggccctcttttcccaaggcccggcatcagcaggagctgctcgagcaattcatcccgaggggtctatgtggtgtgaaaggcttagggagactgttctgtttattgttaagagccaggaaacaaagcctggaaacaaagtctggtattgctcaattcagtggtgataagagacaagggtagggcagggtgcagagaagactcccacacatagcaggaccgagtgagtgccaattcttccttctaacactggcaccaaggagagaccgctgtcccttcccataaaggcagtggacaaatggaagcatcgcttggtgtgccagcttctttggggcaggagaacaataggtgacttgaagcagggttgggagccccatcccaagcacagtggatgctgaagggggtcccaggctccccaggtcctgggcttctcttgattctcagttaagcttgttgattgcatatagttgaatatatataggcgaggaaaagacacaagccaagaactgggggcttcagtcagctctgaaaagtcaggaagagcatttcttttttttttttttttttttttttgtgacagagtgtcgctgtgtcacccaggctggagtgcagtggtgcgatctcagctcactgcaagctctgcctcctgggttctcgccattctcctgcctcagcctcccaagtagctgggactacaggtgcccgccaccacacctggctaattttttgtatttttagtagagacgggatttcaacgtgttagccaggatggtctccatctcctgacttcgtgatctgtccacctcggcctcccaaagtgctgggattacaggtgtgagccaccgtgcccagccaggaagagcatttctaacatccaaatgcaaatgtctgccaccccgggctgctttcctctggaaactgcactgcagggcacagcaggtcccaggtttgcctttcctaattccctgcaccacccagctcccgcctccctcactgtgcgggatgagaggtccacacagacagttccttctcacctttgaaatggcagtggtggctgcagcctgggagctgaggccatcccaagcgggtgagacccccaccaggggccctgggtacctgccggccacaggctgtgccatccaggctgtgcacagccacgcctcagctaccaggatttccttcctgtggaactggaccttccatccagagagtcttgcagcagagagcagaaatgggctttctctctgctggtgtaggaaagccatggcaggaaggcggtaccaacaacacacagctgcctgtcccacgtggggtcctgcacctcctgcctcccagctttcctgcccctttactttgtaagtgtgctctttgattaagtgtcctgtttttaattgtgtccaaatgttcacactgtcttaagtgatgctggagccacagcctggggccactgcaggtccttcctctggagcaaagggtctttgtcacagtgtttctctaaaagcatatccatcctgagtgacacttattttagaaacagatagaattggtgaaaaaagggttgagcattataaaatgtctctggatttcaaagaagttggccaccatctatggggaattggggatgagtaacttctctttaagtaaatgaggacaggacaggcatggtggctcacgcctgtaatcccaacacttcgggaggccgaggagggtggatcacttgaggtcaagagtttgagaacagcccggccaacatggcgaaaccccatctctacaaaaaatacaaaaattagctgggcatggtggtgtgcacctgtaatcccagctactcaggaggctgaggcaggagaattgcttgtacccaggagatggaggttgcagtgagccaaggttatgccactgcactccagcctgggtgacagggcaaaattccatctcaaaaaaaaagtaaatgaagacaaaatcccaaaggctagagccaccacccagagcaggttcaggatcgaagtgcccctgtggttcccctcccacctgaatgctctgttttaaaatgaaggtccaggacaaggggagagcatgtcattactaaggttcagtgttaaatagagacattcttccactgatggcagccattatgggccacctgagctttctttggttttccctgccatctgcatggtcctccactgcacttgaatgaggagtcctgagggtctgagtaagttgcagggattgctgtgctgccaggagtgagtgaaagaagaggccagagcagccacctcagctaaaaagaaagccagaggagagggtgggtatttagggagcggggatttttaatttcaagtgaattctgtaattaaggaaatggggtggtggtggtggggctctgggctgggtgctctggcactgtccctaacagcagtcacagtgatggctttgctcctgtgctgctgtccctcctccctctcagcaataggaagaacatgtgtgcttttgatgcacttggtgcagcaggcctgggatgccgcatttcacacaagcttcaggtgaccccagtgctgctggttcatggaccacgctgtgagtagcaaggtcacaaactcccctgagggaggggagtagctggctgcgtttctgagagaccctattacgattgaactactttgggcctcacttcttgagaactcaaaacagctgctgggtgtgctgaagccatattcaccccaccacaaagaggacagtcagcacctttctccacacaatggtaaaaaggttttgttttcatataaaacctcaacagatgaatggggccactatcaatgattttcagaaagaaaggctcaaataccaactattttttttatggagtcttgctctgtcacccaggctggaatgcagtggcatgatctccactcactgcaacttctgactcccaggttcaagcaatccactcgcttcagcctcccgagtagctgggactacaggtgtgcgccatgcctggctaatttttatacttttagtagagatgggtttcaccatgttggccaggctggtctcgaactgctgaaatgaagtgatccacctgcctctgcctcccaaagtgctgggattacaggtgtgagccaccatacccagcccccaaataccaactattctttaaaaaaaattatgattatgttggaggcacagtggctccttctgtaatttcaatactttggaaggccaaggcaggcaaattgcttgagccctggagttggagaccagcctgggcaacatggtaaaaccctgttcctgcaaaaagtttttaaaaaattagccgggcatagtcgcattcatctatagtcccagctactcaggaagctgaggtgggaggattgcttgagctctggaagtttgaggctgcagtgagctgtgatggcaccactgcactccagcctgggtgacagagtgagaccctgtctcaaaaaaagaaaaaaaaattttatatatatatatgtatgtatattatgttgggagagatgtccctcataattaaactaggttaatacagatgattttatttaatagctgaaatggttctgttacctgggagtttgttttatatttagttgatcttggaggatccatcatgaatcccccctagaagtgcccacagtgacatgttccatgagtgcttgatggaaagccatgtatttctaaggctctggtggcaggtagcagttatgcgatggcatgaggaaaatccatttagtagagttgtccaaaagtgcaatggcctggcttggtaagctgtaaattcagtccctgtgaggggtagaaagtgaggatggagaaggaaggaatatgccaaacaggggttgaacaagacgggcttcttccagctgtcagttttgtgactatgggtactgtccatgtctccaggatccacctgggatgcctctgataatgtaaccacgtacccccatttttcttgggcagtttattccaacaagtgagctatagtgcaggcattgggccatgtggtatctgtttgactttcaagggcttaggtcagcttggtggagttctctgggtccctctagggaatcatccaacccagggatggcctgcagggtcccaccccacccctaaagcacttacattcacacaaaatcctagagctgaatgttctcagcaggcttattcctcatagccaaaagccagaaacaaatccagatgttcttcaaggagcgagtggcaaaacagttggggtcattgtggaaatgaagggaagcctttggagagatgtattggaagaatgaacaggactcagtaatggattgtttatgacgtgggggggttacaggctgaagaaactctttctagagtctggaatggagtccctaggtgagctgtcacaccatttatttagacagtaagtctgggtcacagccaagtccaggaagatgacctagactatagagtgggatcagttctaatctgtaatgtctaagaggtatttcagtctggaaatcagctaggcagctgtacatataattctgagtggagataaaatctggaggttgtaagaatagagttaataattagtgccttaaaaatcaatttggtcacccagagggcttggggttctttttttctggcataccaataaaagaatagcagagttcaggggtgagttatgatgcacttcagattttaaatcccaagcaggggttgtaagcatgctggcaaaccttggggaggagcatccagaaaggcaggatgagaaggagaagcattggcttcaggagccaggagcaagatggaccccagaaacaaaaaggagccacttacctggactgttcctttgacgtggtaaatggaaagtggccattagattttccatcatggaactgtcaaaggacaaaagtacaacagatttagtttaaagatcctaattggctttatttgctattctagaatcaggcaacagttcattccataaaacagactgagcgttcctccgatcagagatggggagatgggctttatggatagaaaaggctgaagcagaaacagagaacaaaacacagattggttgcaaagttactttccttgtaaacattaaagcagaggggagggactgcctatcatgctggctaaacctggcctgttggggatttgcctgttatctctctgtgtcctgacttctcagaaagtcagatcaacaacttcgttttggtttggaaaagtggaactttagcgcaaggaactccaatccagtctggtcttgttactgaaatgaacctgggtctgcttgccccgtgtggtaaaaccaaacacccacactgaggtttgcagcaggagaaaggagggtgttaacttgcaggacaccaagcaaggagaatggggcagcttacacttcagacccaatctcctggatggcttacaagcaagggattttaaaggcaggggaacaattcaggaaagcagaagttacagggaaaccataaatcaatacagagggtatacattgttttggcccaaaaaggtggaagctcttgaagcaaggggcttacaggtcataggcggcttcaggattctttgattgcaattggttaaggaagccaggctttgttgaaaacttggggtcagcagaaaggaatgttaagatgtggcctgtgggcatgactccctccaggcccctgagaaagaaatttacaacaaagagcagccatcagagtgcagccctcagctccccgacatctgaggtctctgtgatgatggtcagtattttccatctgacgtgggtccgggtttctgaaaaaccattcatggacatatgctaagatgtaatctttagtttcaataggggaccaaacaccttgtggctctgacttacttgagtggctgttacttgaagctattattcccttcttgcttatcaggtggctcatttacttctcaaggccagctaggtacctggaatttcccttgaaggaaatcaagattttcctttgtttccatgctggaggaggcccagcaggcctctaataggggtccatgctccgtctcagtctgttgggcctagtgcagaagctcagtccaaactaatggcctcctgtaaatgtattttacagaagtcagcagtgtccacagcaagggagagtttcttgagcaacctgctgggagacctaagagtgaaataaagagtgaatgtcaggtgaaaacattgaaaagatgaggactgacaagtatttacagggggttaactctgaagtggttccaataaactgtgatcttgaaaagcaggtagtggagggaaaaatggcttccccttctaggttctttggctgggctaggaattaaattgacataagacgggctaataggagaataaaaaactttaattacgtctatatgcacaggagtcccacaaaatatggatgaggagaagggccagatgaatgaagcttagatagtgtcctgagttacagaaaggaacaggggcttggggcttgctgaggatgggcacaagttctgggagggtgaggggaggcaatgtctggtgaataaaaggtgtcttgttctgcagagaaaagtctctggggttatagaagttgtctggaaccagccctcttcctgatacagataattcactaatgtagattttttttatagttataaatttcttttacaaaagggcagcttttcagagctactcctgtgtctgcaatttcttagaataacaagatcaaaatttgcctaagaagtatattttgtgttcacatatctggttttgtattgtcatattttggggtggtgtgtcctgagccccaccagcaagggccatgttataggaatataatttttaattgactttttagagttgttttgaattcacagctgaaggggcttagagtataccatcccaaaatatgccactctgacataaagattattttgagctgaagacaactgagaccaagtagacacaggacaaactctctgccctgtccccatctaccagaagggcaggatggctcttaccagcccagaggtggcaccagaaaaatcaacatcacaagcacgccaaatcaaccttatctgtcagcttctgccatatatctaccttcccacaacttgttatccacagaagctcaaggtccccttcctttgtctttccacttctctacaaatacattgctctctcattagggtgctaataagcccaagttctaaccgcctttttgagttattatcactgagctctcccatgtgtatttgcgatgcatgaattaataaatgtgttgttttctcttgttaacctggctttcattggtctaaatttgtggggccaaggcactaaacctaagatgggtggaggaaagattttttctaaacctatacagcaaaattgagctgagcgtgcagagaactctcatatgaacccctcaccggcccacacatgtgcacacacacacacccacacacgcacagcctgccctactgtccatgtcccacatcagtggggcacatttgttactacagctaaacccacaccaacacatcattttcacccaaagtctgtggttcacattagggtcactcttggtgttgtattgtcagtgaaaagagccaaactctgtaaaatatttgaagagatttattctgagccaaatatgagtgacccaaggtatagtctcaagaggccctgagaacatgtgaccaaagcggttgttttacagtttggttttataccttttaaggagacatgagacattaatcagtacatgtgagatgtacattgattcagtccagaaaggtgggacagctcgaagggggtcaatgggaggaaggcttccaggtcataggtggattcaaagattttctgattggcaattgattgaaagagttattatctaaaaacctgcaatcaatagaaaggaatatctgggtcaagataaggggttgtggagaccaaggttcttaccatgtagatgaagtctcatgggggtcacccttagagacaatagatggccaatgtttcctattcagacttttaaaaggtgctagactttcagctaatctctagaggattgggacagcctggaagggaaaagagctagttatggtaatagagattctttacaggtgcaaattttccccacaagagacagctttgcagggccatttcaaaatatgcaaaaaaaaatcctattttggggtaaaatatttttatttccttctttatctgtcatatgatgttatacgagagtcaggtgggaaagtaagctgtgttatatataaggttaaataaagcccatctgttgagatgtcagtttctagggtatgactccccaggccccttagataggaatttgggcaagagagaaaaaatgtcagtttagtcctcagtacattctttgggtttgaacagatgtctaatgccatatccaccactgtcatatcatacagagtagtttcacagtctggcaaatcccctgtgctctgcctgttcatccctctctcccccaacccctgccaaccactgctctttttactgtctccatggttttgccttttccagaatgtgacagagttggaatcttacagtatgcagccttttcagatcagtttctttcagttagtaatatgcatttaaggttctttcatgcagctcaataatgtttggcagagactcaaaggcagggagaggaatgggaaatctgcggtggaaaaggggaagaggagtcctgatggggttgccagccaccagaggcggctgctagtgaagtggcctcattgtctggggtgacacccaatgttcattgtctcacagccacagagatcaagggcatggacacacaaagggtgaggttaagagtggaaatttaatacgtgaaagaaagagaatagctctctgctacagagaggggtcccggaaaaataggtcgctgatgcacagtgcaatgcaaagatttttatagatgagctagtggggagcagtgtctgatctacatcgggtgtgaaaaaacaggaccaggtgtgccatctgcatagggcacgaatctctggacgcccccacaccaatcttctatttattacgcaggtgagtagctactccatgttgcttatttctttcttactgtgcatgtgttaacaacaacaaaaaaaaaaaaaattagggaaggtgaaccccccatggtggacatgcctggccccaggtagtcctttttatcagtgtggctgcaggcctccccccaggcaagcttccagcttccttaactatgtttgcagctccatctttcaggctgctctttgttagaaagaaatgatttcttgggctgttttttgtcagaagttctgccaaggacttttttgccctatctgcctaaataatttatttccatctcctgtatccagtcaggggatcctacctgactggtaagagggtgcctatttggttctccctgttggtcctaggttcgaagcaagggcaaaaaggagggaagccgtcagtgcagtcctgaccattagggttgctgtatgcagtttccagctggttacttcacagactgtgggtcagagtgtcaccaggctctcgggtggattttttaaatcccacggactgaaacccttctttattatctccagtcacttgaacatctttctttgattgacagtttattcagtgttattaaaaaaaaaagctgctactattactactactactactacaattactatttataataatggtaataattatagtaatgatgaatcccagcaaggaccaaataattataattactgatttaatatttatacataaatatttattaaaatatataatctatatattacatatatttataccatgacatttatagtatctacataattacatattatttgtgtatttatgactatttatatttataaattacataataataagaagaatattattactatgactactataagcctcaggactccccccgccccccaccataacagaatatacccctttaaccatccagccacctaatcccacgttgcccccgctggtcgagcttgctatatataaaggcggctgccaactgttgcaagacaactagctaaaaagcctgccgaacagatcgggatcgcgggtgggcaggtaggacgccaggcctcgtccgggtccacctcaggtcacattcccacctcggggcaccctggcaggcatgagtggaaccgtgagatccctggtagccaaaagaagccttggaaaattttggggggagcgccctgggccagggacagctgccgggcaggggacagactccccagcgcctcccgggccagctgcccacccagagtggacttcaaaattcaccggggtcagcctgcctcagcctccccaggggcatgtagaaatttctgcggaccgaaagcccctcctgcgtcctcttcggaactataactgtttatatctaattgctatttatgtagattgattatttataaagtataatttatacttctacaaatttatattatttatattcatatagtttgtaaatgtaaataaattatttgtttataatacttgcttataagaattaccattgctgtataaacctcaggttccaccatccccctgcccctaccctccccttcgcaccttgccacgtccttctcccctcgccttggccccttctcctctcccaaattctagttgcccatctgcttggttgggctgctgatcgatctgatcaactttctgaggccacatcaaaactgcagaaatgaggctgatcgacccagcagctctaacaaagatcatccatcggacatctggtcgcctctctattttggagccagaggctgtacgctcttccccggtggggagggtggggccccaaagtccaaccacaagatcccattttgcaggccgcggctaaatccactgcgccttccccgttttttctcgaactgcccaagccagactccacctccaagacaagactcggaaaaaggtgtgaagctcaagtcggatgaccacgacccacgcgtggccacggacgggcccatgttattcttcgcagtcctcctgtaatggccgggcgggtcctcgcctccagggcggggcttggagataatgggtgtaatggaaggcctgaggacccggccccacgccagtcggagtccgggcggagtaacccatcccccgttcacactctcggaaggcccgtcgattcctgcgtgtactagtcgacccgctcaggccacagcactccgagctcaatagtgcgcctccaacgctgacccgcaggtttaatctccgacgaaaggacgaagagtacacccggcaaagccgggctcatcctgccagtgctgccagtccccttgaactctgcacggcgccctgtggccaaatcccctttcttgccggcttcgccagagcgccggagagaaaaccttaacagtgcagccaggtggcgcccaacagccggcgcaagcagccgcggatcggatcggcatagccagcgggcgaggcctctcctagtccctgaccacctgggatcgcgtttcttggcctgggccgggtggaggagctcccagttggcacggcctggaatgacgcgaccccgcagccgaaggggacttgaaaatttttcctaaccaccgttccgctccgagttactgctacctgctaggacagacctcccacgcggctccgggcctggcgatcttccgcgggaaccgggaacgtttccggagatccccgcaggccggcgccctgcctcggcttcccagtgcagcggggtcgcgggctccccgaggattccaaagttttgcggggcgcctgcggcgggagggaccctgaagttgaaactgtgaaaggcagaacgtgggtgaatcgcttttattctgtcttttcggagtgggaaagcctttctaaagcataaaataaacccagaagccatcaaggaaatgattgatcagcttgacaacataaagtttcacaagcaacgtcaaaagataacaaatgagtgtggggatcgcttatgcataagataagaatattgatttcattcacaatagccaagatacggaagcaagctaagcatctaccagtgggtgaacggaaaaagaaaatgtgatgtatgtacatcagggggtactatcccgcctttgaataaaaggaaatcctgctattggcgacaacgtggatgaacgtggaggccattgtactaagcaaagtaagccaggcacagaaacaaataccacttggtctctcctgtatgtggaatctgaaaatagttgaactcatagaaacggagagtagaactgtggctacctgaggccgggggaagggcaggagggaggagatgttgttcaaagggtacaaggattcagttagacaagaggaatatgttttagggatccacatgacacggtgactgtagttaatgcattttatatgtcaaaatccccaaaatagtaaattttaaatattctcaccacaaaaaataaatgtgttggtgatggatgtcttaattagcttaaagtaattattccaccaatgtatacatatatcaaaacatcacattgtatcccataaatgtatacaattatgatttgtcaattaaaaataaactttaaaaaatctttttaaaaagatttcagcattatttactataataacaaaaaaactggggtgggggtaatagccattgattaagaggggtcaggttaaataaactccagtacatccacaccatacactgtgtgaatttgttttgtttgttttagatgagataaatgttgatgatgaaatgttaaatgaataatttaaaacaagtattaagttacctctatttcaacacattaaatagctagtaaagactgtgtggtgtggacagagggatatgatctacagaaccgaaaagagaccaaaacaaatgcacccagctggtttttgacaagcatgcaaaagcaccttgtggcaggaaaggtagcctttccatcaaatgggagtagggcaattgcacatcacaggcagcaaacaagcaggcaaaccaaaacccttgacctagacactgtcaactttagaatcccaggcccccaccaaatgaatggaccccctcttggccaaggggacctcaggaaaatcttaaaagtttagttctagtctgcctggggtgggaggtcaaacatgcctcattataccccctgccttttggggtttagaccagcattaatgttaacatagagatcagaagactgacagaacagactctgtggcaataaaataccaagttataaacaggacctaaggccatgccaggcaagggttaagtcactaacactacgcctaaagaataaactgtgttccaaggaccacaaggcttttgtttttctctggcagctaaacaaccactggcctcaagatagacaagattaaaacaatttccagctccaccacccactgacttactaaacccctgctctaccagccataacttcctgataagaccaccaactatggattgtctttggctggtttacagaggctgcacacttgtgtgacttcatgccctgaaaagacctgttgacatataggacctaactgtaatacatttaaatgttaagtctccaccccaaagtgaacatggatcatatgctacatgcatgtctgttcaatatgcatgtgctaggaccaccttcatgaatattcatagctcctcctataacctgttgaatatgtatgtttagccaacctgcccagcataaagctcctaccctaacccctcctccttcaaagtgccgtttctggtcccttggctgagatggccaccttaaaggctgtaatccttatgagaaataaagtctcctcatgtttctaaatggataaattgtgggggttttaccctcacacctcatgcaaacattgactccaaatggatcacatatttcaatgtaaaatgtaaaactataaaattttaggaaaaaaaatcttagagaaaattgggatttaggctaaaaaatgagattttatacttgacatcaaaagcatgattcataaatagagatgggtaaattggaagtcatcaaaattaaaaccccaggctctgtgaaaggtccctttttttttttttttttgagaaggagtctggctccatagcccaagctggagtgcagtggtgcagtctcagctcagtgcaacctcctcctcttgggttcaagcaattctcctgcctcagcctcccaagtagctgggactacaggcgtgcgtcaccactcccagctaatttttgtatttttgatatagatggggtttcaccatattggtcaggctggtcttgaactccagaccttgtgttctgcctgccttggcctcctaaagtgctgggattacaggcgtgagccaccacacccagctgaaatgtccttttaagaggaggaaaacaaagtatagatcagaagaatatatttacaaaccatatattctacaggaatgtgtaaaaaaaaaaactcaaaacgcaacggtatttttcttcaaaatccaattacaaaattgatgaaagacatgttaaagtatgccccctgcagaaagacaaaatgactcccaggagactaactgagttgctcaaagttaaaatggaaccaggcggctgtagctgggtgacagagacttcatgtactctgtgttcttagaaagatgttataaaagtatcacaagacctcccttccacaaccaaaccaaaccagttcctgttgtcagtgtcaagataactgtatccggagcaccacttccctggacccctgacagccatttataagaaatttctgacagtcttctgcttaaggcttaaagaacaacaagtcagaactcccctgccctgactaatcaggactcaactgcatcaatcagggttcacctggatcgactaatcaggattcagctacatccaccgatcaggacagcatgagtttcagtccttcatttacataaatgaaagtagttggaaacctggacagaaacttttaccatagagcccaaaccctttcttagttttctagaacttactttccttttacactgaaggctgcaacttccccatttacaaactgttcactgaaataaagtcactttccacattccttttcagaaaacttagctcacagacacgaactagcatttcactgagcaggacgtacagatggcaggtcggcacatgagaagacgttagccttttgtgggagtgtaaattaaaatgacagtgagacgtcatgacacatccatcaaatgccttcaacaagatacaggaacagcatcaaatgcaggtgaggctgtggaggaacgggctttctcacacattgctggtggtaaggtaatattgtactgccactctggaaaacagtgtggcagtttcaaaaaagaaaacagcaacaacaaaaacatgcaagtgaagcgtggcagaatatgccaccccaaaatatgccactttagcataagggttattttgagctaaaggcacttgaaaaacagcagacacaaggaagatgccctgacctcccctttttcttcctgaaagtaggaggtgaatctcccatgggaaaggtgccctccctgtaccaggaggaaggaagcaattcttaccaccagaggcagggagttggggccgaggggaatctgtacaaacaaatctcgttaaactaaccctcatctgcctcattacttctccacgatgaactgccctatcccagactccattgtcttcaggttttcacaacttactctttgtccaacctagtatataagtgttcaggcctaactgcttcttcggatctctttttcctacagggttccattcacatgtgcaaatctgtgtgcttttctcctgttaatgtgttttatgtccacttacctcttaggcccagccagaaacactaacagtagaggtaaagttttgcttcccctgcataaggaccatgtaacccagcaaccaaacccctgggcattcaccccagagacaggggaacttgctgtgcttgaagggttgattcagtgcctctggggccgaggactccccctgacctctgaccctgggctacagcaggaattagaatatttcccagcctgaaactcctctttcctcaacttcagtcaaccagacaccctttgtggatggaaaaatctcattcagtgtttttataacaataacaaataataatggtaatcattacaataatgatgaacaacagcaacaataactattattattattaaccttgggggatgaaagggtagggtacagacctccacaatgctcctggagaatgaccacctactcctgctgggtcccagggtgggctggggtcagagtcccaggtttgcacgtgcaacatgctctgtgaaggcaaggggtgagcagcaggaggaaagggaaattaccctaacagggtgtggcagaccagtgaggaccctgggaggagaaacaggggagggatgtgcagggagagggacccaggtcgggcacccgctgcctggtcagtgagctgccaaagcttcctccacaagtgctggactccttgtccatgcctgcctacccggcccccggccagcaaaccgcgggcaccagctcatggtgcacagaaatatgcactccagatgaatcgcacacctcgatgttaaacgtaaaagagaaaacctcagtagagaatgctaagcgtttgtgtcccctggagaaatgttcttcagtgtggcacagcagaaacccaggtggtcagcagccccatctggtgtggtgccagggaagagcgctgacttgttagagcagcctggagttctgcctgctgcgatccatcacggcggcctctgcatctgcagggtaaggccttcaggtttagcactgcaaacccaggcatttggagtctgttgggccagtatcgctgctcaggtgcagatgggccagctgacttcacctgaattgtagctgccagccttcgtgagaagtgggggcgcttctgggaccggccggctggggcatcgggtgcaccatttctacttgaacacacgtcccccaggcacttggggcccccaacacggaaagcggccatgaggtgctgggcctccctctggctagggggagcaaggagacagcgagtgtggcagccaggactgggcctcagtgctcccagcgggtgggggtgtgacgggtgtagtcaggccaggtctgtggggaaggtttgtaggactggggctgggggctagccttgagtcctgagccacccaccagtggcaaactgcagttttgcagaggttaagcctccggcacctctctaaggcagctaggctgggacaggactggcaacagcagcaccaacacctgtgtgtcctgagcagggggtactgcactcaccggctccaaccagcaacgtcattaacgtttttctccactgtgaggatcatgcaaaccctaccagtttgattccaatgttttttgaaaaacatacttgaacacagagctgggagttttgacaggtaggctttaggagctttgtcaccaccaccaggacacagggatctcccggcaaggtgctcagggacctgtggggcccagaggccagggggctgggagggcctggagtggccagcagggaggctgcagagccatgcctcctcctcccctaatcaccccagcagaccttcctctgagaagcagcagaccagggagggggcatgtgtcattctctgccagtcactttcttctccactccaccacctatgcatttaacacagaaagtgcatgaggccacgctgtctgcagtcagccaccgccactgctccatccaaggactctgcactggaggccagcaggatgccctgggcttcctgcaggggctaagccatgcatgggtcccagtgcagtcaaggccccaaggcagtgagaaaggttcagcctggaggtgggtggttaggcataggtcctcgagagtccctttaaggtctcaatcctagtatcgcgtggggtcccattgctgtggttcaaatttctcagtctttcccttgattttgctggttttgcctctttacagattatttccttttgggttttctctacttctaaagaattttttgttgtaattatttcagacactgcctgagaattgagattttatggttttcaagagttacggttttcaatacatcttcatgttccctcatcctattctcctagaagttggctctgtgctgttagctgcctccacacatgtgcccttcatttgttaggactcaagtgtcacatctgaaatgggggctagcaaggtagatctgcaagacctatcccttggttgaagtagcaagccctggagtggcccagcaggtgctgataagctgacctgtgagagactgaatatacaatgacagtggctagactacataaaaaatcaaactctgagccataatctgcagcaaccagccccaaagccagcccgagatctgcagccacagcccaggaagccagcccgttagaagtcagatgtgcaggaagccagccctctagaagtcagacgtgcaggaagccagcccgctatctccagtcaatccagggagcttaacaccgccctgtaacaatcagcccaagacagtcagaacttgactaataacagcttccctaatttttgtcccggcttccaacttagaaccaaccagaaaaagtgaaatctactgccctaaccgaccacacaggaggccccatttctggtcggccaccccagtttccccaagccaacagcctccactcggagtgcacctggagcctcccctttttccactgtgaacctttcccatcctctgcctgcctggaaatttctaccaaaatgcaactggcgatggctgactcccttgctggggcctttgtgtctctcatttgagtggtctttgcttatctccatgctgcttgctatgctactacggatgggcatttcctgcccatccacgaagatttcacgtgcgtgcctggggtggcagcatacccaggtgcatttctcctgcctcctccttctctctttatcccgcagtcttcctcctcacccagctagccacaggtgtccacatggagcacagtctgaggagagagcagggtcaaacacagccaggttctaggtggagctgaatggggtttgacaggtgccaggtgctcccccagatggatctttacatcataaaaacgattttgtgcttgaagatgtggcttcagatccaccaagcataaagtcaccacctgaaattagaaagaaaacatccaataaataggccttcttcactccagcaaccctctccccatgtgccttctgaagctcctgcagcaagcctgcagatgggttcagaaagtgtttccaagaggagcaccacacagctctaacagacagacagacagacacacacacacacacacacacacacacacaccgagtcaacatgagggtaagaatgaggagagtgatggctgcagtgtctgagagaatttagtctcaaggattaagggaaggctccccaggcgagtgggaaaggtgagcagtgttcggtctctcagaggcgtggatggaagtgtcgtccaggcagaagacaaatgcacaaggcttgaagccggagcaaacagcttccatatgcaggagtgaaaatggcaggcacttctatggcaaatccaagagtgaggcaggagggttcagggcctagcatgccaggccagtgactttgtggaaccagcaaaccaagctaggcaaagtgtggcatgttacttccttataatatttttaattagaatcataatattttctctttaatgcaaagaataaataaattcttaaataatacctagcccaagggccactatccagagacactcaagctgccagaatttttaatgtatctttcaagaaatattttctatataaacagaagcctgagatgtatatgccattttttgtggtctcttccaccaaaacttcctcaaatgtattaagagcacaactcttgaaaacatgttcccactgaaacgtgcacacaaacgttcttagcagcatcattcattatagccaagaagaggaaacaacccaaatgttcactgactgatgaataaacaaaacctgctccatccacacaatgcgacattcacacgtgaggaatgccgcaccgtggtgaacaccagaaacagcaagttcagtgaaagaagcccgtcataaataactccattcatggaagtgtccagaataggcaaattcgtagaaatagaaagtagatgagcggttgcttaggtctggaagggatggggagcatcctgtcaggatgccgaaaatgttctgcaattgactggataatggcttcacggctctgtgaatatgctaccaaccgctgaattgtacacttcagtggtgaattgtttgaaatgcaaatgacgtctcactaaagctcttattaagaaatacatgagttgatggcagatggctatcaggattatgagggtgacatctcaggggaggagctgtgtgtgtggaggtgctagaactgcacaggacatcagccattaaagggtcctctgatctaaaaataggaattgtgatctgagtaattaatgagacactggctgtcctgaatttgcagctagtaaaaaagttgtgagtcaggaacaagcttggtttttccataacaggattttggctgctgtataagagaattggctggaagaagcaccattcacaagcacttactgtcaagaagcaagaagcacaaagcacttatcatcaagtaagaaggacaggactcccagtaagggggtagcagagagatgttggcaactggacagatgcacaatacacttgggaggcgacactgacagaacatgtctctggggacatgcaagaagaattaggtaaaagcataggttatatcagggtatgtcaaaaacagtgacaggagcaaataaataatctaaattgaggaatgctgatttgagaattctcagacatggattactgatggaaaagccaaactctgtaaaatatttgaaagaggtttactgtgagtgaatgagtgaccgtggcctagggaaacagtctcagagggcctgaggaagcgttcccgaagcggtcaggttacagtttggttgtatacattttaaggaggaaagagttctaggcaaagacataagtcaacccacgcatggacggtatacattggtgtgacctgaataggtgggacatcttgaagcaggggtttaaaggtcatagatggattcagagattctctgatttgcagttggttaaaggagtgagctctgtctaaaatttgatgtcaggagaaaggcatgttttaagttaaggatgctatgtagcaaggttgatggcctgcaggcctgaataaacccttgcctggcatggccttaggtcttgtttataatttggtcttttattgacacagaatctgccttgtcagtcttaagatctctaatgttaatgttggagagttgcacctaaactccaaaagggaaggagtgtaacaaggcttgggatccccttggtcaagagggggtctgttcagtcaatgggtgcggcttaggattttatttttagttcataggatggatcagattgtttttcttttgtgattacaaataaggctgaggccaagcatagtggctcatgcctgtaatctcaacactttgagggttgaggtgggaggatcgtgtgagcccaggaattcaagaccagcctgggcaatatagggggacctcgtcgctacaaaaaataaaaaaaataaaaattagctgggcataggagcccactcacgtggtcccagctgctcagaaggctgaagcaggagaatcactggagcccaggatttcaaggctgcagtgagccatcgttgtgccactgcactccagcctaggcaacagagtgagactgtctcaaaaaataataaataaataagcaaataaataaggctgaaatgaacagcctcatccatatcttttcatgaacacccaccaacttttccctccgaatagctttctaaagctttcgaatagcttatttttaagtcatgcaatgacttgacaaattgcgtgttaggaagcctgttacgaatttagactcctgtgctattttgaaatagatatttggtcttcatccccatccccacttcctggcaaaaagctcctaaaacccttggaatctgcagagtactaagagtgtcatttgtgtgctaatgaaatgactggtggctggggaccctagacagcttcaggatgggggctggccaccagaaagacagaggtgggattagggggttgggactttcacctcacttgccaacatctggggagaggagagggactgaaggttgagctgatcaccaattgccaatgatatggtcgatcgatcatgcctctgtaatgccgcctcagtgaaaacccgcaaggacagggtttgaagagctcccagatacctgaatacatggagcctggagggcggtgtgtctggagcaggtgtgggagctctaagccccttcccagatgcctcaccctgtgcacctcttccatctgcctcttcattttcatcctttgaaatatcccttgtaataaatgaataagtgtaagtaaagtgtttccctgagctctgtgagccactgtagcaaattaatcaaacctgaggaggggatactgggaatcctgatttgcagccagttgggcagaagagcaggtcacaacctactacttgtgactgacatctgaagcggggacagtctggtgggactgagcccttaacctgtgaggtctgacactgtccaggtagagagtttcagaatggaattgaattaggagacactcagctgttatctgctgaaggagtggttgatgtggagaagtctctacacattttagtgaccggtgatcagagaaacacaattatcctttggtatcttcaaatggattggtcccaaaactcctcccctggaagggttttggtgatttggacaccaaaattactggctgctcaagtcccttatataggaaagtatagtatttgcatataacctacacacatcctccacatgctttaaatcagatgtgtccaatcttttggttttcctgggccacattggaaggagaattgtcttgggccatacataaaatatactaacactaacaatagctgatgagctttaaaaaatcacacacacaaaaaaatcatatgttttaagaaagtttacgaatttgtgttggagggtaggccacagattggacaagttgctttaaatcacctctagattacttatatctaatacaatgtaaatactatgtaaatagttgttatattgtattgttcagagaataatggcaagaaaaaagtctgtatgtttagtacagacacaatcattctttttttcaaatgtttttgaatcgaggttggctgaatccatggatgcagaacccatggatatgaaggagtgactgtattctgtgtggaatttatgctgaatgggttggcagaacatacatattcaataagctataggaggagcaatgaatatttatgaaaggagaaacgtgaatgtgtcattgagtttcatgactcttcatgggtcatgtgttcatgggagggtgtagtttttagcctctgacatcaaaaggcgaaggaggggccaaaaaccactcactgtgcatcctctgtgagccagccaaaactggtccagaggcagtggtccattttaggaaggatgcactgtgaagctggtgactgtcactccaaaactacaaagaggtagggcgagtccagccacggcctcagatgattggctaaagatgataaaggaaggagtcctgtgtttcttgtttaccagagctggtttctgcttactccttaggaaagagttctggctaaaggttaatatggaagggacatgctgaagtctgtctgaccttgcatcccgtcctggccaggagctcagtttttaagatttctctggggtccctttggccaagagagtgttctatcagtcagttggggaaacttatgatttaaactttattccttgggtcagtttaatagaccttgcaactttaaaataagcattatcaggtctaagaactcagtgtgtgagcaccactcaagcatcacaacctgctgccaagatgctaaatgttgtaagaaaattaataacttaaaggcaaaaactgacctccatgaagatgaaaagtctgatggcactgtaactctagagaaaggagcatgtgtccccattgaggggaaggcagcgtccatttcagggcacactgcaggcatgtcagggtgtttcaggagtctgccaggtgtcctgtcttgtcactcgagactccagcccagggacagacagaaaaccagaagacagcacctcctggccaggatcccagcatccatttgagggagacaagatgagaagggacaatattgttgtagcaaaaataataggttctccacttccttacataggaggaaattcccacaccttgataggaggcagttccccttcctgcccaccttggcacaggcggtcacactccccacctgtatgttgagggactgtgcaagagggcagcactgtctgagttgggacatccacaaccccctgctcctgcccacccttggcttgagtgctggcgacggcaacgtcccctctcagccctggcctgaggtcctccacccttcttcagttctctctctcaggcctccatcatcccacagcttttcttccaatctctcctcttttttctttttgatgacgtttcaaaagagtcagcattttggaagacaactgtagacttgctttcaaatgcagagcatcagagagccatggtctgcccacaggtggcctgcagcagggcagagctgtgcctctgatggccaagggggaggtcacacttgctgcctctgtcctccttaatgctcctgtgacacaattagaacaaagcctgactgccgtgatgaagaagaggtgaactcatgctggtgggtgtcttgtccagagcacgtcagccaccccgtgagttggcagagccaatgggcagacacacaggatgaggttacaggaagatgctctcctgcagcagatccaaggagacagagaccccagcagatggcccgagaagctcccacctgcacctccagcatcaacaggcagacagagaactcctgttagaggggatgaggcaagtctgggacccttagaagactgcaggaagagctgcagatggtgcgaagcaggttcactaatgaccagtccaagggaggcctcccattgcatggagagcagcagagaccatcgctgcccctcccacaaggagtagttggtctggaatatttgctacttacaccttatgaatctcccagttactcgttggtgtgcttttaactaacatgagaagcagggactgggctgtttgttgagtattatgtcttgatattttttagttcagttgtacatgttagtaacaagggtaggggtgcagggtgtcctcatgcatggctgctataaaggtcatgagcaatcaaaaatagaaataactatttccattaattaggatattattgtaggatgaaggtggagaatgtatgctctgaacatgaaaaagagggcttggatcacagctctgccttctgatattttgtttgtttgtttggagcaggtgcttgatcctttaggtagaaagcaagcttagtgaagttaagtgattgtccaaaatcatgctgcttcttaccagttggctagaattcaaacccgagctgacttaaataagagcccaaatttacactggttatgtgggagaggggttgcttttgtttatttctcattactgtgaaaagacatcttatactcagtagaggatatagagtctatttttatactctaaaaattataatgacatgcacatgcatgtaccatcacccactggagacatgcaccggtccacctgcctttgcagctctcatttcacattccagccgcctgctacactcacgtcagcggtgcatagaagaacttcggttatttctcgtgtgagagttcaccttttgcaaaggctgacaggaagtggatgatgaagaactgagttttatgtaaaggagagggagaggtaattgatggatcatggctgagtgcaccgcagggaggaaggatggagggcacgggtggaggggaaggtcatcatggcagagacggggacatctcagatgagatgcccagaggtgtaacaactctgataggaagctgtgctgtgtgccacatgcctctgcaggctgcagaccagtttggatcttactggtctatgtatcaagatatggagtgagcttaccctctccagactgcaattcctgtgagtttctctcttctccttggaatctgagtttgttggttccagagtagctttccagctggggatctggggtgagatttcaccagccaaaggctgttggaaggcaaatcaggatgttgggtatgggctgggctaactgcagggctggactgagcactggaccctcagggtgtcacccctggggcagggtgggctttgggaagaacacagccctggcaggtgcccacctctgcctagtttgtgctggttgctatgggagtgaaggggccgccaagtggtagctccaggtggggctggccctccaaattccaggcctataatttatctggcacatataacccctcatttgaggcttaatttgtttccaaagccttgagtttgagagatcttacaaaacttttattttattgtcatcatattgtgacaagtgaagacatactccaacaaaaaattgaggataaactccagtttgatgagtttttcctccttttggtgtgttgatatcaaggacgctgttagacataaggattaatatcaggtctgcttttcagacactgacgcagccaggagaagggggacatggcctccacagagttgcaggtggagcttgccttgcagcaaggaatcccaggccaaactaagcagggcaagcagcaccattgagtgtcccactgcgtgattggtttcatgtgttgaagaatctacagcctggaaaacaagtggcagaaatctgaatggcagcatggtcacagacactggctggctgaggacttcgagactgttgtggtactttctcaaggcttctgttcccttactcatcaattagagttgacaatggacactgatccctgtctctcctgtggattcactgctacctggagtcaggagaagggagcgggaagcagtcaaatcctttagggccttagttcttgtggaccaacatgttaacaagtgcagctgtcccaagctctttgttactgtggtaggcagagcaatgcccctcaaaagctgttcccatcccaggccatgaaaccagcgaccatgttacatatgtggcaatgaggatatgcccctgcattgaggtgcggctctggagatgtcctgtatttcacaggtgggcccaagatgatcacaaagttcctaaccagggaggcaggagggccaggtcatagaaagagaggtgggcgtggaagcagaggttggagtgatgtggctgtgagctggagaatgtggacagcttctagaagctgagatggtgaggaacagtctccccaggagcccccagaaaggagcacagccctgcagacaatgtgactttagccagacagacccatttgggatttctcgcctccagaaatgtagcacaaacatgtgtggttttaagccagtttgtggtattcagccacagcagcaatgagaaacagacataacttccgtgtgattccttgacaggccacgtggctcaggactcctgactccttcctggctttgcttgcttgactgcaagacacagtagggctagacacctgctgcggtctgagtgtggcccccaaaagcatgtgttggaaacttggtccccagtgcaacagcattaagaggtgggaccttttattttttaaaataaaaaggttccatgaggaagagctgaagtaggtggaatctttaagaagacgtgattaggccattaaaactctaccctcgtgaatggatcaatgcccttatctcgggagtgggttagttatcatggtagtgagtacctctctctctctcgctctctctctctctctctcttctctccctccccctctctttgaccttccaccacgggatgatgcagcaagaaagccttcccttaccagatgtcagcatcttaatactggacctacaggtctcaagaactgtgagacataaatttctttataaattaccccatcagtgtggtactctgttgtagtaatacaaaatggactagacaacacataatgttttataaataaattgtatttgtgggatgcttttgtctttctaatctctccaacaaaagacaacttttgcaggcccacttctgtttgcaggccctctgaaaagccatctcaaaatatgccaaagtatcctttttctttttttccagagtccttttttccaatgcaccaaagtatattttgagataaaatatctttggttttctccgctccccactttgaaacttcaaatgtttcacatataaaaaggcaagttgatccctttggagagatttaggttagagtttgttaaataagagacaggcaaagaagagaaatgacaaatttgaatgagcagaaaagaacaaatttaaatattttgtctcagatcttgggacatttctatggaaacagaagaaaaacaaaggttaatgtctggaatagtgtatggactagtttttccagagtcgctgaagcatcttcaaattgtagtggtaatctgacagatttttctgggtattagttggaatcaggtgttccagcaaactttctgagtagtctatacatcaacaggtacaaaggctgtttacatgtaaagttgctacagtgatttctcctaaagtttatatcaagttttctagcatcaatttgcagggctttaagaaaagcacagtttttttatttctagtgattccaagtcagaaaaatgtgagaaaatgtgagaacattagcttggagacttgtagccagaaaagaattcagaattcagtcccagttgtagacaaataataaaaactgaaaaacaatggacagggctagagtagaatagtgggtatactatagttttcttctgaaacataacttttctctccccagttccccatttctaacaaagacaaatcacaataggaccaatttatttgcaaaataagttttcattttgttataattggcctgattgtttgaataaagtacagaaaaggtggtgattggccattcttttaagttggccttgctggaactttttcataaggaatttcagattagacttttaaaatcctctaaagtctaggaaaccaagccaagtgtttgccatcagactgtgcctgtaatgcctgtagaaattcggtgaattcctctcctcttgaggtcccaatatatcttgaggttcttgggcccttcagaaagtgacattctatacttactccaaggtacagaaccttgtaagggaactgtgtagacaagatacctggccagtctttctgcaaggatttttattagatctataaaatcaactttagttctgctgaataggctcatcatatctgaaaatatgccattcttgtcaaaaccttggtaaaataaccagtgtctcaattttgtcctgttatttaaaaaaaaaaaccaattctcactgagcttatgcaaagaactatattgacataaattaaaaatacttacaaataatttccaaattctagagaaatctgatagagagataaatgtttcaattttgttcaattgttaaaagctatagatggcttaagagaaaaaagttttcttgattctggaaatcaaagcatagaaagaatccacaatgattcaaaccaaagagtcaaaaaaaagttttcagtcctctatcagttcagtcccatgtaattaactcttgttctgcttgatattgggttagcaatcttcaggaacccatcaccttttcttatcagagttctggaagtttttgcctattccaacggtatgatatccaaacttaccataaatctgtatccaagagtacttgtcaaggactttttggtaaatttccttaaagaagaagcaagctttcgactatagtaaatcataaactgctttctgagaagagtcaaagtagaacaaaaattatctgtggatgacaaaagacttaaaataaccagggttagagaaacaattgacaaggaaatttggttatttatgtgacattcagcaatttaatataataatcataattattactgataacacatatgaagacatatcagaattttagtaaccccattccatttaggaacacatattaataacacatttttataactacaactcaaagacatttaaatacaatttttttatgtggccagtctttccatatgatttttgcataccaaataagactaatatgtccctcttggacttccaggagttcttcatgaaaatacttacttttataatttgaaattagatttttggaagttttccaaatatcaacagtttaaaacacttgataaaaaaaacaggatgaatcacaagcaactataaagtaatggtcattcattagtgatgattaccccaagtgataaagattttaaaaaccaaaaacttttactccttgatagaaaggagactctgtttcccaaataatcaaaagacctaatgaagacagcatgaagcaaacaaaatccatctctcccctcttttttgtgcagtttacttacaaggaaaacaaaaatcatttgctatctcttattaatactacatgaaaatagtgtttaaaagagaaaaccaaattctacctttgcaacagtgtattaatgctaaagctaattttaataaaatcttataaacagatcccttcaatctcagttttgatcacataaaataagattttcataaaccttttataacttcttgcattttttctatttttttccccagctgtccattcagttgtatgactttaaaacacctaacagagagaataaaaatctacctaattagacccaggcaaaaaatgtctaaattaaattctgaagatgtttctgttttatttacttttctttttatttatttatttatttttagagacagggcctcattttgttacccaggcttgagtacagtggtgcaatcatagctcactgcagcctccaactcctgggttgtagctgagatgacaggcatgcaccaccacaaccagttaatttttttttttttttgaggcggagtttcactctgtcacccaggctggagtgcaatggcatgatctcagctcaccgcaacctccacctcccaggttaaaatgattctcctgcctcagcctccctagtagctgggattacatgcatgtgccaccatgcccggctaattttgtatttttagtagagatggggtttctccatgttggtcaggctggtctcgaactcctgacctcaggtgatctgcccacctcggcctcccaaagtgctgggattacaggcatgagccaccgtgccaggcctacaaccagctaatttttaaaatttgtttttagagattgaggtcttgctattttgcccaggctggtctcaaactcctgggctcatgtgatcctcctgcctcagccacctaaagtgctgggattacagatgtaagccaccatgtcttgcccttctattttactgtagcaataacttaaaaactatctttatgactccgcatgtagtgcatgcctttaatctcagcactttgggaggctgaggcaggtggatcgcttgaggccggagttcaacacaggcctggccaacatggagaaaccctgtatctactaaaaataaaataaaataaaataaaatgccaggagtggtggcacatacctgtaatcccagctacttgggaggatgaggtatgagaactgcttgatcctcgaaggtgaagattgcagtgagctgagattgcaccactgcattccagcataagtgacagagtgagacagtctcaaaaaagaaaaaaagaagggaaatttctgttttttttggagacagagtctcactctgttgcccaggctggagtgcagtggcacgatcacagctcactgcagcctcgactacccaggctcaagaaatcctcctagctcagcctcctgagtggctgggactacaggcccatgccacaacacctggctaatttttgtagttttgtagagacaggatctcactttgttttgcagtgctggtctcgaactcctggggtcaagtgatcttcctgcctcagccgcccaaaatgctgggattacaggagattgtaccattggatcttttttttttttttaaaaaaggtaccccctcaagtggctcaccaaaaccagtaaggcttaatcaagattatgacttaaccaaggacacatgaggcatctccagagaggtgcacagcagtcctcaccagatccagaaccacctcaaagagagctcaaagaagggaaagttttgctagccacaaatggggtatgacccacatctgccagccatatcttccagggtctcagcctctcagctgaccatctacacacaaaagcctaagagccccgtgtaatccctcaaacagaagatgccagaaaaccaacagctgtctatggaagaggaaaggatcaatgacaagtgggtaagccacaaagtcaaaagtcacacaaatatcaaaccaaaagcgactggcttcccaactgggacctgcacccaggccatggcagtgaatgtgtggaattttaacaacaagactgcaaggtggggccaggtgcagtggctcacgtctgtaatcacagcactttgggaggctaaagcaggcagatcgtgaggtcaagtgattgagaccatcctggccaatatggtgaaaccccgtctctagtaaaaatacaaaaattagctgggcgtggtggcacgtgcctataatcccagctactctggaggcagaggcaggagaatcatttgaacttgggagttggaggttgcagtgagccgagattgtgccattgcactgcagcctgggtgacaagagcgaaactgtgtctcaaaaaaaaaaaaattgactgcaaggtggagtggctggcactgcagattccacaagggacccagggcaggcatttggagcatatgaaggattttagctttgtttcaggtcagacttttgctctttaatctcatcaagaggatttctaaggcaagccatgacactatgatgtgtcttttaatttaatcttccaatgaatataaataaggcagttgtttagaataagaaatctttaaactattttttgtaatttagaggtcttttcaacttaaagaatccatcttttggccgctaatgactagaatttccaataatgttcttattctaacatcaattccatcccacagcctcttcatggaaagccccggatgtggttttctaggcttagagtaggttattaccatttaagaaagacttgtttcctgaagagggcatagaataggcagttccaaagattcctccagtaaaattcactcctggaaacaggctcagatagcaagagacttcttttttattttaactcacagtttttattgattgaagtaataaaataaaaattagcaccttagttcctatttcttgtctattgtttttctttctttttaaaatttaattttatttaatttagttgtaagttccaggatacatgtgcaggcatgcaggtttgttacataggtaaacatgtgccatggcggtttgctgcacctatcaacccaccacctaggtatcaagccccacatgcattagctatttatcctaatactctccctccccaccaccaacaggccccagtgtgtgttgttcccctccctgtgtccatgtgctctcattgttcagctctcacttataaatgagaacatgtggtgttttgctttctgttcctctgttagtttgctgaggataatggcttccagctccatccatgtccctgcaaagcaacagactcttgttgccacacatggttaggatggtgtttgtgtgcacagtgcctctggtgacccacacatttctggggacacccatcacagaccccttaattcatgacactggacagctctcctaggatggaactttcccaggactaaccaggcaacaagggccagaccacaaaaattccttatggatgggacttcttattaagacaaacattcccaacagctggacacattcagaacaaaaagtttgctgcctaaaaccttgtatctcaggttcccaggcatcttcaggctaaacacctgatgggacccaaaaatcacaccccagatggcggaaacaagagacagtgctcccacttgtcacaagtcaaacactccagggcataaaacaagatgagaggggtcctcatctggcttctattttgtttttgttgttttgagactcagtctctcactctgtcacccacgctggagtgcagtggtgtgatcttggctcactgcaacctctgcctcctgggttcaggtggttctcctgcctcagcctcctgagtagcagagattacaggtgcctgccaccatgcctgcctaatttttgtatttttagtggggggggggggtttcaccatgtcagccaggctggtcttgaacccttgacctcaagtgatctgcccacctcagcctcccaaaggactgggagccaccgcacccggcttggcttctattttgaggacccacagcaaagtttgaatgcccatctgatcacagccacagactggctgctcttcaggtctggcctgaacaatgggctggcaggatcttcagcccccattctaccctacaaggccccttttcaggacagaacaacacaggaagaccaagacagacgagaataatcctcccggaaggaagggctctaaacaatatgagtattcacaccaaaaagtacaccagagtcgctgcacccaacactgttcacacagatcctttctcacactaatcaacatcttgcagaggaaaaacgactgatttttaccatctgctcacccagattccacagagagaccggccaggagcccggctggtaagaatttcttacccttctgccagctcgtcaggtcctgggtcccctgactgaagcttccagaaaagcaaaacagctttggtattctgttcaggacaccaaaactgtaggggccaacagaaaacctcccctttgcccttgaaagtttcactgaaaaatcaactcacaactcagattaattagagaaatggcatgcacatttattaatgtgcacatggagaaggaccagagcaatgatcccaaccccgcagtggtgtgcagaagcttatttaccgccttgagactacagaaggaacaggggctgggatgatggcaagacaggttagaggagagggaggaggaggcctggctcgcaaaggtggtctcagaatgcagacagaaccacacagacagcagtcctcagagagaatagatggtaaacatttctttctgatggctaaacatgtcagactctgagggactccttcctagatccagacaagggaaggcttcagaggaaacttgcctgtgtcagtgtggattctctacagatgcaaacgttcccctcaaaaggcagctttgcagggtggcctctgtttgaaggcccctctaaagagccatctcaaaatatgtccaagtatatagtggggtgaaatattttggtttccttcaactacatccttactacttaattcaatgcaatttcccttagccatgaactcttcaagtctttttttgcctgaaaaggttttgattgaattcataatcttgagtgatcaccatgtaagcagataaatattggttgacagttatatttcctcagtatattaaagaaacctggctcggtgcagtgactcatgcctgaaatcccagcgctttgggaggccaaagtggtgggtggatagcttgagctcaggagtttgagaccagcctgggcaacatggcgaagccccatctctccaaaattacaaaaattagccgggtgtggtggtgcatgcctgtagtcccagctactcgggaggctgagatgggaggatcccttgaacccaggaggcagaggttgcagtaagctgagattatgcctctgaactccagcctgagtgacagagtgaaactctgcctcaaaataaataaataaatctttccatggttgtgtgcatgttgagatatctgtcttgcctaaatttatttctctattttttcctatcttttattttgatgtaatttcagacattttaaaagtcacagcctggtgtggtggctcatgcctgtaatcccagcacttagggaggctgaggcaggtggattgcctgaggtcagtagtttgagaccagcctggccaacgtggtgaaactccacctctactaaaaatgcaaaaattagctaggcatggtgggcggcgcctacaatcccagctactcaggaggctgaggtaggagaattgcttgaactcaggagacggaggttgcagtgagctatgattgcaccactgcactccagcctgggtgacagagaataaaaaatgaagagttcatgtcctttgtagggacatggatgaaactggaaaccatcattctcagcaaactattgcaaggacaaaaaaccaaacaccgcatgttctcactcacagatatgaattgaacaatgagaacacatggacacaggaaggggaacatcacactccagggactgttgtggggtgggggaagggggcagggatagcattaggagatatacctaatgctaaatgatgagttaatgggtgcagcacaccaacatggcacatgtatacatatgtaacaaacctgcacattgtgcacatgtatcctaaaacttaaagtataaaaataataaaatgaaactaaaaaaaagagttgcaatagtagtgcgaaaaattccatttatgattccttcagattcctctcatattaacattcaattacatttgctaaatgctcttctcttggtgcagatgtagaatattatagctattttcctagaccctgtgagagtcagttgcagacatgatgctcctttacctacaagtattgagcgtgtgtttctgaaaccaagggcagctcttacattatcagagttcagtgatcaaaaacaggaaatcttcattgacacaatacaattctcagaccttcagatctccttcagattttgccaacggttccaatattgtttttataggggaagaagatcctgaaccatgccttcattcagttgtctcatctggaactgttctgcaacctctttgatttcttgatattgatgtatttccagatacaggctagtcacttaatagaacatccctccatttggttgcctgatacgtcctcacgttgagaatcaggttttgcactttcagcaggaacactacagaggggatgctgggctttttcagtgcaaccactaacaagaaacatgaagccagtttctcccctgctgtgagggtgaggtgggctttctccctggactgcaaccacctgggtgagtgtgttttataaaattatgctttctccactgtaaccttctcccatttccatttctgagtgcaaactatcttgtgggtggttacttttgagattctgggtctcttaaacactagttttggttgatttacttcagtatcacaatacttcagcatattatctactttcatttattcttggcactcattgtggttctggaatctaaagatcaatagttttcatcagttccagaaattccttagccattatccctttgaataggaccgttctctcattatctgcattttctcctcttgtaattattgtcaagtgtgttttgcatattctcatttcaattctccagtctcctgatgatctttcacagtttgcaaatctttattgctatatattctagacaattccacatatggatattcttataatttctatcatcatctgaggctaatctgttgtgttttaatttttaacttcactgatttcactattcacttccagaagtttcccttggtgtttcaaacaagcctgtcttctgtggtggcaatgtggtattttctagtgactgcagccattcttacctatctttaatccttttaaacctagttaaaagattgccttcttccttgttccctctgaatgttatcagcttcacattgctaaggtttttgaggtataattgacaaagtgaggtgtaattgctttattgaagtatagttgcctaagattgtatacatttaaggtgatgtgatgatcacagtgtgatgttttgatctatgtatatattgtgaactcattaccacaaccaagctaattaacacatctgtcacctcacacagtaaccttgtgtgtgcctgatgagaaccttaagatatgctctcagcaaatgtcaagtattattaactatagtccccatgctgtatattagattctagaacttattcgtcttgtaactgggagtttgtgcttatttatttatttatttatttatttatttttgagatggagtctggctctgtcaccaggctggagtacagtagcatgatcttggctcactgcaacctccacctcccaggttcaaatgattctcccacctcagcctcccgagcagctgggattacaggtgcacaccatcatgcccggctactttttatatttttagtagagacgaggtttcaccatgttggccaggatggtcttgaactcctcaccttagattatctgccctttttggcctcccaaagtgctgggattatgggtgtgagccaccgcacccagccagaagtttgtactttttggtcaacatttccccatcccctccactcccagcccctggcaacccctgttcccctctctgtttctgtgagttcaatttttttagatttcacatctaaaaacaggagttaggggagattgtgcaatacagtcaacccttgaacaatgtgagagttgggggtgctgacacccccatacagttggaaacgtgtgtataacttttgactccccaaaaacttaactattagtagcttactgttgcctggaagtcttatgtgttaatgtaaaccacagattaatacattttttatgttatacatattatacactgtgttctcatggtaaagtaagctagaggaaagaaaatgttattaagaaaaccataaggaagagaaaatctgtttactattcattaagtggatcatcataaaggtcttcatcctcatcatctttaggttgaggaggctggggaggagggagaagaggggttcatcttgctgtctcaggggagacacaggcggaagaggtagaggaggtggaagagaagaggcaggagaagcaggcccccttgctgtaactttttttgaggaaaattcacgtataaatggacccacacagttcaaacctctgttgttcaaaggtcaactatatctgcctttcggtgtctggcttatttcactcaacataacttcctctgggttcatccacagtgtcacaaaaggcaggatttccttcttttttagggtgaatgatattctattatctcattatatgtacatcacattttctttttccactcatccatgtgcgtacactgaggaagttcaggaaattccttccccgcaaccagaatatgccagtttgatgtgttgattgcttcaaactgagggcagtggtggaggagcaaatgcagggagggttttctgtggacctccctcatctgttgaaagacagatcttccaaagggaactcagctggcatgaatccccttcctgggaacctcatcaacaagggaagatttgttcatgtcacagcagcacagacagactttgtcactgctgtccctttttcattcttcattcttccggggatacatttatctttcccccaaataatttactctccctttggttgcctttgtcccctctctttctcccctttgcagaaaagtacataagcttccagcctcactgggtgttgggtttcacttttctttcacgtgatgcctcccgtgcccacatgtaaatttgtaagccttattctcctgttaatctgcctgctgtccattcatctcacagactcaattatcgaaccctctgagggtagagggaaagcgtttcctccccacaacacctgggttgattcagtatttcagctattgtgaatatgctgcaatgagcacggggatgcagacaactcttcaacaccctgaatgcatttcctttggatatatacccagtaatggagttgctggatcacatggtggctctatttttagtttcttgaggaacatccatgctgattttccacagtggctgtactaacttacattcccaccaacagtgtacaagtgacactgtactgtggtctgttataccctccttttctggctttcacattttgtctgtggtgcactcctcaaatgagttccgtggcatgccttgttcctgttttcactggaacatactgcacgctatgaggattatttcttcgtggaggcctggtcatacttggttgatgagcagaaggaccatttgccttttagaagcagatgtttgacttcaagtttaaaatcttctgtaattactgatcaaattaacatctccacaatactagttaacacttttcttaaaacgtcttttgtttcctaatactttttctacatttttgcacaaagttatttcattttaattactcttaatttactttaattttggaagtgagctttcttttcaacaatccataaatggttttttattttctcttttttcttgttcatattttcccaacattgtcccttatatatttccgtatagttaaccagatttatttcttatcaatctaatttgttttatattttaatcaatttatcgtttaccattatgaatttcttttttttcttactttttcttttgaaacagagtcttgttctgtcacccgtgctggagtacattggtgccatcttagctcacttcaatctctgcttcccaggttcaaatgattctcctccctcagcctcctgagtagcttgcattataggtgcgcaccaccacaaccagctaatgtttgtatttttagtagagatggggtttcttcatgttggccaggctggtcttgactcctggcctcacatgatctgcccacattggcctcccaaactgctaggattacaggcatgagtcaccacacctggccattttatcattatgaatttttgttctactttttccttttactttttttttttttttacagattttagtcttgttccagtttttgtttacctaacttcttcagttaaagttggcttattaaaatgttaaatttcttaggaaatggtaatctttggaggttaaaaagatttaaatttcttattattctcacaatgcacctaaaactatacagctacacattttttctcttagaacagcttctgttgtattctgaatatcttcttatgttgtactttcaatcctagataccttcttctctaaacttggtggatcttctgaaagttggagcagaatgggctttatagtttaaaaggtccactgctgtccagggatgtgaattctttgaggagggagttactgcacaaggaggtcgggagctgacggagtctgatgacaaggccctgggatgtaggagagggcacaaggcacagcaaagccagcctcactgcatgtccctggagcctgtgccaggtctacttcctggctgccagcttttccacaaatgctgtgtgcacctcacactttcagatcaggccgaaagatttctgtaggtcatgccaggaaagggaggttaagcaggcagctgtctaaggggtttgggggaagcttgggggagtcacaggattttgttgaagagagagaggtggaggagatggggctgtgtgttggggaggaaggttcagactggagatctagaaatccattagatcctctggtgggtcagggacaagagttgggggtgttgggggtataagtgggtggagaaggaggatttatggtgggagtggatttcaacgtctgctctaggtcagcttttggctccttaattttgttaagggatgttttaagactaaccatagtacattctgtgttcctctatcagtgtgatcttcccatagatgccagcagaccagttgtttagaacgagtactctctaacatgttttaaacatggatccgtctctggccatagctgatttggatctgcactggtgcatatgttccagtagtgccttaatctgcctttccagggaaaggccaggaggtggctttccatcattaccagcatgcaaggggtgttcctgcagtaggtgcagaagaggcagcccgtgatccaaaaattcactctcagagatggatgaagaaagcaaagacttacattgccatgtgcaggtagggagagtgtttgtgcagaccacgcctccagtctcccatggaagctgagacaccttcagcctcaggtccactcactgtgacactgggcaggtgatgctggaataggagtctcccagcactaatcagggcaacaaggataagatgaagaaagcccttatgaattggcatcttacaacaaaactccgtgagcgcttgacacatacagacagagagagtgccacctgggtctcatgtgtcttgagtccccagtctggtcagactgctgcctggcacagagccacactctgtgcccctccgatggcagagaccagagaggcatcctccttggtcacacagccaagctctcaggacataaaacgaggtgagaggggtaccccatcccttttgtttttttgtttcagggacccacagcacagtttgcttaggcagacatgggtctgacaagcacaacaaacccaagtgctggggacccagcagactttgaaggacctgtgcctgtgttctctacccgacacttcctctccttatgacaaacggcagaaaaagacagagacaaaggaaaacaaagaccatctttgagatcaaaaggatcaaatagaaatctaaacactaaaagtccctttttacccaaagaactatttcacaatgttttatcctgtcaatcccaatttagagagagaaaaagacacaaatctcaccattctcacctagatcagccccacagcagagacctggaaggctagcagtaagaaccctgcctttgctggcttaggtcagaggtcccgggtcttagctgcagtatctccagaataagcaatttcccagtcagtgagggagggccccggactctgtgccacgttctgcagggacccagagatcacctccaaccccacttagctcttacatgggctcctcagctggatctagaaaccaaattgaaatcaagcatattaacaagagaaaagcatacaaattgtattagtattaaaggtacatggggatcttcccaagttagtgaagtctgaagtagccaaagcaagatgcttttgtactttttagacagaatgataaatttgagaagaaatgacaaggccaagcagaatctggctaggggcagtaaatttccaggggagcctctaggtgatatgcgggaatataaaatcaatggcaacaaggcttacttcatgaagtacatttacttgggtcagttgctgcccccaatccccagtctccagtgctaagggctctcttcttgcccttgtgtgggggtgccacccccagaggagtctttatggcttgctacatgcaggaagaggcaggtcagctcaccctttctaaaactacgatttctccaatatttttgacataaaattatcaatataccaatttggcatattttgggatggcattcactccttcaagggaaaggtgggatggggaggtgtggggtcaggtgaggatgtggtgaaagacaaggtggggtatggatggaaatgggctctaggggaagagggaacaggcatggaaggggtgaggagagagagggccatgagccatgggtctggaggcagagagggaggcactggtgcaggtgataaaacctcacatgaggggtggcacaggtcagggggaaggtggaggccactggtgaggagactgggggttggcattgacaaatccacagatcccaaaggtgatggggaacagcagcgtcttccccggctccccacacagcagcatgttggcctccagatatactccatcacccccctgggcagggctcacacttctgacacccagactctacaatactcctctgtccccacccagggcagatccctaccctagaagttctccctctcatgtctggtaaatgctgcacagagccctggaattccacagggcaagttaggaagagggacagctgaaatcaggaagtaatcaccttctccaaagagaagttcagtccagtaccatcttgtgcccctgggcaagctctccaggctgagggaacaggagcagtggttatgctgggcaaagttggaagcaagggacctctcaggaagtgctgtagaatgttccactggggacacctcgtaccctaccaggattagaccttgaaacctggagatcccaggcaattagtattcaaggtcaaagggccagtgacaggaataggaaggcccactgtgtcattcacaaagcacttccaaacccatcaccccaggtgaccctcacaacaaccccgtgagatctgcagggcaggggctcccacaaagaaggagtcaggaatgtcgggattttaacaccttctccaagtcaggaccaggaaatgctgtcccagcaccaacttatattccctaggcttcctcccacaccacagcttagggtgactgccacctcatgggcagagaccctagctttccaatccttacaaggggctgtgcaggggagaggatgaagccccctcctctgactgtctcctctaagagcctgttttctgatgaaagtcactctgggaactgtcagcctctgcaaatgggggcctggacctcgtggaaagaagatgtgaaggtcacacctggcagggaccagctctggagggcaaacctcaccttttaaaattcccaacttgcatgtcctcctgccactgcattggtgctgacttctaaaggagcagcggacgtgaaaaagttgactttcttctaggttaacttcatgaagattattaaagtgatgaaaatatttatcctattctctataaagctccagcgaatatggttttctgcacatgcttatcaaagaatcttttagccaggagccctctgctgaagaacagtgtacaatctcagctgggacgcacatgttgcttctggaaacagatgaacacagtctgatcagagtctttcatgggtcagcgttgctccaggccagcccagcacagtcaggagcctcggcccaggcacgcccaagaagggagggtggctagtgcccagatgctgggggactgctcttttcgggtgctcttaattctgttaagaagccaatccatggccccgatgtcgtggtgtttggggctttaccctggcatcctgaacacacccagatagctgggtgtgagcactggagagaagccccggtctccactccacctcctgccctgcccaagctgctcccctggactgatagtgttctagtctctcctgagcattctcattcctggggcccctggggtccaatagtcaatttaggagcccatctaaagagactatctcttttagggggctggctttagggttcccttaccgatgaattggtaaatatggatggcagtggatgtagttgcatgacagaaagcacatcccaaccccacacaaaataatgagaaatggaaccaaagtcccagggctctccaagcacagaagaagccaccaaatattctccatctccatcatctgaagtgagctgatgcctcggcagctgggtgcagataacatgcagctcagtgcagagctccaggcccgcatcacaggctgtggaagggttacagattactcttgtgctcagaaggagacaaaacaatcagctctcccactgatcccaccccagcaggcccagcacccctcccagcttccaggccccaccaccctgctgccactacctattttctgtctccaaatttactttactgtaagttccttttcactctgtccatgacccagacataagcagggattccctcagagaaacagacttggatcccagctttggaggtctgaagatctccaggaattttttctaattctcaggcattaaaacaaatttttttggaagtataacatacagatggaaagcacaaatatcttaagcctacaatgcaatggattctcacaaacagtacactatgagagttgaactcacaccagaaaatgggatcaccccaggacctggaagcctctctagggcccctttcaagacatcacctatgccccgccccccccaccaaactttcctgacttatgattttccaggaacaattttatagttttcctgtgttttcactcaactaacatttacagtaatcctctgagataaacactgcactatcccccgttgcagatgggaagctggaagcacagacactggttattgatcaggtgcccactgctaagggtggagccagggtcccacgtggaagctccctgcagagccacattcttgaaacattgaactgcgctgcgaaaagccctttggctgcctgggcacagtggctcacacctgtaatcccagcgctttgagaggccaaggtgggatggttgcttgagtccaagagcccaagaccatcctgagcaacataacaagaccctgtctgttaaaataataataataataataaaattaaattagtgggtgtggtggtgcatgcctgcagtcccagctactcaaaagctgagatgaaaggaaaaaaaaaaaagaaaaaatcccttggcaagcaggaacaatagctcagttcaatgcaattgggtgtgtagaagaatcaccaccaagctctgggaaggctaggcagagggttttgcacacactcagggagtcctgtcctctctactgtggttggaacctgagaggggctgtgaggctctgagcaggagagagacttgcccaaaggccaaagacagggaggagtagagtctaacatgagtacaagattgactaggaccatcgtttatctctttacacaggaacaggaggaacttgaggcaaggaagggctatataagatgcagtcccctccctgcaggggccagcttggtgctggatgcatggttggttttatagtgacttgaactctgggactgcggcaggtggggccagatccttgactgtgcaggaatagacctcttccctgaaccgacagatgctgtatgaggaggggaggagggctgggaagccagccaggctggggtgggtgggcagagagtgttggggtttctcacctgtcctaacaaccacaaccacctttctggccttagaaagaggcaacagggagtgtgcgttttgtagagttcttcagggctgggcagagcccctgaggagatttgttgggggtggaaggacagaattcagatgaaggagacttggaaaaatgagttttaagaagttttattgtgggttatgatttcgataatgattagaattgcgtttcagggtgggcatggtggctgatgcctgtaatcccaaaatttgaagaggcaaatgcaggaggatcacttgaggccaggagttcaagaccagcctggacaacatagcaagaccccttctttgcaaaaaaaaaaaaaaaaaaaaaaaaaattgaaaattagccgggcatggtgtgacacacacctatagtcccaactagttgagaggctgaggcaggaggatcacttaagctcaagagttcaaggctgcagtgagctatgatcaaccactgcactccaacctgtttccaaaaaaagacaagaattacatttcagtataatgaaatcataatttttaaaggtaaatactataacctttaattgagagagaaaaagagtttgacagcttcaaacttgatactggcataaaaataaacaaaatagcccaaaagtccttgtaaatattcatgtatatataggaactgataacagaacaaaggttgttttccaaagaaatgagggatggctcacaggttcattgagtattgttgaggaaataggctatccatctttgcaaatgctcagattattcctaccacacaatatacagaatctagttgctgtataaggaagaagagggtggctctgggcagacacctgtgtttcaatcccagttttgctctatgcacctctatggcctagagaaagttaccctacctctctaggtatatgctatccagatcttaagcgggtttaagaaaatagctaggctggtcatggtggctcacacctgtaatcccagcactttgagaggcagaggtgggagaattgcttgaggctaggaattcaagaccagtctgggcaacacagtgagtccctgtctctacaaaaataaaaaataaaaattagatggcatggtggtgcataactgtagtccaagcaactcgggagtctgagacaggaggattgcttgagcccgggagttcaaggccacagtgagctatgattgcaccactgcactccagcctgggcaacagagcaagaccctgtctcaaaggaaaaagagagaaagaaagaaaggtagctaaatcatagaatggttctgataaactgggctctagatgtgaagaccttagaacaatgcctggcatgttcagtaaatactatttccccatatccgtctattaatagcacgctaaacataggaggagaaggccacacaagcaagtgggttacaaacttctggttctgggtaggactcaggagcagagagagatagatgagggatgatggaggatagcagtggactcactaagattgacttcctggctcaaatcttggagaggaaaagggaaaatcccaaaggactttggccatgggagttttgctgctagtattccagggcatgtcctgtgattcatgctcgttaagacaaagaattttatagcagttgccatcccagaaaattcctattccagcttccctgggccacaggtgagacagaggctctctaaagtcaacccgcaggtttggcttcttccatttacctgtgccctttctttcaacaagaggcctccaaggctgccacgatggagaaaagaaatggggattacacaggagacagttctgtgagccaagccccaaagcggcagcctgagcttctgcccacatcataccgacaaggactcagtcctgtggctcctgctactggcagggaggtgaagtttccctgatctgcaagaggaacatgagtgggttaggtgagcaatagcactgactgcaccagcatgccttcaggtcagcagattatcatatttctgttgccactacacaccaataaaacagaaactcactctgtctccaaggtggccatgcaaaggactctctagtaattccatcctgctcaaagctcaggaccattggctcacacagagtcctctccaaagcagcaagatgtggccctgtgcagccaggagacagaataataacctaattcccattcagaacatgcagaacatggaccaaggagaaacacagaataatttgtgtagcctacggggctggcaatgggaagatagtaagaatgttttccttgattggacatcaagtctgctctctggaattaagtccattttcattttgttttctcctcttgtgcctggctctcctctccaaggaattcatcattgtctgttaccatcttggtcacttctgaagtgggtttgggggaaaaagtctctgtgggagctgcaagtttagcagcctacttccttgcaaagatggtaccaagacttgcctatgggtccaatggttttagatcctgctctgcatttagacaatgctcatagctgctttgcaagccaccccaaaccttggttaactcacatccctgtgtttccagtcagttccatgagccaattaccacaccccaaaggcctttctttcttggacataattctcaagactgagccttggtagattggacttctaaaatactctcttactacttggggtccagaagcagcaaggtttttccaccttacaaagtctgatgtttctggattctcttgatttctttttagttatacttacatactgggaaaattattgaactcatcttcctccaattacttgccaaatgcatttatcaatatagaacacacactactaacattgtttatcaaactcttcccttatagtcacaagttcagcagcaggtgcataatctgccatctaagtaactgcaagtgatgactttaccaaaggctttgttatcacttaagatggattcagctttcattagaattattcatcaaaataatataatacaaaaaccaaataaaatgtggctacaccataaattttggtaaatgattagcaaatataaaaattaaaaaattttggaacgcttctcttaatgagacagatggacttctgtcccagctttgccatgaatctgtgaatgaacagttacctgctagaatgtgacagagttcaacatcagtcatacacctattttttcacttgttcagtttgaagtcctgagaaaccttgcttacataaataagcagataggaatggaaagggtctttatgcaattatttgaactctttcaaagttatagaccaaaaagcacagttatatataataaaagttattgtaaatgacccatctgctgacaactggatttgttccaccttcagtttgttcaaatgaagaattgaaacttatgtgactcgtagtgggatttgatatccaggaattaaagacagtctcacctgaaatacctacttcagtattttaaattatccccttgttaatccctggagatatggatctatggtctatagtaagatgcaagattgttgaaagggaacctcttgtgaagtgggagaagggctattctaaatagggactctttgatctcatgctagatcttaggaagatcatattttggaaacagcccaggtagaagttaaagatctgaaaattaatttctttaaaaccatccatgggaaagttctgagttaggaattccaaaggcctgccttctaccaaaacagtgaaaccactggcaaaaaactgtcaaaatcactctttatagaactctggaaaagcttgcagcaagcagtagagcacatattcaagaaaaactgctgacaccaataagaaaagcttgctccagggtgctttagcttatcctggttccatctcctgcttcccttgaaaactcacagctgttgttcccagtgtggtactgaacagatcagaaatgaagatattctcagagagttggaactgctcattttgatctgtcagattgctccccagaagactagctccaaaggattgccattctcttgtccaccttggaactcaccccaaactgaagcaccacctcagagcaattgttgacaacatatatggcaaatgttccaggcccaactgccaaagggaatggacagttgctggggaaaacaacaggttaaccaaaacttactgggagaaaagtctggaaataagatgttttaggcaacaagggctttggaaaattgttacaaattcctgggaatcttgaaggccgcacacatgcccagggctctgtgcaccctcagagaagagctcagacagctctaagctcacccttggctgatcatgaggttcaacacaggcaggaagtgaaggttaagaccaggttggaaaccacctggctgagcattgaaggaatgacctcaaaatgcaaacacttcctctgcaaagattagatttttattttattttattttatttctttagacagagtcttgctctgtcacccaggctggagtacagtaacatgattatagctcactgcagcctcaaactcttgggctcaagtgattctcccacctcagcagctgggaatacaggtgtgtgccaccacactcagctaattttgaattttttgtagagacggggtttcacgatattgcccaggctggtcgtgaactcctggcctcaagtgattcacccatctcagcctcccaaagtgctggcattacagacaacagccaccgcacctggccaagattagattttttttttttttgagacggagtctcgctctgtcgcccaggctggagtgctgtggcacgctctcggctcactgcaacctctgcctcccaagttcaagcaactctcgggcctcagcctcccaagtagctggaactacaggcacccaccaccatacccagctaattttttgtattttagtaaagacggggtttcaccatgttgcccagggtggtcgtgaattcctaagctcagccattccacccaccttggcctcccaaagtgctaggattacaagcatgagccaccattcctggcctaaaatcagctcttttaagtatgtccaaagagctacaagaaaccatgttctaaagaactatggtgaggacgaaaacagtatctcaccaaatagagaatattaacaaagagatgggaattataaaaagaaattcagaagttaaaaagcacaataactgcaatcaaaattcaatggaaggctcaccagtgcatttgatcaggcagaagaaaagaactgacaccatggtttaggtcacagcatcccagatgctgcaactagatttttcctttcttaggaaccttggggtccaagggttgtagtcccactggtgttcaacaacacacggatcaatgtgtgtccatgcagtacatttaattccgaacccccatttgggggtactgtcaggcttatagatgccttcatatacatacattatgagatgctaggatattcctgctgctcattactaggacagagctccagctgccatttcaacaaaaaatcccaaaaagtcaactaaattcaacgccttcatctgcactcaatgagcctgtctgcccagtggggattgtggacagagcagaagcattatgacacgttacgtgttggggtttttagtgctaagtttgtgtgatgagaattgctgaaccctctgatgtggggtgagtcattaaattgtctcccctgccactgaatagattccaacatagcctggccacacgtccaagggtgtgggggacagagggggagccgaagcactgatgctccctgatcctttgatcagtcaagatgactaaggtgggtgcacacagaaggcgggggcaggaaagtgctggggtggatgttggagaaccgacactagtggagctaacccaaaatcactaaatcagggatttcagatggcgtctactgttagggagatgagaatcctcatgtgagatgagtcaggttctcctgggaattgccatggggcagggggttgggggggagttaaatggcactcctgaacactagggctaattaataataaagccctatatttccattttactgccaatcacatggagacataaacatcttcctgatgggagccatagccaaagcctttccacttgcaagagctccgacttcccttcagtgcatgcgggttgaccagggagactacaagagggggcaggggtgagattcgtggcaggtgagcctgggagcagagcagagagaagcactgttgtaccatggcttctttttccaattttgctttttttttaaattatactttaagttctagggtatatgtgcacaacgtgcaggtttcttacatatgtatacatatgccatggtggtgtgctgcacccattaactcgtcatttacattaggtatatctcctaatgctatccctctcccttccccccaccccacgacaggccccagtgtgtgatgttcctcttcctgtgtccaagtgttctcattgttcaattccaacctatgagtgagaacatgtggtgtttggttttttgtccttctgacagtttgctgagaatgatggtttccagcttcatccatgtccctacaaaggacatgaactcatccttttttatggctgcatagtattccgtggtgtatatgtgccacattttcttaatccagtctatcgttgttggacatttgggttggttccaagtctttgctgttgtgaatagtgccgcaatggacataagtgtgcatgtgtctttatagcagcgtgatttataatcctttgggtatatatccagtaatgggatggctgggttaaatggtatttctagttctagatccttgaggaattgccacacagtcttccacaatggttgaactagtttacagtcccaccaacagtgtaaaagtgttcctatttctccacatcctctccagcacctgttgtttcctgagtttttaatgatcgccattctaactggtgtgaggtggtatctcattgtggttttgatttgcatttctctgatggccagtgatgatgagcatttattcatgtgtctgttggctgcataaatgtcttcttttgagaagtgtctgttcatatccttcacccactttttgatggggttgtttttttcttgtaaacttgttggagttcattgtagattctagatattagccctttgtcagatgagtagattgcagaaatgttctcccattctgtaggttgcctattcactctgatgatagtttcttttgctgtgcagaagctcttcagtttaattagctcccatttgtcaattttggcttttgttgcctttgcttttggtgttttagacatgaagtcctttcccatgcctatgtcctcaatggggggcattgcctaggttttcctctaggatttttatcgttttaggtctaacatttaagtctttaatccatcctgaattaatttttgtctaaggtgtaaggaagggctccagtttcagctttctacatatgactagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggctactgtagccttgtagtatggtttgaagtcaggtagcgtgctgcctccagcttttttcttttggcttaggattgtcttggcaatgcaggctcttttttggttccatatgaactttaaagtagttttttccaattctgtgaagaaagtcattggtagcttgatggggatggcatcgaatctataaattaccttgggctgtatggccattttcacgacattgattcttcctatccttgagcatggaatgttcctccatttgtttgtgtcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgcgcattgattttgtatcctgagactttgctgaagttgcttatcagcttaaggagattttgtgctgagacaatggggttttctaaatatacaatcatctcatctgcaaacgggacaatttgacttcctcttttcctaactgaataccctttatttctttctcctgcctgattaccctggccagaaattccaacactatgttgaataggagtggtgagagagggcatccctgtcttgtgccagttttcaaagggaatgcttccagtttttgcccattcagtatgatattggctgtgggtttgtcataaacagctcttatgattttgagatatgtcccatcaatacctaatttattgagagtttttagcatgaatggttgttgaattttgtccaaggtcttttctgcatctgttgagataatcatgtggtttttgtctttggttctgtttatatgctagattacatttattgatttgcctgtgttgaaccagccttgcatcccagggatgaagcccacttgatcatgatggataagctttttgatgtgctgctggattcggtttgcagtattttattgaggatttttgcatcaatgttcatcagggatattggtctaaaattctcttttgtggttgtctctctgccaggctttgttatcaggatgatgccggcctcataaaatgagttagggaagattccctctttttctattgattggaatagtttcagaagaaatggtaccagctcctccttgtacctatggtagaattcggctgtgaatctgtctgttcccagatgtttttttggttagtaggctattaattattgcctcaatttcagagcctcttattggtgtattcagggattcaacttcttcctggttaatcttgggagagtatatgtgtccaggatttcatccatttcttccagattttctagtttatttgcatagaggtgtttatagtattctctgatggtagtttgtatttctgtgggattggtggtgatatcacctttatcattttttattgcatctatttgatacttctgtcttttcttctttatcagtcttgctagtggtctattaattttgttgatcttttcaaaaagccagctcctggattcattgattttttgaagggttttttgtgtctctagctccttcagttctgctctgctcttagttatttcttgccttctgctagcttttgaatgtgtttgctcttgcttctctagttacttcaactttgatgttagggtgtcaattttagatcttttctcctttctcttgtgggcatttagtgctacaaatttccctctacacactgctttgaatgtgtcccagagattctggtatgttgtgtctttgttctcattggtttcaaagaacatctttattcctgccttcactttgttatgtacccagtagtcaatcagcagcaggttgttcaatttccatgtagttgagcggttttgagtgagtttcttaatcctgagttctagtttgattgcactgtggtctgagagacagtttttataatttctgttcttttacatttgctgaggagtgctttacttccaactatgtggtcaattttggagtaagtgcgatgtggtgctgagaagaatgtacattctgttgatttggggtggagagttctgtagatgtctgttaggtctgcttggtgcagagctgagttcaattcctggacatgcttgttaaccttctgtctcattgatctgtctagtgttgagagtggggtgttaaagtctcccattgttactgtgtgggagtctaagtctctttgtaggtctctaaggacttgctttatgaatctgggtgctcctgtattgggtgcatatatatttagggtggttagctctttttgttgaattaattcctttaccgttatgtaatggccttgtctcttttgatatttgttggtttaaagtatgttttatcagagactaggattgcaacccccgcctttttctgttttccatttgcttggtagatcttcctccatccctttattttgagcctatgtgtgtctctgcacgtgagatgggtctcctgaatacagcacactgatgggtcttgactctttatccaatttgtcagtttgcatcttttaattggagcatttagcccatttacatttaaggttaatattgttatgtgtgaatttcatcctgtcattatgatgttagctggttattttgctcattagttgatgcagtttctttctagcatcgaaggcctttacaattcagcatgtttttgcagtggctggtactggttgttcctttccatgtttagtgcttcctttaggagctcttgtaaggcaggcctggtgtcacaaaatctctcagcatttgcttgtctttaaaggattttatttctccttcacttgtgaagcttagtttggctggatatgaaattctgggttgaaaattcttttctttaagaatgttgaatattggcccccactctcttcaggcttgtagagtttctgctgagagatccactgttagtctgatgggcttccctttgtggataacccaacctttctctctggctgcccttaacattttttcctttaattcaactttggtgaatgtgacaactatgtgtcttggagttactcttcttgaggagtttctttgtggcattctctgtatttcctgaattggaatgttggcctgccttgctagattagggcagttctcctggataatatcctgcagagtgtttttcaacttggttccattctccccatcactttcaggtacaccaatccaatgtagatttggtcttttcatgtagtcccatatttcttggaggttttgttcatttctttttattcttttttctctaaacttctcttctcacttcattttattcatttgatcttcaatcactgatagatttcttccagttgatctgaagcttgtgcattcatcacgtagttcttgtgccatggttttcagttccatcaggtcatttaagaccttctttacactggttattttagttagccattcatctaatcttttttcaaggtttttagcttctttgcgatgggttcgaacttcctcctttagctcggagaagtttgatcgtctgaagccttcttctctcaactcatcaaagtcattctccatccagctttgttccactgctggcgaggagctgcattcctttgtagggggagaggcactctgatttttagaattttcagcttttctgctctgtttttttccccatctttgtggttttatctacctttggtctttgatgacggtgatgtacagatggagttttggtgtggatgtcctttctctttgttagttttccttctaacagtcaggatcctcagctgcaggtctgttggagtttgctggaggtccactccagatggtatttgcctgggtatcagcagcagaggctgcaaaagagcgaatattgctgaacagcaaatgttgctgcctgatttttcctccggaagcttcttctcagaggggtacatggctgggagaggcgtcagtctgccgctactgtgggatacctcccagttaggctactctggggtcagggacccacttgaggaggctgtctgtccattctcagatctcaaactctgtgctgggagaaccactagtctcttcaaagctgtcaggcagggacatttaagtctgcagaggtttctgctgccttttgtttggctatgccctgcccccagaggtggagtctacagaggcaggcaggcctacttgagctgcggtgggctccactcagtttgagcttcctggtcactttaccaactcaagcctcagcaacggtgggtgcccctcccccagccttgctgccacctcgcagttcaatctcagactgttgtgctagcaatgagtgaggctctgtgggcatgggaccctccgagccaggggcaggatataatcttctggtgtaccgtttgctaagaccattggaaaagcgcagtattagagtgagagtgacctgattttccagtgtcatctgtcatggcttcccttggctaggaaagggaattcctgaccctttgcacttcctgggtgaggcgatgcctcaccctgcttcagctcatgctcggtgggctacaccaactatcctgcatccactgtccaacaagccctagtaccagtacctcagttggaaatgcagaaatcacccatcttctgcatcactcatgctgggagctgtagactggagctgttcccattcagccatcttggaatcgccattccctttggcgtctttgtctctgctctgctttgcctgtatcattatggactatccctaggggagaatctggatgaacacaggtggtggctgagttctccacagcccacctgcagtgagtgaggacctgcctcttctcctgaatggtacctctttaaccatcagttgggcacatttgtctctcagcctggatcttctaaatgtgtccaagaagtcttagtgccagttgtttctccaggactgtgggaggctgtggcagctcaggggctgattgggagatcatctcttttccaacctttccctctatgagttccaacttccatgaagcctgtgtcttctcagaagagatgggagaggtttctttttctcatccagcccacagcctcagcaagggatcgcccatatcagtggctatcatgggcccaggcatgaggtgaccacaggagttggggctgcatgagacactcaccttgcagttggtggcaggtgtgtcctcaggggagtcctgtcagccagcactccaggtgcgggatgcagggcagggcagccttcaaggatagcagaagagtgggttgggttggagagggcaaggaggaatcacttatgtatgctccctagttttaaacctactaaaatgtttataggatagacctgaacagtctgatcatttcaaaaggtaaataaaactctccttacaatccttgtcctcaaagtccttagccccgcacacacaggattgtgcgcaatgagggaagctgcacctgccagcccaggcctgtggagttctgggcgttgcttcatcactttgtgtcactccataagggactgttcacgtgtatttgttcagcttcgctctccagaaggcccttcaactattagtccattgtatctctcaactctcccaacagattgttgaagcatttcacagaggaggaacccgaggctcctatgaaggaatagttcacccagagtcatggttgataggccacaggtcatggggatggcttgccttgggatgagtgtgtagattgactttaaatttctaaggaggggagtttagatatgtattcccaaaacttaccatcgccatctggaagtttgaattaccatcttactgggaactgtccaggtgacctcacactagagctcatgtgatatccgtttatgatgaggtggttgtgtgctcagggtgcacacatatctctgagtgggtgtgaggcacatgccaggtgggcacagagacatccacctggaatcccagaatggtttgaacccctctacatatagacctttccttggtgctgggaagtcaattgtcctctccgacccttgagagggaaggtcctgggtggcccataatgtttcagatgttttaggtatcagtaacctttaaggacattactgtggatgccacccaggaacagtgggccctgtgaggcccagcccagaggtgccatgctggagaacaatggtcccctgggcctagtgggtgagtctgtcagcactgattgatttattcatttatctttaataatttcaacttttcttttcgattcagggggtccttgtgcaggtttgttacatgggcatatcatgtgatgctgaggtttggggtacgattgatattgtcactaaagcaacgagtgcacatggtacacaacggttagtttttcaacccttccccccttcttctcttccttccccctcttgaattccccagtgtctattgttcctatctttatgcccatgtgtactcaacatttacctcccacttgtaagtgagaacatgcagtatttggttttctgttcctgagttaattcacttaggataatggcctccagctgcatccatgttgctgcaaagcacgtgatctcgttctttttatgactgtatggtattccatggtgtatatgtacacattttccgtagccagttcaccattgaagggcagctaggttggttccctgtctttgttatcgtgaataacgatgatttattttttgaacatgtgtccacgacagcttggccacacccctcctctcagccctcagtcacactggttctttcacagcacaaaggactacctgaaggaagcttgttaatgtctctacatctggcttgtcacccaccagagcatcatcttcccattgcaatgtcatgcctttctggctgctagatctccaatacccagaacactgtggctatctttaaaaaataaatcactagattaaatttttaccaagcaacaactctgttctgagcacgaagctagcgtttgagagcatagcaggaaaaataactggcccttgcctttttcttgcaaaactgagattgtgctggtggagctttcattgattggattattatgaaaataaaggtcagccagctgtggaatcttccttcactctgctctgagcctggccatgcaaaccagcaacatgagctcccactgcctggagatccgaggcaggactccctcctgtcctgtgagggacactggtgtcctcagggtcagggtgctcttccctggctgcccttggaagcccacctcattcttcctcaggagcctgccctgaacctgaggcccatgcttggttctggcataggattcaaatccctgcagcttcactgcagagcaggagctctgccagagagaatttcccaggtggagcaaggacagggctgtggagggcagggaaggtcctccctggggcctgagtccaggtgagccgcagacaggtgtgctcctgggaggacctagccagggagggagcagggtcttagtgagcgcggtgcggagttccaggaatggtgttttcaggtagtatgggggctgctggttgaccggttcctttgaggtcatattcctcatgcgtatcagtctcccttcctatatgttcctgtcctcctgggcgtcggagtttcccgttgcagcctctgccctgacccttgcccttggaccgtttccctcccctttcatccctgaaatcccagatctattctatttttcctcttatatcaaccctgaaaatgttgtctgtccgtttcctaagtcgtgtttccactcgctggtgtacggattgtcaggttctaccccatgcagctgggtgggcctctccggctccttcctgctcctgtaggtttcatcccccacctcccccaacagcggcttttagctgcctggggccgcccgcctgaccctaggacgagtgcggaatgaccccctctccacgcggagccctgagcgggaggcggcaggggcccaggcagcaggaactgggaacaagccgcccggcaggaagtttcgggtggctggaatttaggaagaagctagcctgagctcaaaacctcctgctaaacaaaccttaaggcgcgcatccggctctgtttcccacctgcaggttccgcattccttagcccagcaggcggggaggcgggagcggggtcagaattggtggaaggctggggttgcggggtgcagagagtgctgagccatgaagacttggggcagcgaggccgagtgatggcagagcctggggaggcgtccaggctgcgggggagcagggactttggagcaatgaccctggggggacactgagcacagggccagggtggcgtccaggggtctcgggtaggcctggactaaagaggcctgggaagagagacgtggggaggtcaaagggccctggtgagtctggatgaggagcagaggattgagtccccccagaactgagtccaatgtttttggggggagggacaaggaaacagtgagggggtgggggccatgtgccactgttcgagggacaaacccagctcagaggaaataaggcacgggggtgaggtgacaagggacatgggggtgacagggccatgagatgaggggtgtcgaggtcgggccaggaaaagatcaactaaacagccgggggaagtggggacccagggaagcaagacatggaggcatgagggagaaaaagggaggagggggagctcagcaaatcagtcactgccaggcgcctctaggagtctgattttgtggcaccttagtcatgttttcagagaagaggttcatagtctagaggatcccatggccacatggccaacacagggaggaagtggggtgaagagctggggtgcccatctgtggccccgcttccttgtgaggttcccacaggccctgtgggcacacagcccagctctgccctgaactcagggcctgcctgggtcctgtctcttccctcctgtactttctgtctcagctgagctgttcttgcctgcaccttagcacctcaggctgagtgggagggagaatcctaaactggccctcaagattctgccccctggggaacagccctgtgtatagaatccctttcaccagggtggcctggatctctgaatactttgggatctcactccccaagttacatgactttacattgcagttagggggttttgaagatgtaattacaacccctaatcagtctactgtaagttcatcaaaaaggagattttcctggagaggcctggtctaatcaggtgatccctttcaaagaagggctggaggctgggcatggtggctcacgcctgtaatcctagcactttgagaggccaaagcaggaggttcacttgagcccaggatcacttgaccccatctctacaaaaaatacaaaaattagacgggagtggtggttgtatgcctatagtcccagctacatgggaggctgacgtgggagaatcacctgagctcagggaggttgaggctgcagtgagctgtgattgcaccactgcactccagcgtgggcaacagagcaagaccctgtctcaaaaaaaataacaggaagaagaataaaaaagtgggctggaggtcagaagcagaagggatcagcgtgatgcaaggcagacagtctcctgcaggccctgaagaggccacctcctgtgctgtgctgctgtgccaccgctatgctgctctgccaccttgtggagggcctccaggaaggtttctgaagctgctgcgtgtgtggcaattggttacgtagcagcagaaaacaaatgcagctttctactcctccctctcctaccccacccctggatctaaccagttcctgatattctctaaccaaggatcaccctgcacactcctggacagccctggtgtgaaccctcactcaccctgggtggctgaagatggtttgggataataatgataatagtggctcctgatatctgttgggcactaactactgtgcaagtattttatgcccatgaagccatcccattttcacaacaactgcataaggaggcatatctagaagaggatctagcagccttccagttcaacttcatttagacatcaggatcccaggcccagaggcacaggtcatggtttccaagccccatagggcgctgttttcaactgttaggataatccagaacacctggagggcgctcctatgtgctatgagcaaagcaaaaacatccttcattcaacagactctccccaggctgagcctgcagaccccctcttgtgatagggtcagaattcagtttttaaagagcttagtgtgtagatactattgatgatctttgggagctgaagtgttcttgaactccaggcatagtaacatgttttaggttcatttatttgaagcattatgaaaggaaaatatatgttacacctcaaaaggagtttagattctctgtagttataactactgtatagtcacatgactattttctaaattttaagctaaatattcagtgtgataagatactcatttttgtacatgttatatccacttaactattaaagctggtcatttattacctcacatgcagtgttaagataatgagtaaattgttcataaattttcactactattattgggaagcatcatggcatgtaataaatcatcttttttatacatagaatgaaatcaaggctagggaaggtacatactactccattcgtgctgtgtggctaagaatggatctcatcgattgtgtataatggcaagatgagtactaaaaatatttgtaggatcaatacttgaatgttcataagcaagatgtcacaaatatcccaccattcctacaaattaaaataattttagtataatttttagacagcacatttataaacatgtgccaaatagaacatagccacctagcacagtgactggattggatgtagtacgtctctggattcctcctatgtgtttactggagatgtttgggaagtcacctagtcctttgattgttcatattctttatccatgtattagaatttcatagtaactgcttagctgatgtgtttcatgtaagttacagaattgtctattaaacatgctgtgctcattacctattataggatattgatttttgtctgtatatttgcccttctttaaaacattctagtacttttactttttagaacatgcaggagaatacgtagcaggaggagagcaaagatgacaccaacttttttcatttcttagcccttttgatctatgttatggatgaagatatagatgaaaattaaggctgagatatctgatatcctgatatctgttgggcacttttaatctgttgagaattttaattgttagatattttacttctgattatgtgaacatatacaatttaatgattaaaatattataaatttcatgcttaataataaatgtctttcatatatgactccatcaaatctttaaactttgcatatttatactgtgaaaaaaaatgaattaactaagcctccggctttctaaaatggaagcaggagaagcactcaaatctgctaaaggtcaagccacagaatgttccagtagacttggataaacaactgaagccaatgtccaccagccttcagcatctttcagctgggagtggcctcgttaactgaccaatcaaaacgagtttacaacttcggatttctgcccaacaaatcaactgcctttaaaaataacttttgtggaaatccttgattcaaaaatgtttcctgcacttgccttacaagacactcttcagggccgccctgactcactgtacctgagttgcaattctttgtttctcaaataaatgctatttcctttgacctccatgcccatcttttttagtgaacagcacagtatcgtaactgttattggtatccattattaagactgttggacctttcattgcttcatagaattatctttatcttgggcaagaaagtgaaaattatccatagtttctttaaaatagtaatattttaagccactcaaaataagaaaaagttaaagttcacaataaaaagatcctgatttacctgaataagacttgaaaagtgaagaacaattccttctacctgaaaagggtgttgacccagaatccaccttggacgaccctctagagctggcaagtcagcgtcatccccagtgcacctgtgactgacaacacatctcacccagctgccatagggatgtcaaagacacaggatacagtgctggaaagggaaaaagcatcagtgcaaaagtagatttcaggatttggagcacggaggcaagtgccctctcctggcatccctgcatggggccatagtgaggaggctctgcagtcttccaggaggactggaccatggataggaaatacccaagacatggattctctagggacatgggcgattccaaaagcaccgaggagcgtgcccctagagaagcagtccactgggtccgtagtaaaatctcatggcataaccaatgtggagaccagagactaaaaatctgtaacgtccttggtgtccatggacctcaaagccaaacacaacagccccacgagtatctgtcatccaggcacggagagctaggggcgagcttctaagggtaaaggaggcttcttccctgtccagatgtgtggacgcttgggtttacagataatggaggtgtctatgtatgttgtcatgaaaatataaggcaagtggcaccaaatatgatttagtggtcccagaaattcggtgctgtgtgctttctgcacgacattaattttaattatatggacacagaaggagaaaatttaaaacttaaatgtcttatcattgctagaaaaataaaagttttttccctacgagttagaagtcttgatctctgcgtttttctatggatcgattctcaaagtttgtgcaaatacagttggtgtttctttctaagtgtctttggttatgaactaaggatgtaaccaactcctgcttattaggtaaagggatgaggcaagagagatccagcaacagggtgtgtttttttttcaatctttggcaacatttttctgtgatgtccaaagtagtgaactccctgactagggtttcagacatggagtgttctaatccaccaaacaccaaagggctgggaagaagtgatttggacatggataaccagtgtcacctacaacatggaacagagggtcatcaaagtggtctgagtcactttaatatgtggctggagagatgcaagaacaacagaaagagccctcaggaggcatccccacccaagggcagtgaagctcagtgcagctgcggggtgtggggtcatagggtgaccaggtgacagggctgatggggaggagaaatgctctgttaagggtgttgtctctgtcacttcttcaaaaagcagcacagtctcaggcacatgctccctcctgccccaccccacccacaattgatccactgcagctcttccaagatgcttccctccattctagtacctccccttactcctgagcccctgtggcctctatcttactccctctctccagttctttgtaccttcctcctctccctcactcacctcccctcccatgcaaagcccctactggttcccccctccccacttcacctccactcacactccatcttcaccctccattccagtccttcccttcctctcctcactctgactccaccggtgaactcacttcccatcccttctgtccatgtccctgcctcagtttacctcccttcccctctcctcaccttccttggatgcacctgacctctcctgcctccctccccttcattcatgcccttcctttcttctctctccagttccatctcctccaacatgctcccctccccctttccttcagcctctgttgacctctccaccctcccacagtcccctgcactctcctgccaaggacatccctcccagccatccccgccctcctcacctcacctcgtttggctccatgtccctcagctccccttccctccctcttccctgtcccaagagccatctgggtttcctttccagtctccctctgcttgtgtgctttcttccccttccctgacttcccctgctctatcttctcctcagttccccgccctccctctctgcacctgcccagtttcccccatctcccctccatgctccctttctcagtttccctccccagctcctgagttggaccacctcagctcagcgccctacttcctgtgcctgcccctgcctgctgcccaccctccctgcacacagctcacttctccctctggccctcctgctgagcaagtggctccccgactgccctgggcctgcccactttccccagcccccgcagtcaaggctctccacatcaccggggtgagggccgagatgcaccctctccagggctctgcttcctccagcaggtcccagatcctccctccaagctaagctccatggcccatccctcccctgggggcaacaccacagggaccttttgcccaccttgccaggcttttcagaggcctcgaagctgtggtcaggcaggcaagtggggagcaagccaggagttacagatccagagcttggggcagtccaggcagcgggggctgtggtcccctgtgaccacttctgtgaccttgccacttgaaccctccagggcctatgtcctcacctccaacgtgaagatcaggctgggccattattgcaaagctgtgctgagtgttgacaaaggtgcatgtcacgctttattacaggtagctggtgtttcctgagcatttggaaacaacgccctgtaaaatactgtgaactaatcgcagagctgggcacagcatgcttcatgatcttattttatactgacgtgttttgtcatcgtgctgtcaagtattctccagccacatcatttgttagtagtttgacctgcataggagggcagtgtcaccctccttcctgctgtgctgatttcagcgagggcctccgggccagactgccccgtgcgccccctgttgactaacctgggaatcgcccgccgcctgccttgagccttgtgatgtgggcaggacggggccggggcagggccaggagcctgcggggaggcgcggggccaggcgcctgcaggagtggaacctgcccaagatctaggagtagctcggtgcaggaccaggacagagttcacacccctggcttcacgtacacgtattttttttttttatactttaagttctagggtacatgtgcacaacgcgcaggtttgttacataggtatacatgtgccatgttggcttgttgcacccatcaacccgttatttacattaggtatttctcctaatgctatccctcccccagccccccatctccctgacaggccctggtgtgtgatgttccctaccctgtgtccaagtgttctcattgttcaattcccacttatgagtgagaacatgcagtgtttggttttctgtccttgtgatagtttccagcttcatccatgtccctgcaaaggacatgaattcatccttttttatggctgcatagtattccatggagtatatgtgccacattttcttaatccagtctatcattgatggacatttgggttggttccaagtcttttctattgtgaatagtgctgcaataaacatacagacctacacataaattaaccggtgtgtgtcaggtgtagataccagccaagaagaaaagacaaagtcagcgggggcagctctaggacagcgatgacctgggtcgcttcattctgtgcctggggaagaaccaaagccacttggagattaacgccatgacaaaaacaagggatgacgtgtgtgcagttgtgggtttcatgtttactttccacgactctagaggacttgcccacctgttcatacataaaccagtgcccagggccccactgcccggtgagggctccatctcccctatcaccccaccccctgcttagctcctggcccgccccaaccatcccttagttgatgagttggtgaagctgccccctttttcctccctataccttctcttctctcccccaggtcctgctgggccacagtcttcggtctctctgccccacctgccgaaggacccccctggtctcttgggtcctcacctgcatgctcccgagctcacctctaagttgtgtctgcccttcacaaggctggccccctgcagcccaccccctcacctggggcaccagggccatccacttcctccactctcctcacactcccgaagtgactcagggctcccctgagcagctgggctggagtcctcccaccaactccctcagttatacctgctcccgtcccctcagacccagccccccaggtctccagacccattcatggacgtggcctcctaggcctctcaacactcacctcccagcaacccctcagccctgccctccccaggcaccaacttgggacccccacagaggcagagacacctattcccacttgggctcatgtcaccctggctcactggggatgctgagcctgtgagcccaatcttgctccatccctccagttcctttctccaatccaagttctctcagacctgtggtgtcactcccagaagccatctggacacccaaggcactgcctgacggagatggccatgctcttccctgtagggatggacaagggacacctgcagtgcacaggtcacagtctcaacctttggaatggtgtggcaggctgtgccctagtagggcccccaccagggcccctgaatggctgctccccatcagtaacaaggaagacccttgatgatcatccccactgcctctgagatgggcccggaaaggcgtgagcttctcaagcacctgggtcaccatctgggaaatggcagtcatgatcaagtcaatcccttgtgccccagagacactgtaactccccagtagaatcccacagggattgaggccaccctaggcaacatagcaaggttccatctctacaaaaaataaaaacatagccaggagtggtggcacacacctgtagtcccagctattcgggaggctgaggcgggtggatcacttgaggccaggagttcgaggctgcagtgagtagtcattttgctactgcactccagcctgagtgacagaaggggaggagagggagaggggaagggagggaggagtgaggggagggagggagaggaggggagaggaggggagggagagagagaaggagaggagggaaggggagggcaggggagggagagagagaaggagaggaggggaggaagaagaggagaaagaaggaagaaggaagaagaagaattccagagagtgaagagccaccaagggtatccccacactctgtgcaagcgtctatctgcctgaaacatacatgtgtgaaactcactgttggcagcacaatcaagacggaaaattagacctgagagcagcctctgtggtctttgagagggacccaggggatgaccagaggcagggaggctccatgggagggagaaacacaagtagatggccttctctgtggcttccagcctggggcaaagggtggtcagtctcgagatgcccagtaggggaaaggctcgtgtgggaaaagggaaatcaaaaatcctgccacctgcacagcacaggggaatcacccaaggctccaaagggtcattactgtgatgtctgtagcataacatccacatcgctgtaacatccacaggggcctccttaacaccatcaggctctggaatcggagagcagaagcttcacagctgtagctgaagtgggtctgagtacagactaatctctatcgtgcagcttactattatccctcctttagggacatggtcattttaaaatattttattttgaaataattatagaacttatagaaaactgcaatagcagcataatgggtgcctgctcccttcacccagctcccccagggcttctagttttgccatgtgtccccacctcgctgaccagccccagtagacggcaccaaaggcaggcaggatcacacactcctctttgctcaaaacactcagggatccttcctgccccacacaccctctccatgcacccacattctctgcccaagggtggcctggcccccaggcccagctcatccccagcatgtgactcctttcactcaggctgtggatctcatgtattgcaaatgtggtttaaactttgagaacagcaattctggtttgtagaaaaaaagtgaggatctaggcgtttgcagtcatgcacatgttcgtattttaaatacaggccaatgagctgctgcctagtgtgcctaccagagacacacctgttgttaaactacaactggatttactgttccattctgcaaaaatacgccatggtgctgtggagggtgcagtgagaggcttggaagagccttgccacaggctgtgtgtgtgtgccagctggccatgggtggactaactggagaggggctggctctgagttgagcactgttaggaagcaggaggaggtaggtatacactggaatcttcataaacctcatccccggggaggcctgacacgggcaggacaggctatcaccaaggccaaagcggcagtcatcatgtgggctgggagaggacacggctggcactcctggcctgagagatgctcccatctgtctgtattcagacaggattctggagtggcttgtctttgtcttgatcagaccatctggggtcttgcctgctgctggtgtcctgagggacagtttgtgttctccaggagagccccacaacctcactgagggtgccagcccagctcctgggacacagccaccctcctccttctcaagctttaatgagaaacgggcaggaggttgccggagaaccactgcccatcttccggggtgctaggggtgtctgctggcagttgtggtctagggcaaaaagagaagggaagggaaaatctttcagaaaataacggaatcacaatggggctgcaggcgagatgagcaaactgggctggtggcatccagggcgttagcaaagaaaaaagcaccagtgttcaggcagccagggagcccagccgctctcttagggtcaccccctcccagccctccggaggccacccttgtcccgccctgccccaagggcacagcccgcgcccctcccccagtcctctccctgctgggctgccccctcccgcggccgcatccctagtcagtccctgagaccgtccagagttcagtccccgggatcaggcttgcagtgttgggccgccctccttgccagatgccgccctggagagggcaagggcgcagaaagggctgagcgtcccgggtccctgcgtggccgaacggcatgtgagcacattccaggaataaggaaacgagaggagtaggcatttctaccgtctaaggcactttgcatgaaatcccgtggcactggaaaagtagttcaaacaaagtaacgctggcttttacgatgcagataaacggataagcggcgtaggactcaagtaggagggctccgtgcacaccaggcgcagcccagcggggatttgcctgcgcgtcccagcgcacagggaggtcgctgagtcccagggaagccccctgggctcgcgctgcaaactcaggcagcctctgctcctgccctacggctttgagggcacgtgctcctccggggaggcacagcttcctctaatttcccacttcctcatccggcccttaattcactaaagactaacagggaatgatgttcattaccaaagtaggtgctccccctagtgtagcacagaacgcggcgctgttctcactattgaattggaataatatttttagtatcaaaattaattctagaaatctattacagttcattttccagaaaacaagggtagcaaaaatagtataggtttgtttcttaatttctttatgacacacatcactggttcatgtgataacgtgtggattctcacctggaagacacaagaggaataaaatcaccatattttaaactctatctcaagtctctcaacatttcaggctgtgctcatttacacactacagaatgatgagtattcagtggaaacttttgcagaacaattaaaattgcaaaatcggagccgggcgcggtggctcacgcctgtattcccagcagcactttgggaggccgaggtgggagtatcgcttgagcccgggaattcaagaccagcctgggcaatatagtgagccatcatctctaaaaaaaaaaaaaagaaaaagaaaaaattgcaaaattacctaaaatgaaatgcatacattgaaacgcccacaattattatgaaaattaaagttaatattaacaacatatgacatgagccacaagatttacattaaaatagtctagttgacaataacttgaatatttaaataaagtcctctttatctctaaataatatatttacagtctgccattatatgaatcacttaaaattcagatgaggatattaatcaatattgacaatttcttcaggaatatcaagtgaataataatgatttcacttttttgtttcattttgtttttgacataagatcttgttctgctgcccaggctggagtacagcagcaggatcgtgactcactacagcctctgccttctgggctaaagcagtcctcctacttcagcctcctgtgtaactgggaccacagatgcacaccaccaggcccaggtaattttttattttttggtagagacagagtcttattatgtttcccaagctagtcttgaacttctgggctcaagcaagcctctcacttcagccacccaaaatgctgggatgacaggcatgagtcaccatgcccagcataaagattttattatgtggaaataaaaggacattaaaatataacttgaaataacccatttctcgcaagtatttatttttccaccagttaatcaaatagtgccaacactagacaccaaccccacttccattgctaatcccactaatacactcaccaagacttcaattcctgacccccatgtctcaggatactcctcaatagccattgccatagtatatccaaaaacaaccatcgtaccccctagataaattaaaaaaaaccattaaacccatataacctcccccataattcagaataataacacacccaactacaccactaataatcaatactatacccccataaataggagaaggtttagaagaaaaccctacaaaccctattactaaagccacacttaatgataataaagcatatgtgattaatcccacatggattacaaccacgaccaatgatatgagaaaccatcattttatttcgactataagaacaccaatgaccccaacatgtaaaactaatccactagtaaaaataatcaaccactcacttatcgatctccccgccccatccaacatctccatatgatggaacttcagcttgcttcttggtgcctgcttaacccttcaaattattacaggactattcctagctatacgctactcaccagacgcctcaaccgccttctcctcagtcgtccacatcactcgagatgtaaactatggctgaatcatccgctacctccatgccaatggcgcctcaatatttttcatctgcctcttcctacatattggccgaggcctgtactatggcttatttctctacctagaaacctgaaacattggcatcattctcctactcacaaccatagcaacagccttcataggctaggtactcccatgaggccagatatccttgaggggccacggtaatcacaaatctactgtccgccattccttatgtcggaacagacctggtgcagtgggtttgaggtggttattcagtagacacacccactctcacacgattcttcaccttccactttatcctacctttcattattacagccctagtagtcttacacctactatttctccatgagacagcatcaaataacccctcaggaatctcctcccactccaacaaaattaccttccacccctactacatgaccaaagatatcctaggcctatttctcctccttctcaccctaataacactagtactgttttcacccgacctcctaactgatccagataactacaccctagccaaccgcctgaatactccaccccatattaaacccgaatggtattttctatctgcctacgcaatcttatgatccatccccaacaaactaggaggcgtactggccctcctactatcaatcctcatcctagcagcaattcccacacttcacatgtccaaacaacaaagcataatattctgtccactaaaccaattcctatattgactcctaattacagatctccttatcctcacatgggttggaggacaaccagcaagctaccccttcatcaccttcggacaaacagcattcgtagtttactttgctacaattctagccctgataccgcttgcctccctactcgaaaacaaaatactcaaatggacctgcccttgtagtataaaccaatatattggtcttgtaaaccagaaatggagactctctcccaaggacaactcagagaaaaagtacttgacttcaccatcagcacccaaagctaagattctaatttaaactactctctgtattctcatgagggagccattttgggtacaacccaagtatcgacccaccccaccataattttatatatatcgtgaatttctgctagccaccatgaatattatatagtactataattgcttaactgtacatagtacatatcaaacgaaactcaacaacaactcctccccacgacgcttacaagcaaggactagaataccttaactaacggtaacacattaaacccaccctccaaaagaaacttctcaaccacaagcgtaccaaaaaacactatatatccttgagtacatagtacatctaatcgctcatggtagatagcacattccagttaaacaagtcctcgtcaatacggatatccccctcagatagtggtccgttgttcaccatcctctgtgaaatcaatatcctgcagaagagtgctactcttcttgatccaggtccataatacttgggggtagctataatgaactgtatccggcatcttgttcttacctcacagccataaagtcaagaccaaccacacgttccccttaaataagacatcacgatggatcacgggtctattaccctattaatcagtcacgggagctctccatgcatttggtattttaatctggggggtgtgcacgcgatagcattgtgaaacgctggccccagagcaccctatgtcgcagtgtctgtctttgattcctgccccatcccattattgatcacacctacattcaatatcccaggcgagcatacctatcacaaggtgttaattaattaatgcttgtaggacataacaatcagtaaacacacccacggccgcttttcacatcaactctacaataaaattctgcaaatccccttcccccatctttggcctcaccaacccaggaaaagacatctttgccaaaccccaaaaacaaaaagccttaatccaactcaaccagagcccaaatttttatctttaggctgtacgcatttttaacagtcacccctcaactaacacgtctttttccctcttagcctcacttcacagactctacaaatttagttatccctttttcagccatcccattcaacgcatgcccgaccactactaaaccaacaccctaaactaacccaaccccaaaggcaaggctttcccccctacccattgcttgtatgcccatcccctagccttgcttacactgtgcaatcacagtctatgtagcttaatgacccaaagcaagacactgaaaatatctagatgggcctacactgccccatagacaaataggtttggtcctagcctttctattaactcttagtaagattacacaagcaagcatcgccaccctggtgaaataaccctctaaatcactacaatcaaaaggagtaagtatcaagcacgcattagtgcagctcaaaacactttgcctagccacacccccacgggagacagcagtgataaacctttagcaataaacgaaagtttaactgagctatactaactttagggttggttaatttcatgccagccaccacggtcatacgatgaacccaagctaatagagactggcgtaaagaatgttttacattatccctcaataaagctaaatttcacctaagttgtagaaaaccctagttgatataaaacaaactacgaaagtggctttaatatttctgaatacacaatagcgaagattcaaactgggattagataccccactatgctcagccctaaacttcaacagttaaatcaacaaaactgctcgccagaacactaggagcaacagcttaaaactcaaaggacctggcggtgcttcacatccctctagaggagcctgttctataatcgataaaccccaattcacctcaccacctcttgctcaacccatataccgccatcttcagcaaaccctgacaaaggccacaaagtaagcacaagtatctacataaaaatgttaggtcaaggtgtagcctatgaggtggcaagaaatgggctacattttctaccccagaaaattctacaataacccttatgaaacctgagggtccaaggaggatttagtagtaaattaagaacagagtgcttaattgaatagggccataaagcacgcacacaccacccatcaccctcctcaagtatatttcaaggactatctaactaaaacccctatgcatttatatagaggagataagttggataaaccaaggtgtagcttaacataaagcaccctgcttacacctgggagatttcaatttaatttgaccaccctgagctaattctagccccaaacccaactaattctactaccaaataacctcaactaaaacatttacccaaataaagtataggcgatagaaatgatatctcggcacaatagacataataccgcgatggaaagatgaaaaaacataaccaagcataaagtagcaaggacaaacccctataccttctgcataatgaattaactagaaataactttacaaagagaaccaaagccaagacccccgaaaccagacgagctacctaagaacagctgaaagagcacacccatctatgtagcaaaatagtgggaagattcataggtagaggtgacaagcctaccgagcctggtgatagctggttgtccaagatagaatcttagttcaactttaaatttatctacagaaccagctaatgcctttgtaaatttaactgttagtctaaagagggacagctctttagacactaggaaaaaaccttgtagagagagtaaaaaatataacttccaaagttggcctagaagaagcgatcaattaagaaggcgttcaagctcaacacccaaccacccaaaaaattccaaacacataactgaactcctcacatcacattggaccaatctatcatttcatagaagaaataatgttagtataagtgacatgcaaacattctcctccgcataagcctacatcagaccaaaatacttcactgacaattaacagcccaatatctataaataatcaatgaaaccattattacccacactgttaacccaacacaggcatgcttacaaggaaaggttaaaaaaagtaaaaggaactcagcgaatcttacccctcctgtttatcaaaaacatcacctctagcattaccagtactagaggcaccacctgcccagtgacatatgtttaatggctgcggtaccctaaccgtgtaaaggtagcataatcacttgttccttaaatagggacttgtctgaatggctccacgagggttcagctgtctcttactttcaaccagtgaaattgacctgcccgtgaagaggcggacataatacaacaagacgagaagaccctaaggagctttaatttatgaatgcaaacaagaccaaataggcccgcaggccctaaactaccagacctgcgttaaacatttcggttggggcgacctcggagtataacctaacctccgagcaacatatgctgagactataccagtcaaggcgaatatccacatacaattgacccaataatttgaccaacggaacaagttaccctagtgataacagtacaatcctattctagggtccacatcgacagtagcattaacgacctcgatgttggatcaggacatcccaatggtgcagccgctattaaaggttcgtttgttcaacgattagagtcctatgtgatctgagttcagaccggagtaatccaggttggtttctatctattctacatttcttccagtacgaaaggataagagaaatggggcccacttcataaagtgcccctgccccatagatgatattatctcagcattttactgtacccacacccacccaagaacagggtttgttaagatggcagaccccagcaattgcataaaatttaaaactttacaaccagaggttcaacccctcttcttaacaacatgtccataactaaccttctacttcttattgtacctatcctaatcgccatggcattcctcatgctaactgaatgaaaaatcctaggctacatgcaactacgcaaagggcccaatattgtaggcccctatggactattacaaccttttgccgatgccataaaactctttaccaaagaatccttaaaaccctcaacgtcaactgttaccctctacatcactgccccaaccttagccctctctattgcccttctactatgaactcccctccctatacctaaccccctagttaatcttaacttaggccttctattcattctggctacatccagcctagctgtctactctatcctatgatcaggatgagcatcaaactcaaactatgccctgatcggcgcattatgagcagttgcccaaacaatttcatacgaagttaccctagctatcatcctattatcgatcctactaataagtggccaattcaatctctgcaccctcattagaacacaagaacacctctgactactcctaacatcatgacccctagctataatatgatttatttccacactagcagaaaccaatcgagctgcttttgaccttactgaaggagaatcagaactagtctcaggcttcaacattgaatatgctgcaggcccattcgccctattctttatagccgaatacataaatatcattaaaataaatgccctaactgccataatcttcctaggtacaatatataatattcacctaccagaactctacacaatatgcttcaccattaaaaccctattcctaacctctctatttttatgaatccgaacagcatacccccgattccactacgatcaactcatgtatctcttatgaaaaaatttcttaccatttacactagcactacttatatgatacatctcaatatccgctacaatttccaacattcccccctaaacttaagaaatatgtctgacaaaagagtgactttgatagagtaaataatagaggtttgaatcctcttatttctaggaccataggaattgaacctatccctgagaatccaaaattctccgtgccacgtgtcacaccctatcctggagtaaggtcagctaaataagctatcaggcccatacccagaaaatgttggttatatccttcccgtactaatcaatccactggcccaacctgtcatctactccaccgttttcacaggtacactcattgcaacattaagcttgcactgattttttacctggacaggattgaaaataaacatactagcttttatcccaattttaattaaaaaaataaacccccgctctacagaaactgctatcaaatactttctcacataagcaaccacatctataatcctcataatagctatcctctccaacaatgtactctccggacaatgaaccacaaccaacaccaccaacaaatactcatcattaataatcacaacagccctagtaataaaactaggaatagcccctttccgtttctgagtcccagaagtcactcaaggaacccctctaatatccagcctacttcccctcacatgacaaaaattagcccctatttcaattatatatcaaatctccccattaataaacattctccttaccctttcaatcttatccattatagtgggtagctggggtggactgaaccaaacccaactatgtaaaatcctagcatactcctcaatcacccatataggctgaataatagcagtactagcatacaacccaagtatcaccattttcaacctaatcatctatatcattctaacaaccaccacattcctggtactcaacttgaactctagcactacaaccctactactgtgccgcacttgaaataaactaacctgactaatacccctaatcccatctaccctactatcactaggaggccttcccccactaactggctttctacccaaatgatttatcattgaagaattcacaaaaaataacaacctcattatccccactaccatagccattattactctctttaacctatatttttacatacgcttaatctactctgcttcaattacactattccccatatccaacaacgtaaaaataaaatgacaatttgaaaatacaaaatccacaccactcttccccacactcactgtccttaccaccctcctcctaccaatctctccacttacactacccacctcatataaatttatgttaaacgcagactaagagccttcaaagcccttagtaagttaataatacttaatttctgcagcacccaaggactgcaaaaccctactttgcatctactgaacgcaaatcagccactttaattaagctaagcccttgctagatcaatgggacttaaacccacaaaaatttggttaacagctaaataccttaatcaactggcttcaatctacttctcccgccgcaagggaaaaaaggcgggagaagcccaggcaggattgaagctgcttctttgaatttgcaattcaacatgaaaggcacctcagggctggtaaaaagagagtttttagatttacagtctaatgctttgctcagccatcttacccactaatgttcgccaaccgctgactattctcaacaaatcataaagatatcggaacactatatttattgtttggtgcatgagctggagtcttgggcacagccttaagcctccttattcagactgaactaggtcaacctggcaaccttctaggtaacgaccacatctacaacgtcatcgtcacagcccacacattcttcataatctttttcatagtaatgtctatcataattggaggttttggcaattgactggtccccctgataattggcgcccctgacatggcatttccctgcgtaaataacataagcttctggctccttccccacccctttctactactgctggcatctgctatgatagaagctggtgccggaacaggttgaacggtttaccctcctttggcaggaaactattcccatccagaggcctctgtagacctaaccattttctcccttcatctagcaggtgtctcctctattctaggagctattaatttcatcaccacaattattaacataaaaccccctgccatatatcaataccaaacgcccctctttgtctgatctgtcctaatcacggcagtcctactcctcctctcccttccagtcttggccgctggcattactatactgctaacagaccgtaaccttaatattacctttttgacctggccggaggaggggaccctatcctataacaacacctattttgattctttggtcaccctgaagtctatattctcatcctaccaggctttggaataatttctcacatcgtaccatattattccggaaagaaagaaccattcgggtacataggtatggtctgggctataatatcaattggcttcctagggtttattgtatgagcccatcatatattcacagtagggatagatgtagacacacgagtttactttacctctgtcactataattattgccatccccactggcgtcaaagtatttagctgacttgctacgctccatgggggtaacaccaaatggtccaccgcagtactctgagccctaggattcatcttcctttttacagtgggtggcctaacggacattgtactagcaaactcatcattagacatcgtactacatgatacatattatgttgtggcccactttcactacgttctatcaataggagctgtgttcaccatcatggggggcttcatccactgatttcccttattctcaggctacacactcggccaagcttatgccaaaattcactttgccatcatatttgtaggcgtaaatctaaccttcttcccgcagcactttctcggcctatctgagatgtcccgatgttattccgactaccccgatgcatataccacaggaaatattttatcatctgtaggctcattcatctccctaaaagcagtagtgctaataattttcataacctgagagaccttcgcttcaaagcgaaaagtcctaataaatgagcaaccttccactaacctagagtggctgtagggatgccctccaccctaccatacatttaaagaaccagtctacataaaacctagacaaaaaaggaaggaattgaacctcctaaggctggtttcaagccagcctcataacccctatgactttttcaacaagatattaggaaaactatttcataacttcgtcaaagttaagttacaggttaaaccccgtatatcttaatggcacacgcagcccagctaggtcttcaagacgccacatcccctatcatagaagagctaatcgccttccatgatcacgccctcataatcatctttcttatcagctttctagttttatacgccctcttcctaacaattacaacaaaactaacactaacatcacagacgcccaagaaatagaaactgtttgaatgattctacctgccattatcctagtcctaattgcccttccatccctacgtatcctgtacgtaacagatgaaatcaatgacccttcttttaccattaaatcaatcggacaccaatgatactgaacctatgaatacaccaattatggaggattaattttcaactcttatatacttccaccactattcttagacccaagtgaccttcgacttcttaaagttgataatcgagtagtccttccaattgaagcccctgttcatataataattacatcacaagacgtcctacactcatgaactgtccccacattaggcttaaaaacagatgtaatccccggacgcctaaaccaaaccacattcaccgccatacgaccaggagtatactacggtcaatgctcagaaatctgcggagctgaccatagcttcataaccatcattctagaactaatcccgctaaaaatctttgcaataggacctgtatccactttataggctaccgcccactctcttaataaggttcactgtagagctgacccagcattaaccttttaagttaaagactaagagaatcgctatctctttacagtgacatgcctcaactagacaccaccatatgacccactatcgtcgcatcaatactcctcacattattactcatcattcaactaaaagtactaaacacaaactaccatctgcctacctcactaaaaattattaacatgcaaaaccacaataatcctttagagtcaaaatgaacgaaaatctgtttacttcattcattgcccccacaattctaggccttccagctgcagtgccaatcgttctatttctccccatgctgattccagcttccaaacaccttatcaacaaccgattaattaccactcaacagtgactaattcaactcaccctaaaacaaataataacaataaataacattaaaggacgaacctgatccctcatgctaatatccctaattatcttcattgctacaaccaatctcctcgggctcttgccccactcattcacaccaactacccaactgtcataaacctggccatggcaatccccctatgagcaggtgcagtaattacaggcttccgctttaaaaccaaaaataccttagcccatctcttgccacaaggcacaccctcacccctcattcccatactaattattatccaaaccatcagcctatttatccaaccaatagccctagccatgcccctaactgctaatattatggcaggccatctgctcatacacttaatcagaagcgccacactagcgctatcaactatcaacctccccacaacctcaatcatcttcacaattttgattttactgacgattctcgaaatcgctgtcgccctgattctagcctatgttttcacactcctagtgagcctctacctacatgacaatacataatggctcaccaatcacatgcctatcacatagtaaaacccagcccatgacctctaacaggggccctttcagccctcctaatgacatccggcctagctatatgattccacttttactctaccaccctactaacactaggcctactgaccaatgcactaaccatataccagtgatgatgtgatgttgtacgagaaggtacataccaagaccaccacacagtacccgtccaaaaagtccttcggtatggaataattttattcatcatctcagaagtctttttcttcgctggattcttctgagcattctaccactccagcctagcccccacccctcaactaggaggacactgacccccaacaggcatcactccactcaaccccctagaagtcccactcctaaacacatctgtactactcgcatcgggagtttcaattacttgagctcaccatagcctaatagagaacaattgtaatcaagcaattcaagcactacttatcacaatcttactaggcatctacttcaccctcctacaagtttcagaatactttgaagccccctttactatcgccgatggtatgtatggttcaacatgttttgtagctacgggcttccacgggctccccgtcatcattggttcaacattccttactgtttgccttatccgccaactattatatcattttacatccaagtaccacttcggcttcgaagccgctgcttgatactgacactttgtagatgtagtttgactattcctatatgtctctatctactggtgaggatcttactcttttagtatagacagtaccactgacttccaattaactagtttcgataacactcgaaaaagagtaataaacctggcactagccctaacagtcaacaccctcctggccccattactaataaccatcacattttgattaccacaacttaatatctacataggaaagtctaacccttatgaatggggtttgacccactatcctctgctcgcattcccttctccataaaattcttcttgattgctatcacctttttattatctgacctagaaattgccctattactacccctaccgtgagccctccaaacaaccaatctaccactaacagttgtatcatcactcacattagttactatcttaatcctaagtttgacttatgaactatcccagaaaaggttagactgagtcaaattggtaagtagtttaacagacaaaaacaatgattttgacttgttagattatgatagtcatacttacaaaatgcccctcatctacataaacattacattagcatttactacctcactgttaggaatactaatctatcgctcacacctaacgtcctccctactatgcctagaggggataatattatctctattcatcgtaaacaccctcataaccctaaacacacactctcccttaattaacatcatacctatcaccatattagtctttgctgcctgtgaagcagcagtgggcctcaccctactagtctcaatttctaacagatacggtctagattatgtacataacttaaacttactccaatgttaaaattaattatccctacaatcatactacttccaacaacatgactctctaaaaaccatataatttgaattaacataaccactcacagcctaattaacagctctatcccactgttatttttcaaccaagccaacgacaatctatttagctactctctttctcctctgaccccctgatgacaccccttctaatactaacagcctgacttctacctcttatgatcatagcgagtcaatgccacttatctaacaagtgccccttacggaaaaaaactttacctgtctgtactaatcacccttcaaatctccctgatcataacattcatggccacagaactaatcatattgattattagtggtgtagttgggtgtgttattattctgaattatgggggaggttatatgggtttaatagttttttaaatttatctaggagtatgatggttgtttttggatatactacagcaatggctattgaggagtatcctgagacacgggggtcaggaattgaagtcttggtgagtgtattagcgggattatcaatggaagtggggttggtcttatgagtgaaggagtatgatggggtggtggtagtggtcacattctttgctgaacaaacggtacctcaaataacttcatacaaatactactgggaaacttagcattttattaaaatgtttaaatttcctattttatcaaatctaacatattagtaataatatattccttttattcaactttaaagttctattcaacaatagcaatttataattttatattattaaatgttattcatacagtttaataattttataatttagcattaatgaaaccagcacagacaatataatgttcatgatattttatgtatatgtttaacatacacatacataattcaacattaatggcttccttaattaccattaatattataattttatattatcatttaagtttgcccttctattttaatattagatgtcttagcatccatcagttctatcaagctcttctcactggttcttctttgaattccagacatggccacaatcttctcttctaaaattctaaaatctgagggctctcgctggctgggtgctgctggaagaactgtaacttggttgttatctcaacggtattttattttaaatgtttcaattaaaagaagtttttaaaaatgtggaaatccctgagaatattcacttttttaaatacaatgggaatgtatttaatgtatggctgaagtctgtttctcctcgtttgatccaggggtgcttctgagaactcttccaagtgccagatcctgggccgctggcagcttggccccagtggcagttcagttaccccatcacggctggggcaccaggggagccccacaggtgggcgaaaattaccgtagattaaaacctaggcagtttaacacaagcagccagcaccaacatcacggtacttgatcttccaacttcctgcactaccaattctatgtctcatcacattctcctctggcctctcggcccccagcacacaggcttcagcctctgtttctgctgaagccctttcttcatacactctagaacatagaacataggacagagagagagactttagtaggaatactgacatttaaaaacttatcagagatatgaaaaatcaactacatgaagtacggcggtatattaaggctttgtgaataaaaacacagtaaagggtgggtgtgtaaagctattttccaaccatccttccaaaccaaggcttttgagggcacaagtcctcccagcaggtggcaggatgggcccagcagtgtcttcagcccattgctgtcatgagttaggaaaggctgaattctattttacatacaaaagaaaacatttatttaattaaagattcaagctacaatacagttcttcataaaacactacaatattttgattatcaatgtttttctgttgctttttctcatgaaacatgatttgcctttgtgaaatctgaagtttcctattctatcaatgagaaggtgtatcaaatggatagtccatccagtgtatccgacatcaattacaaaatgcctccctttttcttaattttgccttttttccctttgtcattcttgagtctctgttagtgcactgaggaagtgaagacatgtacttaaagaaatgccaacatctgctgaagatcagattccgtattttgtattttagttgatgtaatgatgactttagttataatgactttagttgatgtaatgattctaatgaacaagaaagattttgtttcccattttaaaagatatcattaagtcatgcagaatatttttcaatttattatgggtgtgtatgcaaggggttgccatttcacctgcttcagtcttccctctaaaccaatcctaagacacacctaggctgaattcatatcacatgaaaattcatcacatgatgtcctactaggtcaaaaagtataaaaactgacattacggagaaagacttcattgaaaccaggacagaaagacactaaggcacacagtgctcagagcggcatgctgacaagatctctggtgggaggccattgcctggacacctgctgggttttgtcctggacaccattcattcacttgagcatgtttggtacccagggtatttttcaataataggcaaaatagaatgagttcttcaaaccttgtggattttatactgaaaacttccagagatatatcttaggtaattataagaccaagcacaacaacaacaacaaaatcctaacttgaatccatcagttgcagatttcatggttgactacatcaagaggaagttgcaagctctaaaagctggaagaccagtcaatatcaggaactcctcagaagtgaaggaaaagtggtttaaatttgtttaacaaaaccatgttttcaaacttactttaatttatgcatgagggccattaaatttgttctttttaaaaaggaaacttcttaattggaactaaatcattcattattcactgtgatacgggttatatacccttaggttccatgtgattattcacatgttcagctgacagaaaggagaaaaagctactctaatgacttagcttcgctttgactcactggtttttatctcattttaacttccaatctcggttacagagagtgttaaagctggaagaaataacattttggtagatggtaaaggataagtacgagtcatttcaagttgttgaagctttcattaaacaaagcaagctatttgaaatcttaaagctatttaaataaagggctaagacttttccgttttatttacttaaaagcttaaaagatactgttgaaaatttaacagttaatctattgtagggtgtggttagacacttattttgacagtgctcactgaaaattcaattatacccccggagtcaaacttgccagtcatcaaaatgtctaacgatctgagtgttcacggggtaataacaaaccccatactaaacagtttgctagaaatctgtcctataacatctaaacggaacaattgggtggttgtctaagacacctaagctcaatatgacatttcagctaaaaagagtgaacttataactaagcacttcatgcaagttaccaaaagagaagatattctttaataaaaaagtacatttgtagaatcaaagaatctcagtgttgtaagaaatatttgagatcatttcagttaggcttttcatttcttaaatttgaaactgaagctgagattaaacagctaataaaaagacaaagccgatccatgatattggtttgggcaatgatttcttagatatgaccaaaacgcacatacaacaaatgagattacatcaaactaaagagcttctatacagcaaagaaaacaattaacagagtgaagagtgacaactcacagactgagaaaaaatatttgcaaatcatatgtttgataaagagctaatacacaaaacatacaacgaattcaactcaataacaataaaacaaccttgttaaaaaatgggcaaaagacctggacagatatttctccaaagaagacatacaaatggccagaagagatattaaaaggtgttcaatatcaccattgattagggaaatgcaaattaaaatgagatttcaccttactcattttagaatggctattacaaaaaaaatgaaagacaagtgttggtgaggatttgaagaaaagagaacacttgtaaaatgttggtgggaatgtaaattagtgctgccactatggaaaacagaagggacgtttctcaaaaataaaaatacataattactatatgacccagaaattctacttctgggtgtatattcaaacgagttaaaatcagtatgttgactagatatcaacacttccatgttcattgcagcattattcacaatagccaagatatggaagcaatctaagcgcatatcaagggatgaatggataaagaaaattatatacacatatttatagtgtatacacacaatggaatactattcagcctttaaaaaggatacaattctgtcatttgtgaaaacaaagaaaaatctagaggatcttacataaagtgaaatcagtcaggtacagaaagacaaatacatcatgatctcacttacatgtgaaaagtaaaaaatgtcagactcatagaagtaaagagtagaatgatggttaccagaggctggaggaggcaggatagacagaaaaaagaagattaatttgttaaatggtacaaggttcagctagatagaagaaataagtcctagtgatctattgagcaatagggtaattatagttaataataatgtattatatatttcaaaattgtggagtatattttaagcactctcaccataaagtagtgataaatacgtgagttgaaagatatgttaattcacctgatgtaaatgttccacaatgtatacatgtatctaatcatcatattgtatgccataaatacatacaatacttaattatcaaataaaaagttaagatggagctgagccaagaatccaagtctctgaatttagatttttcattttctattatgccaaagtgttttctgaaaattaaaattgaatatggcatgtccaaaagaatatgtcataagaagacaggaatggggggactgctgcatataatctcatatttttagtcagttttgtaacatattattaggagaagaaaatcaaatattttaagaaaatttttataactcctgtaatactgtaattttatggcaaacctaaaaccttcaaaacacagagtttttttaaaaaagtgaatcatatatatgcaaagtttttattgagattattaaagcaaaatccctcaaagtagcaaaacataagtatatgttttagactgtactatgcagaatagcagaatggtaccaatggcaaaaaatctttcaaaagacataaaaattattgaggtctcatcccagctctactaatctatgtcttagcaacctagtgtaattcctacaagttctgaacactgcctttaatgtatctgcatggttcccatatcattttataaacttcaaatattcacactttataattgaaacaatatacaaactttattattaaataagctatgggatgatattctccatctaccctataaggatactatcttcctgtcagaaaatctgagactctccaatacatatttactccccagatcttttctttttcttttttttttttttttttgagacggagtctctctctgtcgcccaggctggagtgcagtggcacaatcttggctcactgcaagcactccccatatcttaactgtggaatctccagaccatgtccagtcagtaatccattattagttttgtctcatgtgccctaaccaccttctctttaccttctatttcagccccaaataaaagttactattcttggctcaattctccaaatcctttgaaggtaactggtgacactatagcttttctttatgtgccaccttgtgatccaggcttcctagttatctgtgaatattcacatcaggttacctggactccatagaggcagcaccaacaaaaaacataattgggatatacaccacttttagactttcgattacatgccccaccttataatgtgtgaactgatttcacttctagacattcaactttcaaacaggtatgctctgtattaaacaccaacatcctccttccctttcactcaagggacatcgggaaaacaaaaagatgcaatgcaaagttcacatataaggataattatttgtgataatggtgacaatgatccctatttcttttcctgctcttatgaatttgcaaatgtcctacaaactgtattaaatgagtctgtgaaagttcatctaagtccctagtattattattttttaactctctagaaagtcctagccacgtagctcaaagcaaaatagaaaagatccaaatcattcataggacaagtgttgaggcaactttcaattactaaatatatttttagccatttaaaactaaaagaaaagtaacgtctgtaatcccagcactttgggatgctgaggcaggcggaacacaaggtcaggcgatcgagaccatcctggctaacacggtgaaaccccgtctctactaaaaatacaaaaaattagccaggcctggtggccggcgcctgtagtcccagctacccaggaggctgaggcaggagaatggcttgaacccgagaggcggagcttgcagtgagccgagatcacgtcactgcactctagcctgggcagcagagcgaaactccgtctcaaaaaaaaaaaaaaaaaaaagtaagaaaactcttttactcctttttatgatttaaattttattttaggtttgaaaagtgagctatatatcacttaacagtcaggaagcgtgcagtaaactcaatctctgaaccgacgttacctaaatcaaagatgttcgttttctcatactcatctctaaaacagaggtagacagagaaagtgcttctttttccgagattgtaatgaattcaaacctattcattaactttatagcagttattttggtttcacagtgaaacataaaaagttctattttattggaaagaaaaccaagtagctatctaagtagttcatgagaaggaatttgttctactgttttaagtgcatgagggataaagcaagacttagaaatatttttgttagaccatttcattttaatagtattttctattataacagaaatgacctacagtaaaataattcaaaatacccttacttctgaaggttatttccacataaaattgtaacattactatgatctaaatttaaataaattttctattgatgttaaaagtttgataatatacagtttgttaaagtggtttggtcactatttgggcacgatcgacttcaaaccataggtgtttaaatgaaccaaagtcttttgtttatttctatagctttttgcctagtttgattaataactagtataccagtcattcacatatagtcataactggccaaccaaggtttacttggtaggagggtgacagtttaccctttaataccacctgattaaaatacacaagatgttctacacaaataacaacaaattgtttatttctaagaacataattttccttttataggaagctctcaactttaatttggagtcacattttaattttataatgtaataattcaataaatggtcattagatattgggttatttggaaaactgcaaaaaatcaaacttctgacaatgtcctttaaaataattaactcagctggaaatagttaaacaagacttaaaaatacaaatcataatggccaggcatggtggctcacgcctgtaatcccagcactttgggaggctgaggcgggcggatcacgaggtcaggagatcgagaccacggtgaaaccccgtctctattaaaaatacaaaaaaacttagctgggagcagtagcgggtgcctgtagtcccagctacttgggaggctgaggacagagaatggcttgaatccgggaggcggaacttacagtgagccgagatcgcgccactgcactccagcctggggcaacagagcaagactccatctcaaaaaaaaaaaaaaaaaaaagaaaatacaaatcataacgtgaatattcaaatgattgtacagtgtaacaattgtatgcaaataattaagaatagtgactataataaaaaagtttaatagatttgacatcaacatttaaagaatataacttacatatacgaaaataagccatcaaaacttgaagctgtcaaattgtgaaaaacagtagtaaacaataaaaatcactgactcattggaaacactgcaaaatgtcatgaaaacatttcagaaatgaaggtacgttaatgaaaaataatcatagttttaaattcagtctcacctcacctttaagaaacagtgtaaaacagcaataaatgggataatttatattactgcaataaaatgcaaatatatatatattgtgtactagcaccctctcttcaatgtatactttaacccaatagctttctaccactggaaatttatcataagaaaataatggtggcttacacctataataccagcactctggtaggctgaggcagtaacgtcagttgagcctaggagttccagatcagcctgggcaaaatagtgggattctgtctctaccaaaaaaaaaaaaaaatgccagtcatagtggctggcacctgaatccttgctgcttgggagactcatatggacctaggctgatttgagcaggggtatcatttgagcacaggaggtcaagtctgcagtgagctatgatcattccatcgctgcagcctgggtgacagagcaagaccctgtcacacacgcaaaagaaaataattcagaatgcgcccaaaaatatataaatatatttctgaaagctgcatttgtaatactgcaaaatcaatgccacattgagacaggggtaccaagattaaggtagagtcaccaatgacaattaaaatctggagtcagaatgctgtatctaagtaggacaacaatttctctgctgcagcctaccattaccatgcagcaaagttgctctattacttctgaattttccacattcttaaagaaaagcagaaaatccagtttctaagacaaaaatcaagttataagtattgacagaaaaatcacttttaaataattgtaaaagtaacaacacactataacagtaaatctaattcagcctgataccaggctgtaccaatagatataatgaaactgcataatattggtaaaacaattgtatggtagaaaaatactggcataaaaatgttcatagcaaattcataaatggaaaaagtagtctgttttatttaaataaaaaggagctaaatgaatggcagacaactacaaattaatagtttatacctttcaagtttagaattaaggatatatttttctttattttttgttttcattattgtgatgtattatgctgaaattagcaaaaaaaaaaaaaaaaaaaaaaaaaaagagagtatctgaccaatacagaaatttgtattgagaagtaaggtgtgtccctaacaaacccacctatgagtcagtttgaaggtagcaagaaaatttttatcactgtcatatacttcagaagtatttgtgtacctaatgatttccagtgtcatcaaacataggtaagaacactgagtattagcactggttgatatttggtctctacaatagtgagtatggtggttaattttagatgtcaacttgaatggactaagggttgcctagagagctagtaaaacctattaaagtattatttaatatagtattgtagaatatacgttaaatacattatgttacatgtattctaatgcaacacattataatatattaaagacattattccattaatacagtacttagtatagtattacttaatacattaaaatggtaactaagcttgacgaatccctgagcaaagccagttagacctcataagcagcctctcaaccttgcttgttttgcaaacattaacaaaacttcaggtattttttgtaaatgcctatatgaaagaaaaacagaactttctttttctttccaaataggagtgtttactatagttttcctgtttctgtatcacattacacactgaatgtgtgggagagcagagagatttaatttacaagttttagatcaagagagcataaccagatcccaggttaagacttaacactacagaatactcatgttagtaatactcgtcctataaaaagatacacttttcactgtaattgctgcaaacaataaaatactgtaaaataatatgcagtgtgtttgtgaaaggtcaataacatgtttatatttttgctgttgaaaaactacacaaaaacaaatgactacaacagcagatcaattagtatcagtagaattataccatcaaaaattccactgagcttgaatgtaagatctgacataaccagataattccatggcaggggaataaactgcatttacattctctttctaacaattagtgcaagcatatccagataaactatattgattctacattatcttagagtgaaatcacctaataacttcttcagtagtctttcttttaatttttatcctaattatccgtctgaaaatgatcttttaaattgggaaaactctgattacattacatccttcagttcagagtagcattgggtaaagacattttggctgcagacaaatcactctttcatagtcatcagctttcagaacattctaagactttattttccatctaaacttttcagttaatttgactctaacttttaattgatgttactgagcagcaaaggagcctgaaggacactgctttgtttggaaaaatgaagaaagaaaggaatgtaaatcctgtaaatgtaattctaacgaaatcaagataaaatatagtgtttataaaaggaaatacaattatttctaataactgtactttcatttcaaataattttcaacaaattagtgatgtagaataaatacaattccagaagaatccaggattttttttctattgcatggctttttattaaattatagctacttgaaggctttgagaaattgaacaccagtaaaactgcccttcttttgttaatatgttttgttttcttttttcatttttaattcaactagtcattcacaagaaaaaattcactcaggtaaacttttttgattattctttcatagcatttaacgcgtgttatttattgtagtcttttgtctatgaatctattaatgctaagaaactgaacattcctaggagtgtcctaataagaaagaaacattaacaatttcagctgtatttttacttaaataaatattcatatagtttacctttcaggatcataacaaacactttaattatataagaaggtttttgtatatacatcagactaccaagaagtcatatctgattttgtgcttttctactactcttcccccaaacacttgttcaaaaagtttacttttaaagggtctgaactgtgtgtcaagcactgacatcagcatgttacctgaattaactcattaaactcttgtgatactcatgtggtattagcagtgaagaaactgaagcacagaagcttcaagtaaaatgtccggttttagagcaactgaacagtagagtatggaagcccagttactgaccttgtaccattgcccagtattgtgaactgacctaaaaaggcctatgagatatcaacccattaagatccatgacataaagaaaattgtttgtcctacaatatcccaatctggatgaaggcacataaagagaatatgcttaagcatgatgacaaaaaaataagaaagaactgtgaatgaactttacaaaacagaaaagaacacaagggactttggaaccaagttgaaaattaaatatgttcatgtgcacataacaaaagagtgatcataaataaactgtgtcaacactgtactatgaaggtgaaactttctttttaggattagttaaaccttgtataagttgtaaaaaaatgcaaccacatatattgatgtactaaacccaatgtttcttttggcttatatactaaaaacaggaattccttcctgtaatgaagaaaaaacacaggcatcaaggagtaacaaaattaatgtcttagaatctaaaatatagaaacaccaattaaggctttttttacataatacatgcaaaaactgcatcagaatttacaaaaaatctacagcgtaattggttctggcaataagcagtcacattctgctggaggtaactttagtaacgtcaagcaaaggtcttaaaattatgacaggtggtattcatttaaaatactcttaagagctcttagaaatcaagaacacagtatctggacccttatccacactcaatctctttctaactgggaaattttgggcaaagttttaaactttcttgaacataaaatgcctagctagcaataactttagaaaatactaggagtttgtaaagttacaagaatcaaatgagttaataaatgtaatgtacttaatgtaataatgtgcaaaataataattcattattttaatatctaaattctctagcttgtagttattttgaacagataaatatatataattaaaatttctaacatgtgtttttgattacttatcatgtagaaaaatacagctttccagatgaaaatatagtatataatgtagaagtcacaaataatatttattaaactggaatgctatcattttaaattattttggagctcattaaagtaagtctgcactggccaactttttatttattaattaaatttttgcctagcacagttaatctccttttctaagacttaattcccaaatctatagcctttcttttcccatttggagatgagtgggagtactgttcctttcttgccaatcccttcctctattttcattataataaccaatatgcccttgcctaagcatatgcccccagttaataatacagattcactgtactgtctcaccaaatttaacctgttatttttggaaacagggtttgtttaaaaatgggtttgttatttcttaatacatgccaaatgtcatcagtatatcgtggtccagatgtattctaaataccaattgaaaaacattcttaaagctaagaacacacaacatacttcacagagtgaacaactgtgagaagcctggggattgtaggcattcttggaaaactattatttttttttccatgtgtgtcaagcatttgcataggttatatgttttatagctccagttataaaaatagggaataaattatattccctcacatctgtacaaaatagcaagaatacacatctacagaagtttaaagtatttactctttttttttagttaatacgtttcagaaccttaaagagagcaaatcataatacccattgattataatgtcacattttagttattacattattacatttacttattataacttttagaattttaggagggaaaaaataattctgagtgtgaaatttgaatatttgcaccctaaaaatttccaattccattttcaataatttagtagaatgtttcttagagaaataagaagacaattaaaaatatgaagtactactaggttttcaagtatattgcaaagccataaataatatataatctatcagtggtacaataattaatatattttttcaattatattcagttgtaagaactcaatgctcctaaaatttttaaataatactatataaaagcaactcaaatgatatcagctcaaattcatgtatacatctttgcagctaacgtcttttaaaattaaaaataatttaaaattttgtcatacatttatgaacccattttaaagaacataacatgtcatacaaatgttaatttaatacacaatgcattagtaaaaactgttctgtatacatatgtttatgttagaaaactatttttaaacagcaattcgattctattgattcatcaaattattaaatcacaacattgctaaactcaatttttactctcctaagcatattggaatctatgagaatatacagtagagataataatttgaatagaatttaacttatatgttttagcaaagaagaaataaaaactggaatattatgggtttctaacatgcctatttgtttgttagttttccttttaaaaatttctttatagaagcattttgagtgaagcccacagattatttaataacttattagttatttaaaaaagtctgccttgttgacaatgtggaaaacaccatagagtggggtcccccaccccaggagctgcagaccagttagctgctcataacctgttaggaactgggcctcacagcaggaggtgacctgcgggacaggtaatgctgggtggcattaccacctgagctccgcctcttgtcagaactcagagcggcattagattctcataggaccaggaaccctactgttaactgcgcatgtgaagaatataggttgcacactccttatgagaatctaataactaatgcctgatgacgtaaagtggaagagtttcacatactcccccatccccacaacccactcacccagccatccctggtctgtgaaaaattttcttccacaaaactggtccctggtgccaaaaagtttggggaatgctgtgttaaggtgaaaaagggtacatgtggtaattgtaaaaaaaaaaagttcaataaatataggaaaaaactctaacatcatatgtatatgtggacatatatacttacatatacatgattttctgatttgaagaatgtataaaaaatgagaaaatgacattgaaaacctttttaaggatcattcattaatatactctcgctctctctatatatgtattatatactatatagtatatataatatataatacatataatatatagtatattatatattatatgtaatacatataatatatagtatatagtatatatattatatacatataatatataatatatagtatatatattatatacatatactatataatatatagtatatatatttattatatacatatataatatatagcatatagtatatagtatatatttatatacatatattatatattttatataatttatatttatatacatatatattatatataattacatattcatatatgtatatataatatataatacatgttttatatatattatatatatacattttatatagacagggtctcactatgttgctcaggctggtcttaaactctagctcaagtgatccagtcttggcctcccaaagtgctgggattacgggcataagccactgtgcctggcccatagttaagtacttaagtcaaaactgatcattgtacctcctttctcttcctcgcttcattcttgaaaggaattcaacactgaaaaagaggtggagacttaactgagtcattcacaaataagaactttagaaaagtgaaaaaacatagttatacaaatcatttccaatgatttgttcatctttaaaacataggccaatatttctattttacccaactttactcagctgtaggatgcagtccagaaacatcttagtgtaagagtattttttcataaaatgtaagatattttattcaaattgaatggctgatcagccataagaattccactgtaaagtaaccaaagaagtacaattcttacaaaacaatcatgaaatagttttaagaattaaagaaaaagtaatcacttttcaccaggaatcaaacttttagttggcatagcataaaataatttctcacactggcaaaaggaaaacctccagaaacctccaggcaaatgtcctttccccactcccactcctaaagaaaatatgggctagaccgaggcaccatgatctctcctgcctcttggatttgctctctgtatcccagggctgtcttctagtctaatctcactcataaagctgagcaaatggcataccaagacagaggatctaacatgtgtttgaccttttggaggcatctcaagtccctggattccacctcctgttctccgtattttcaaacatgttctcgaatatgtgtttgacctttctgaagtatcactagtccctggattccacctcctgttctatatattttgtaatgttaatgtccaatttcatttttaaaatgtgagtttctacacaagttgtttcttatttgtacccgaagactttgaataggctctggcactcccagacatgggatatcaaacagatgcaggccttaagtaggtcataggactggacttacatacaagtggctgtggcttgtgagactaggttgtagtggtttttttgttgttgttttgttttttcattttgtctaaggacttgaaaaccttcaggggagacgtgagttaagatttgtcttcttctagtgatcttcttttaaaacacaaatcaatcctgttaaggaatccattaaattactattagtgcgaatggacttttttaggtagcatggatgaattcaatgtaaatgcaaatgtagtatgtggaagaagagccattctcattctatgaacataggacaaggatgagaatatatataacctatagttaatgaaaaatatatatttctgatttatgtgaaatcaatttaagagattacataaatatattctatagatataatatgattttcatcagagcacagaggatgaagagagaagagagaagataggagtggtggctactagatccttttgggggattatttttaaaaaggcagtttttggcaataaaaggggactaacaccttctaatagatatccactggcttgcagaaaacaaagtgtcagaaaatttatcattggagaaaagtcaatgtttccattagtattaatgtggctaaagatggctcaagggtaaaattattcaaaatactatgcatcacaatagtgccaccctgtggactactctctctctcaccctatggggaaaggggctatgtgaaaagaaaaagaatttctagcgcagcaaaacaaaattctttaatttttttacatagaaattgatagtgtttgctatcagtgatgtaattattttacaaagaagcccttgaactatggcagaacttctggatgctctgtcactatgtgtcaatctcaatatatcaatcataacacgtgtgatttggggttaatatgaaggaaaaacaaacttctcttcggttaagtatattttccgagatttaaattagtttcccaatttttttccccaggtttccaaattcttagtgtaacaccaaccaaatatcaaaatagattattagagtttcgatacaataaataaaattaaagagtaagcttataattcacattatttaattacatgcattattagagaggacatttcattaaagcatgcaagttgcattttttttttttaaattttgacatgtagatagtttaaactaaaagccagccaacactttgatatagcagaagacaactgggaaatgtcagttgactaaagtggttatttaaagaaaataaggaaacacaatattctttttgtctattgatatgtgatgctgtactgttattgggcaaactttttaaataatagaaaactctaatgcttacgatgacaaaaacatgttctgtaaaatagcactgtatatgaaaatagtacaaaagggggaaattagaactctgacaccacagtatcaatgaacatcacacagactgaagatcacagtagtgaatgaccaacatctttaggctggaaagagtgggaaaaattaagaatttcatggagatgttattttcaaaaatagactcaataaaatcaccaaactcaccactgggttcagaatgtgatcaaccatctctttcacttttatgttacctttgtggagttttattaatggaaatgaagaaatttactagaaaaacatgattgcaggcactgttaaatttactttctctttgtataatttcatgaaagtgacctgaactgctttgcagcattagtagggaaaaagataaatttatgaaattaaaaggtgagaatacataaaaagtttttatctttccagtgagaaagtgataatcataatgtttagttaaagctatcatctaaccaaacccatcagtacgctaattgtttttaacttgagattttaataatgctgaagtatttccgtcacctcagtattagtgcttccttgtttaaatctcaaagggccaccatccaaggctgcaaatatacaaatgataaaattttggtatttaagaatacccatcttctagtaggacagccatgacaataataatggctttgatagaagaaaacaagaaaatttcaagaagataaatactagggaaagtttttagattaacatgcaagtatgataccctccctcacaaaaataaagttcattaacactaagcctgtaaatttcatagaatacttcttgaactaggagaactggaatcacccatcctgttagaatgcaattaattggaccctcttgaacccgtatcttgtgtgtcaggagttgtaaatctgttaagcatcttcaggcactaaacaagatctgaatactaatgggttcatttatttcactgattactgtatgcagatatgaaattccaggcactgatttttcattaaaccactctcttaaggttaacttgcccctctcttttcacctgaatccatatgcttgccacgtaaattgtaatattgatttttaacatttccccacagttcaaaaatattgtttgcaaaaaatcaagggccttttctaacaattcatgtaattcctgttattagctaatgtgtaagagtagggaacaattaaacatactgtatacaaaatcttaccatcctgaattgcacccaagatattagttcagtcatccttcaaattacctcacaactaaaaaggatcagatacttaaataaaaacttcaggcaaggtaggaaagaagtcttttatcatccctgtatattgcaaaagtgttccattctctctaaattcacattatatttattaatgagcagcacatggaaagaaagaaaatgagagagagagagaaaaagagaaagaaggaaggaaggaaggaaggaaggagagaaggaagagaagaaaagataaagaaggaaagaagtcaggatggtaggaaagtgagagacagaaggagagctagagataacgatgagagaattaaaagagggaaactctaatgtctttgatatcccccaatttaaaagagaaggatgtgaccccctcccccgtttacatataatggaacaagccaagtctccattcactgcatgtggacagtaagaaaacttgcatggggaaaacttttggggggaaatgaaggtgatttccgagctgctactgcagttatatatgacactgacatttatttcccataattcttgcccacaggaaacacatcctttaagaaactgaataaaatcaagtttgacattctcataatctgcaaggtatcaacttccctgagaagctcacattcccccaaaacacacacatgtatgtaaggagcgagacattcaggagatgagctgtgaaaggtacttccacattgtgagggtgccaaggatttggttattcctgaacctgaatccgaaaagcgggggtggggtttgcgatgacaaatgagggtgagaagaatgtttccatgaaaccagacacccttttggaatctaggctgagaatcaggatcccacccccttgcctaccgccaggctccagtaagcaacctctggcgtcctcccctctgctccttccgcagcagcagacatagggatccctagcagccagggagcttaggtcccgccgagagctcctgccaagcgcttctctctcgactagttatcaattgagaaaaaaaggatcagactcacaacaaggatggtgatcaaaatccagtgtcaggcaccagggtcccagaaggttccggctcctcttctgcgcccttacccagctcttttcgcctcgcaaagggtcacccagggagccaccagcagcagatccttcccttttgctcctcctgatagcgccaatcttcgccaccactgccacactgcgcgcccgctatccactcacggcacaccgagaaggcctggcggagacagcgcagggggaggagggtggattaaaaggatagatttttggaagggtaagggagaaaaactttgatgttgtacccacacacaggactgagaagaaaccaaaagaagttgcagcttcaggagctgggaggacgctttcgccagctcggaaaaaaaataataataaatcaccccctaccaaaatcagggggaggaatcttcctgctccttgagcgatcactgagcacacctcgcaatctctgatcttcgaacccactgaaaaagcacaaggcatggggagtcctgttggttcacgcccggggtgcgaataccaaaagcacctcccgctggaaaggctgcaggaatctcgaggcaaagacagaggcaaacgcaacgctgggaagagcgaggggtgctgccatctgcaaaagcagagacgcgtctcccttcgggcaaagtgactgttacaaagtctgttccctcctgcgcaaggacagagacatttaaaggcctgaacggacgtcagcaccagtcgagctcgctgggtgagcgccaggtctccccaccccaaggatagcgcgcacagggcgatctgctgctcgcgaggtagagagtggcttacttggggagaaaacattgaatctgtaaattaccttgggcagtatggccattttcacgatattgattcttcctacccatgagcatggaatgttcttccatttgtttgtatcctcttttatttccttgagcagcggtttgtagttctccttgaagaggtccttcacatcccttgtaagttggattcctaggtattttattctctttgaagcatttgtgaatgggagttcactcatgatttggctctctgtttgtctgttgttggtgtataggaatgcttgtgattcttgcacattgattttgtatcctgagactttgctgaagttgcttatcagcttaaggagattttgggctgagacaatggggttttctagatatacaatcatgtcatctgcaaacagggacaatttgacttcctcttttcctaattcaataccctttatttccttctcctgcctaattgccctggccagaacttccaacactatgttgaataggagtggtgagagagggcatccctgtcttgtgccagttttcaaagggaatgcttccagtttttgcccgttcagtatgatattggctgtgggtctgccatagatagctcttattattttgaaatacgccccatcaatacctaatttattgagagtttttagcatgaagagttgttgaattttgtcaaaggccttttctgcatctattgagatgatcatgtggtttttatctttggctctgtttatatgctggattacatttattgatttgcgtatattgaaccagccttgcatcccagggatgaagcccacttgatcatggtggataagctttttgatgtgctgctggattcggtttgccagtatgttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctgttagaattcggctgtgagtccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcatagaggtgtttgtagtattctctgatggtagtttgtatttctgtgggatcggtggtgatatcccctttatcattttttattgcgtctatttgtttcttctctctttttttctttattagtcttgctagcggtctatcaattttgttgatcctttccaaaaaaccagctcctggattcattaagtttttgaagattcaatgccaaccccatcaagctaccaatgcctttcttcacagaattggaaaaaactactttaaagttcatatggaaccaaaaaagagcccgcatcaccaagtcaatcctaagccaaaagaacaaagctggaggcatcatgctacctgacttcaaactatactacaaggctacagtaaccaaaacagcatggtactggtaccaaaacagagatatagatcaatggaacagaatacagccctcagaaataacgccacatatctacaactatctgatctttgacaaacctgacaaaaacaagcaatggggaaaggattccctatttaataaatggtgctgggaaaactggctagccatatgtagaaagctgaaactggataccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaagaacaaacaaccccatcaaaaagtgggcgaacgacatgaacagacacttctcaaaagaagacatttatgcagccaaaaaaacacatgaaaaaatgctcaccatcactggccatcagagaaatgcaaatcaaaaccataatgagataccatctcacaccagttagaatggcaatcattaaaaagtcaggaaacaacaggtgctggagaggatgtggagaaataggaatgcttttacactgttggtgggactgtaaactagttcgaccattgtggaagtcagtgtggcgattcctcagggatctagaactagaaataccatttgacccagccatcccattactgggtatatacccaaaggactataaatcatgctgctataaagacacatgcacatgtatgtttattgcagcattattcacaatagcaaagacttggaaccaacccaaatgtccaacaatgatagactggattaagaaaatgtggcacagatacaccatggaataccgtgcagccataaaaaatgatgagttcatgtcctttgtagggacatggatgaaattggaaatcatcattctcagtaaactatcgcaagagcaaaaaaccaaacaccgcatattctcactcataggtgggaattgaacaatgagatcacatggacacaggaaggggaacaacacactctggggactgttgtggggtagggggagcggggagggatagcactgggaggtatacctaatgctaggtgacgagttagtgggtgcagcacaccagcatggcacatgtatacgtatgtaactaacctgcacaatgtgcacatgtaccctaaaacttaaaagtataataataaaaattaaattaaaaaaaaaaaagaaaacagatctggtggcgctgctgagtgtcaaaccctggagcccatcatcaagacgttatactggtggcagttctgctgtgagtgcacttgccgaattgaacagagccagagctgcgtggagagagagctggccactctgcacgcgcgcagccaatattgggttaccaaggagctcaacacctggtttttagaaaaaaacacttctctctttaactctggtttgagtcagtattctgatttgcttctgaaagttagttgaaatccatcgagatgtctttcacaagaaagggattagactttcccgtcttggaattccaatcaagataatacttaatctttccttaacccccactgtgtacttcctaactcacagtcacaatggatgaaagtattcaagcatcttcaaatgaccattaccctgcattctaagacgatttgcctacttagacgtcctttagtaactgcaaattatattttttcaagttcgtttgccagctggcttcagatcaggttcagtcaatgaaaactggtgtgtaggaaattggccggtgcccaaagagtaacagttaggttgttcctcctcctttgcctctgctatgggtgacatctacaccattacctgtcctctaagtggttctagcttccatcagggaatgctggctccttgtctttagtagcttgaccttccccctttatactttcaacctgtttctgattataatttgacttctcatataatcagagggagacaatttactgatttcaatcaattactattctctatattttatttatcatactataagactgcattttatgtgtgttttaagcatgattcagccactcaaaatttgacaagagcagcattggtatcttccaaaaggaaggtcaaatcctgctgtgtggtaaactaattaccataagatctacaaactacaggcttagggttttactttgatgactgttatttttataattctgagtatcagtgttcaacatatttgatggctatcctcatcaaatgatcctaatttatttattcactaatttatgtactctttgaaaatatgtattgacatcttctgtatccctgtcctcatacatctctcagttttgttgcaacagaggaaagaatatggtgaaacaaggagttggccccttcttgacaacttgtgcagacacaagtgctttgaatggggaagagactgggaatgcaattttcttagtgtggtgagctattctgcaatattataacagattcaatatctaaagagctgcaactcaaaatgaataagataaattgaagtgttgtgatttaagtgcaaattaaactctcaaaaacattaaaatacaggttttgcctgtaattaacaaagcaaagagagagtgtaaatcttatgcagcaattagattggtccatggtaaaacggaggtagctggtaatttatttttctatgttggggaagaaatttaaaaacaaatatagtaaacagcaattaatgttttatgatttgtaaataaagttatatttttaagattgaagcctctcttaccattctcaaagagccatttcaagccttgaatctctcagggcttcagtctgaattattataactttccagtttgagaacatttttcatttattcaacacttaaattgtatgagattatattttcaggaacaattatgtttattttttatatgaaataaaagtggacaaaatattaactgataattgtaaaagtattacaagaaatacaaggcatattataattatgtgtcaataaaaagagaaatgcctgtaaaattataataaatcattcaaatatcttaaaagcaaaatgcataaaatgtagaatgtatatattttcatttgaatgaccattttttaattaaaaaaataaaaggattcttaaaacattcaattagaaactacggattttcagcttttcccgattctattagaaatgtaaaacaaaataaatttaaattcaaaaacatgacagacccttcataatgttttctctgcctactcattccatgtcacttctaatttctccctccatacaaaatatgttgaaatcatactaaatctttgccttctgtgcttttattgtaacacactccatcatctttacagttgcaattttctgttcatataatttgccttctttcttccattttatggcttagcatctttttatctttcttggatcatctaaggtttagttttcttgtggaaatttacattggctgcacttcctagatattcccattgggcgttgatttcctcttatagcacttcctccactgcgatgtgttgccacactaactaacatagctaacctgttatacagtaagaactgttaggagagagttaggataaaaagactaaagtgggtagagttagggtttgggttacaatactagctgtatcttgatttgctagcatagcatacatactagtcaacaagtatatatgtattgaatatacctataaataaatcaataataacttttaaaacatagacctttggtttgtatcttataaaaagcttccctaaaatgtatgaaaggtctcactgactttatgaaatatacattgctctgatttcttatttatttttatttatttatttatttattttgagacagagtacctctgtcacccaggctggagtgcagtgtcacaatcttggctcactgcaacctccgtctactgtgttcaagcaattctcctgcctcagcctcccgagtagctgggattacaggcgcatgccaccataccagctaatttttatatttttagtagagatggggtttcaccatgttggccaggctggtctcaaactcctggcctcgtaatctgcctgccttggcctctcaaagtgctggggttgcaggcgtgagtcaccgtgcctggccccttgctctgatcttagtcttcttaggctctggtccttaatatttgagaatgtctgacaggacccgtgaattttattttttaaaaattgtatatgcccaaaatttgcatgcagtttgtatggaattttgcaaaatgtatggaaatcctgaagtctggcttgtttttttcttttttttttttttggcagggtctcgttctgttacccagactgggatgtggtggtgttatcgtagcttactaccttgaactgctggactcaagcaatcctccaggctcagcctctgagtagctgagattaaaggcatgtaacaccatgcccagcttattttattttatttttttcagagacaaaatcttgcattgttgcccaatctggtctcaaactcctgtcctcaagtgatcctcctgtctaggcctattaatcccaaagggctgggattccaaacatgagcggctgtgctcagccttgaggttctggctgtaatctggctgttatttatggaaacaacagaagttcttggtattagcagcagtcattcttcttgagagagtcaccccacaagactgagatgaatatatttaagaacccaaaatgaggtcattatggcagaacagaattgatagtgcacattaaaagacattacacactttgggtgattcaactaaatcatagtctgaaatgcagttacaaagtggtaatgttcaaaagatcatctattagtcaaagttacaaggaaagtcctggttatgttggtaaaaattgatatctgtgattatccatcttcaaatgatttgttaaatgtttattaagataaaaaagttacatttcaaaagtatttatattatttgtcaattcctccataacaaattatcccaaaataaagtataataataaaatttaaaaaaagatgagaaacatattcttcaccacaggaaaaaaaaaacaacctttattatctcaaagtttctgtggtgcaggaatctgggcatggcttaactgggtcttccattcagagactctcacaagttataatcaatctcactcacatgcttgatggtgtattcagtactttgacagctgttgtccagaattccatataatgtgagcctcttcggtatggaaggtttcttcatcaaaatgtgccaagccaaaaaaaaaaaagctattgaaaagagtccaagacagaagtcacatcttttgtcacctaatcacagaatcaacctctcatcatgtttgctgtattctatgcaacagcagcaagcctatagatccagctgacacccatggggaaggtattagacaagggttggaatcccaggagatggagaccattagaaacaatattaatctgctgattacagtagtttgccaaagaatcctgagataataattctgggctcaaaattcttatgaggcactgaggcaggacaataaaggaacagaaaataatactatattaattttaatgatttattaatactaatatactggtataatgtgctaaaatagtatactacatttttggtaatttgtccaggagtaatagaaacaaatccaaatattaaatatcaaagcatattataattctatgataattaactctgtaatttaaaaagtctaatataggaatataccaaaaaagaaagttttaaaaatatactttatttcctaatatatcaaaatggagccttcacatatgaaattagtaaaatatttttgacctaataatttcatttttagcttttctcttaagaagtcatattgtttgcaaaaatgttatgtaccaaggagtttataacatgcagttgtagtcaggaaaaattttaaattaaaaatgtgcaataaatatatgtaaaaacagaataatataggcatctaaatagccctatataaaaagacaaacataacattacaaattagcattaaccaaaaatatgctctgaagtacatcccttgattaaatttacttaagtttcttttggaaaaaaataaaaataattgtatttgctagtaagagaaggtagaacattatttgcccatttgttttcagaagtaaaacaagacatttatgttttcagaagtaaaacaaatacaatattttctaagtaataaggttgagacaagaaaaaaacagcaatgagtaaaaatgtctatttacatgcttttacaggaaaacaagacttaactactttcttccaaaaaaaaatttaagtagaaatgttattgttttactaaaagtaaatacattttacatacttctctcataattttaatctgaagttcagttatggtgatcatattagtcagtgttttccagagaaacagaaccaacaggagagaaaaagagacagggagatgaaataaggcattgtttagcatgattatgggggaaaagacgtcccaagatctgcagtcagcaatctggagactcaggagagatggtggcatagctccagtgtgaaagctggcaggtttgacactcaatgaaagccaaagtttcagtttgagtccaaaggtgggaagaaaccaatgtcccatctcaatgcattcaggtaggaggaagttccttcttactcctaggaaattcagcctttttattctattcaagatttccactgattgatgggacccacccacatcattggggaagtctactttactcagtctatgaattcaatagagaaaaagatatacataagctatcatttaaatttttaaaaaatcatttctaatcaaaatgtagcattttaattgtgtttttagagttttgtaagtgtccttaatttttcagcttattcttaaaaaatcaatttcactttattcaaaattcccttttggaaaacattaaatggtggcccatataatcttagactttacatgctttttgataaatataacattaaaagtagcatgtgtagtaatttaaattacatatataagatgtacatatattattctccagaggaaataaaactgttaagaactctgatttagtcagggttctccagagaaacagaagtgatagaagatgtgtgtgtgtgtgtgtgtgtgtgtgtgtgtgtatacatatatatatatatatagagagagagagagagacagagagcgagagaagaagtgaagagaagacatttattaggagaattggcttatctgatttcagaggctaagaagtctcataataggccatgtgcaagctggagaaccaagaaagttgttagcatggctcagtccaaatccagaggcctttccagactttaccactaatcaatacactatatttagaaaggtatcataataagtctctatttcaatttaaaattctctattttcagagacaatgaaggacaaagggtcaaattttacaattattgtgaaaagagattatagagaaagggcctggataataccaaaaatagaagaaagaaccatccatctggggcagagaatcagcagtgatattacttgaaatatggaaattaataatatgtaaggttgagtttaagatctaaaatataaaagttaaatttaaatctaacatatatgatttaactctctagaatatatctactcaattatatgaaacaagcgggctgattctcaatactttatcaataataaaggtttttccaaatagttttgaagaaatatcaaagtgtctaaaaaaaaagccttagaccatgaaccatagagaaaaagacaaggtttgccatgaaaagtgaataacctttttatttccagttgtgatgtgttgatacaaaccattagcactttcatttcagtgaattatgccagttcttgctttaccttgtcaagattatatatatgattatataagccaaacatgcttccaagctgtaactcacaccaaaataataaagactgcgaatgaacgactatatttaataaaaaacaaaatcatacacttattttagatttgaaaatgtttgggcaataggttaattagatctcttttgagtgttttgtttgggatgtgtgtgcatatgaatctgagtgtatgtctttgtgtgtgtcatcagctcaacccaccttgaagaaaaaaatatgataaaataaataaataaaatatatattatcagaattcggtacagataaaaagtacaaaatttgatgaagatctctgtcttgtttatcattacacaagaaaggaaaaaattggaatataaggcaaaaattgtttgttcatactagctacttttgaacactgctctgcccaacaattttgcatccattaaaataaatataagaatcaaatatttcaaagcaatgctataaaatacttgtatgtagaaatttgttgatgccctcctcagcatcctgtccatgtcttattttatatcagcacaattcacaattgcaaaaacatgtaacgagcccaaatgcccatcaataagtagattaagaaattgtgatataaaaaaataaatatatggggatactattcagccacaaaacgaaaaaataatggggattcacagcaacctggatggaatcagagactattattctaagtgaagtaacgtcagaatggaaaaccaaacatcgtatgccctcgctcgtatgcgggaactaagctatgaggatgcaaaggcattagactactacaatggactttggggacttgggagaaagggtgtggggcgtgaggaataaaagactacaaattggatagtgtatactgcacaggtgttgggtgcatcaaaatctcactaatcacctctaaagaacttactcttataatcaaacaccacctgttccctaaaaacctatggaaataaaataaaatgaagaaattttgtgtatgcataccacatattttttaacttttttcacaggttcattgagatataatttatatattatttaattcactcatataaagtataaaattcaattttttagtgcattaagtgggtgaatatgcaatcaccacaacataattctagaacatttttatgctccttaaaagaaaccttgcgcccattagcaatctttcctcattttccctactctttctttaaacccctcccagccttaggcaaccatccatctacttcctaactaaggatttgcctattctggaaggatttgcctatcctagacatttcatgtaagtggaatcataataatatatagttacatgtgtctcactactttcacttattatgttttcaatgttcatcctttttggagcatgtattaatacctttttctttttcattgccaagtaatgtattttatggacaggccacattttattaatctactcctcaattgatgaacatttctgttgtttcctactttttgttgctataaatacttgtatgctactttttgtgtagacgtttgttttaatttttttggtgtacacataggagtgaattactgagtcacgtggtaattctatacttaaacttttgaagaactgtttcatttttctgcatgatgcttgccaattatcccagcaccatatattgaagagtgtcctttccccactttatgttttgtttgctttatcaaatatcagatctgtagattgctttgggtagcattgagattttgacaatattattttttgagttcataaatataggatatttttctatttatttatgtcacttccaactttcatcaatgtgctataattttcagtatacacatttttcacatcctacattaaaattactccttagtattttatttacttatatatttgttttgatgctactataaatgtaattactttattaatttatttttcagatagtttatcatgggtgtttagaaacaagaatactatttgtatgttaattttgtaactctcaactttattgaatgtgtttatcagctttaacgggtttttttggtggagtctaagattttctttatgttaggattacattttcagaaaacacagacgatctcaccccttcctttcctatttggatgcctttcatttcttggccttgtataattactctggatagtagattacatacaatgttttcagcatttgtaatttgacatgaaatccatctgttgcaatacactgattttcacttttcaacttgaaaacctggacatttatcactactctccctttctcttggtctagtccttatttaaaaaaaaaacctaccaatctaaactaggataattatttttctataaaacaatttcaaaggcatttaaaaaatttaacaatttttaaactttctatgtcaatgattttaaactgcggtctctcaaaacaaatccaatacctttagtaggaaaaattatgttaattcctacactatcattgggtctagccaagagttgatattaatagatatgcttatttattaccttgttctaacagttgtagtgtaagtcttgaaaatcaagtaaaaatttgtaaagattataatcgcacaaactccctctctcatgaggcacacagttaatccaaaatattatttctaacttaccataaagccaacaagtaaatacaatgtagtgtttaaaaataatcataagtatattctagaaatgaaacattaattgatactatttattgaatatctcatatttatttacatagaaacaaaggaatcaaaagcatattatgtaacattgaaatgactaaaaatacttgagatagcattgctacataaatgctatgtaaatgctgacaaaagtaaaaatgccattcgctacatttgctaaacatactgtgacacattataagtattttaaagatatatcactaatgcttgggtcaagtgggcaaaaatgattctaagtatttaattgtggaaaaatttagtgcaggggatagtattcatgtgatggaaaaattttaagtggaactcagagattagaagcagcaggaagttttaataacgtaccaggtgcagtgtataggatacaagacagaactataggtaaagtctgagtctttccagcatagctaggagacatggctaactccacctgtccccaggccttacctagaagttgaacagctccaaaccaggtaaacagaacaattttccaaagtcaatcaatttatgacgttaaagcacttctaaaatttaacctctgacttaaattagacaaaatggataaattttgatgatttttttaccaatgattttaacactgtctttatttcccaaagattactgaagtcatgtgaaataaaaggcattggagattctatttttctgacaaaatatgtaagagccttccttttcttctaagccaagtaattagggctcctttatatatatacatacatacacaacacttctagacaggaaacgatctagcagttgtaagtttttctttctcattttatgaatcctaacacaacttccatagaccatctatgacatgaactttctgacttttcctgtatttccctctttcataattagtcattctactttaggacaagaatttgccatacaagatcctctctcttgtaacatttatttccttcataactttcttaccataaatacatcttcatatccacaactttctttacatctccctccccgactgatttctgatccccatccaaacctaaaaggtcagataacacaaagcaaaacaagggagagctttacattttgagagagacctgtctgcctgaagttcttgggattccatgaggacaaagaggtttctcctaaaatgggttttgtagcaccttctgtttttctttaaggagtcccagcctgtcagaaattaccttagatcctctcatgtgggcactgagtggcaacaagacagactagggaacactggcaacaagacagacaactgagtagaaaaagaaaaactacagtccccactgtaaagatggataaactgaggcatcatgcagtttaaaaatgcatgttacatagagttgggctccacagctcactctcttaaccatcctgtaattttgcctaacctatgcccagtcactgatgcacctgtatggtacttcatggcccccttagagcttagaacctgggtttcattcctgctctacagctatataatttaacaattttcttctgaatttgttggattctaaccctatgcttctaaaattttattaatattactgaatcttaaagggagctttaagatgtctttagtctttagaaatactaaacctataaacaaaggactatatgaagttaaaactgtattcaaatttctacatgttttaagacactgaggcaacgtattaagaaacacacctaagacaatcaatctactctggacaaaaatttagatatggtctcttctaaataagctacctagtggtatttatacatattcttccttatatcaaccgtatcttacatgctcatagccttaaaaataactaaaaagtgtcagaattataggccttacacatttctgttggcttgaaaaatgatacaaaatgcataaacttctagagtgatcagtttaaaaaaggagttcataccaaaggtagtaatactaggaatcaaagagggctaaactctgcaggtttttaaaggtgaaagttaataaaaccttgtttttcattgtgaatctttgccttacaacattatacacatgattcttcccccttctttttcctcttgcaaagatgtggtgatgaaccctttgctcatgcagatgacaatactcttgaaaatggtggcagagaaaaaaaatgaagggaatatggttcacttaatcatctcataaattagaacttattacccctgtgactcctgaatagctccagaaaaaatatgtgagagacatgaaatggctgtttgctaccaatattttatgtgatgcttcattttttgattccttgaagaacacaacgcattagcccatttatgcgagaggttgcaactttttgaatttttgcataagtgaaaaattagaccttgtcgatgacatttagcagtaggatacaagtaattcccacgtgcttggcgtggaacactaggcataagtgggttaacacaattacgaaagcatagctattcaagtaactaattatacaactgacttttttttcctcatctctaaaacatagggatcagttatttaaaaaacacagtgacaagtattttatttttaactcagttttggtttgttaagggcgttgcttggcataaaaaaaacaaaaacaggaggagaaacaagaatacaaacatgacatagaagcagtagcaaaagaaaatgaagagtatcaagaaaatgagaagaaaatacacaatggaagaaaggaaaaagaacaggtgtgggaattaaaaggcctattatgataccttttatcccctcctcgattcataaaatttgagtaactccaagagtatcacaacaaaaaacaagcaaaaggatacacaaatagtcaccccctaaatttggttaggaatgagataatgctgccactcaagcctagctcgggcaccagcaggaggagggcaccctccagagactgcaggagaagggggaggactcctctttgccctatatgtaccaccaccactgccaccgaggccttcgttacaacacccacaggttcctccccaccccagaacgggatgggccctgcagtgctcctactcccccttcccagcccccagacttcctactgctaccaccactagcgccgatgccaatacaaccactgtcaccctcaatgtaccagcccaccctaccaggctcctaccacctggtccccgtgggtgccctcctaccgctccagttgagctgcagtctccatctctaccaccaacttcatgaggcaagtttcagagccatgtcatctgctcgaccataccactggcgactcctccttctcctcctgcagcctggcttggagcagctgggcaggcaaagctagaaaagcccaaaacgggactcagggagtgcaaccgttagagcctcaccttgtcatgctggtgactgggtttcagggatcagtttcattgaaggcactcacacccacttccaaagtccagcctctcctcttctggcaaaagctggccaggaactggggcctggggtgggagtgagtgccttcactgaaaccagcccctggccaagtccagctggccaggaattgctgggcccaccaaggctgccctcctcagggagcctgagtaggagaaactcagacccagccagccctccccacccaagagctggttccctttcctgacacctccacccaaagtgccctgtcccccacttcccccatggtgcctcctactacctacccggtagtcccaggtggtcttcccaacacagagcatgagggcgggccagaaaaccacagtgggtgtgggggccctgccctgcaatctagctcgagcgggagaaaattgccttctagagtctggcatctgagaagagaacgatcccttacttggagaccaccagaagaaggaggccactgctgtcactgccgccaccacctcctcagctcgccagcgccactggcagtgtagcccccatagcacccctaatctgccccctgccactagtagtgtagcccccggatagcacatccaacacaccctagtttcaggcaatgtaaccccaatatccccctaaagcactccctccacacctcagggagcataacacccggtagttctcacaatctgacccagccacaggcagttcagctcctgatggcgcactccccagtcacaggcagtgcagcacccaacaacgcccctaaaccaccgcccactgccagcattgtagccccggataactccacccaacccaccccctgccgcgggtagtgcagcagaagatagtgcccctaatccttccccagccacctgcagtacacattagtgtacacaatctgcctccccgacaccacccctgccaccatgggctgtatagccccggatagccagccaacctgccccactaccagcaatgcaacactggagagtgcccccaaccagaccactgccacaggcagagtagcctctagcagtgagcgccaataggacacccaacccttgtccccagaggcatacggggcagcctcagaaaactcacctaccccatcacatttctaccactgtggccgagctgcagtctctgacgtcaccaccaaccacagcgaggtaagccacggtggcacaggctccagcctccagcatgtggcggttcctcttcgttctagtcctccagcccagcaggagaagctcctgctgccggctgccctcctactgctctctcgccaccaccaaccgcagcgaggtagtgtcccaggctccaggctccatccatcctccagtctccagcaagcggaaggttgcggcctcttccagttttctaagttgggcacagagcagctcctctgcttggcacagaagagcctgaaatgacgtgacacgacctcagcatgctttatataccgaggttaatgcaaatgtggttcctggactacatgttctgataggacgagaaaaaaacctctaggcctactctgattggactttattttcatgctgtgatttgttgtgttaagacttgctctcatccaattacaacattataataaagtccaatcagagtaagcctggaggttttttctcatctactcaaaacatgcagcccaggaaccctcctgggcataactgcagtatataaatgatgctgaagagggatgaggttttttcgggttcatgtatcttcctgtggagttgctcggtgtagaggactaggaatcaggagtcactggcctcctatgctaggggctggagccgtgggagcggcggctcacctcgctgtggttgttggcagcgacggagctggcagcgcggctggagtggtaggagacggaaaacagttttaggatagatggaggggagtaaagagggtagatagtgccaaagggaaaaaaaggtagcttagtcagagaaggagttgcaaaaaggtggtagtgaaaagatggtgggggaaaaagtttttgggtagatggaggcagaaaaacagggtggggagtgggaaggaaggaaggttttgcagaaagacggtgggtaaaaagtttaaaggtagatggagggggaaaagagggcgtcaagtgggaggaggaaaaagagggagatgatgggggaaaacgggggtgagcagtagggagagaaggtttcgtgaaaagatggtggggtgaaaatagagtggggggggaaggtttttgggtagaggagcaaaagagggcagcaagtgggagaaggaaaaagagggtagccagcaggaggaagacaaagttttgtgaaaagacagtggcagaaaagaaagaccatggacaaagaaaagacggtgggtgaaaagtgtttcgatagatggaggggggaaagagggtgacgaggaaagagggtagcaagagggagcagggatagagggttgggaaaacgacggaaaaataatttggggtagatggagggcaaaaaagagggtggcaagcaggatggggaaagaagagcatgagcggtaaagggaggagactttgaaaagatggtggggaaagtttttgggggtagatggagggggaaaagatggaggtgagcaggagtggggagaaggctttgtgaaaagacggggggtggaaatgtttttgggtagatggagaagggaaagagaatggcaaggaggaacgggggaaagatgatgatgagaacagtttttgggtggatgaaggggaaaagaggttggtgagcagcaggagtggggagaaggtttagggaaaagacgggggaaaatgtttttgcttagatgaaggagcaaaagagggtggtgagagtgggagggggaaaaagagggtggccagggtaaggggaaaagacggtgggaagaaactggggaaagggtttgggtagatggatggggaaaagagtgttgagcaggagagtagagaaggctttgtgaaatgagggtgggcaaaaaatggtgaagtttgggggcagatggcagaagaaaaagggtggcgagagggagggggctaaaggcggtcgggaaaagaaggtagggaaataattttgggggacaaaggtttggggtagattttttaaaataagattatttgtatttttgattttgatgagttctttattttgtgtatgaaccccttgcctgatgcatagtttgcaaatacttgcttccattctctgggttgtttcttcatttttaaaaaattttaatttaatttttttttgacggagtcttgctctgtcgcccaggttcagtgcagtggcacaatctctgctcaatgcaagctctgcctcctgggttcacaccattttcctgcctgggcctcctgagtagctggaactacaggcgcctgccaccacgccaggacactttttttgtatttttagtagagacggggtttcaccgtgttagccaggatggtctcgatctcctgatctcgtgatccgctggcctcggcctcccaaagtgctgggattacaggcgtgagccactgtgcctggccttgaaacataactttattttttatttttgtatttgtatatatactttagtagccctgagttttaataaagttgcctttaaaatatgtatcttatttttcagaaatataccctaaggcatgtgattagttgggtggcatgttctttagtttttacaattgaaggattgtcattcctttatacaaaaaaagtgaatttttatcatatgctagaggaaagaaggtagatactaaataaatactgtatgcttccatgtagataaaatttgaaattatataaagacacaataccttaaacttttctggggttaaagtggggaatttcattggcaaagttcatgcaataaatgtgtaggtgaagggaacattccatatttgattatgtaggtgattatcaagctttataaatttataaaactgaactggactaaaatgtgtgccttacacgcaaattataattctataaaattgattaaaactagttagataagagagaatcaaggggaaaagagaaaaggcacgtgaaaaaataatgccaatgcactagaattatctttgatgacattaaatatagcctggtcttctcttaattctttttaaaattaatgtagatttctcaatcctttgatactttttcctgaacgcatcttatattctcatacatgttaatgtatggctacataggagaggattcttttacagctggactggaacagcttgatatttatatctagagatgcattggaaacataacactgacccgtgagcaagatgaaaatggcatgtgctagtgattcattaatatgttgctttaagtttagtgccaactggtctacatcgttgagaatgtttagtttgatggtttacacaacttgacttaagaagtgtatgaccaacagtgtatgagagagcctgctataaagacttttctgcacttcccttaaattattatagtaagctcaaatcttgaaggttcagaatatacagataaaatgtgtccgtgaggctgagaaaggatctttagggagaaaggctctgttcctgaaagacagactttcaatgatttcctgcattttatttctgttctagtttacctttacctttattaatcactaataaggtggttcttatagggcctcataggcctttttagttttccaacctattcatacttagtgcaaacctagtaattttttgcatgatagtattgggattttactctgaggctaggcttcacactgtaaaaacatctttttggaattgtatcattttcagtctttccatcgtgttccactgtcccagccacacacacaccagatatgaagactacaagcaacctcaaaaagtaacccatctatagtagatgtttttacctcttgtgaaatctaaggaaaatatactaaaaatgaaggcatcagtaaaacagtatcattttaggttgacctcgagcatttcaacatcagtctaacttcagaataatacattagcaaggagaaatggggtacttttgtggttttttacacctgttatttcaattgaaattgaaaaaaaaaactaatttgaactaaccataaaaggaaggttttatcagtattgaaataaaataacagaaaatgcatttgtgggtctgacctcaggaccgattttaaatagtcaatccctctaactctcattcccctttctctgagcattagctttattcttattccatcttacttgatgtggcactgacagatacagactcgttcttacaacatataccatcagaagtgaaaccttcacactctccaactcttgaaaaatctgagatgcactttgactattctcagattatgggtatattacttggatcaaaaagtactgcacagggaagtagatactgtaatctctgacattacagtttcaaggttggagtgagaaagggatagctccctaacaagggagtatcatagaaatgatattttcatggtcatacttctgtgaactaggcagacatcccttcatgtcaactacatctctactctactttgaacagataaatatccttgcatatacaaaattatgcagtagtgtaagcatgacttttcattaaaatttaagcaaaacagtctatttaggtgaatacatactgatacaggagatagttctgcttgaatgatctttacccttggggagagatacataaaagaatgtcatactttattatgatatgactatccagcatatttatgagtaaactttcataatacctttctctattgtctaaaataagcacaaaaacccttttagttaattaatatccctttttaatatacagaataaatagaaaatagcacaaaaggtattatgccagcacacagaaatagttccagttaaaagtcaatcctgtattttgagaacttgacaaaatcataattgaaaatagtgtactatcttacatgcagatgttgtgtaatcagggacatccaaatcaacttacatccaaatatttcacaattagtttttgaaatattctgtgaagtattataaaaccaggccctcaggaatataaaagcacaaagggagccaggactccaaatagccatttattcatttcctaaggttaggtacaatgaggactgcatttttaacattatcagggccatagagacattggagcttaaggataagatccaatttcatagcagtctgttaaagtttaagccagtctaatgacccaaatgttcaccataataattaccatcttgagtgatgatgttatgaatacaaaggaacactgcatctctaaaataaactacgtttatatgacatgagaccaatttgatggaaagaaggcaaaactgtgaatggtaattttgttttaattgttttcattgtgtgtactcatctgaaaatataataccatgtaattagaaaagttatcataacagaaaatagactggaaccttaactttttatatcaaatgttctgcacacgaatatggcctcctactgatgatctatggctccaaaatattggtagctataattatgctttgtaaaacagaagctgtgaatgtcttactacataaagacacaaagaatcatttccttactcattcactgctagtagaccctgaggcacagcatttcctgcccagatacctgattattaatccagtttttgttaggggtacactaacgttaactaacggagattggtgtttaaaccagttaatgtaaagaaatgctgtaggaactgaaatattccttttaaattaacaaaagtgttctttctagatagtcaaagttacatgaggacccaactgtataccagaaaatcatttgatgaatatggaattaataaaataatgttttgttgtatggttttagtactttgttggtgccaggttaaagacatgtggccctagataggataactctacagaagagaatttaatttgtttgcctgcttcactagaaatccaacaattaagtcagtgactctattttccaatattcatttcctccattttttcatctctttttgattgatggtatcatttcgttattttattttcattgacatggaattcattttggctaaaatgactttttgactatttgtgtatatatatatatatatatatatataattttaaaatcaatggaacaatattgtttctctacttccaagattatccctctatattctctaaagtcgataccgtgaaacagtccagatatgagtctaggaatggcagtacgaaatactgtaaaactggaagcaacttagtaggtaatcagtagggaaaatgaaactcaatataactgactctatttagttaatgtaatgatgcatttattttatatttttcatacaagtatttttttcatattttaaaatttcaaagttaagtatacatgtgactacagtcctcgcaacttctttaaggtactttatccggcagtcactagcagatgtgtttgtctaattcttagttttttttctgcctcataattttgttcacatttgctgtggagattttagaaatcacctagattgtttggtacaggaaggaaatcaaccctgggctgcctaattactgacaatctgtgtttctatggatacacatacattgatgattttggttaaccctttccacaaacagtcatacgtcccatgatagcttgctgtatattaaatcaaactttttatattgaaagtggataaagtaagccaaggtgttccagaagaaaatacatttggttctatatttttaaaaataagctatagcttgaaagtttcacctgcagtcctaacaagaaacaaattgggataaatagtccaaataaatgaaacacataaaaaaagaatctatatcaagtgtaataaattgtttacacctcaggtttttttctgctttgaaatttgtcttgacgtttgaccacatacatatttctgttgtattcacttctaaaaatagaacaggaaagatgtggacaacaaaaataggatatgaattgagagaagacgtgaactctcagaagaggagaagaatggcataaggataattagcatcgagatattgaatctcaacaaactaggacatggtggtgtagataatgatgaaagcatgcttgatatgtaaactagtaatttggtcgagcgagtaattttgacattcagatcaaatacaaataatttaataaaattagaccacaaactgcatagtgtgctcacataattgttttcattttttccttgctccgaattcaggtctgacagaggaacagataatacaaataacagttgatcccttacatcatctagctagacaaaatgatgcatatatactaccaccaatggaagttttcttcttttccttatatctttaatcttatttttaaattttatctatttcaatttataccttttatttttttttattacctaaaatgtgctatatgaataactttcagggaagcttggattaatgctgcatttgttcaatatgtgacattttccagttcctccataatattctagttaagtgtgtatggcccattaacctcctcctttgtgtttcagtgcacagacttctgtcattaatcatctgtacaactaaaaattcagttcttttttaaaactcacatcagactaaaactttagagatttgacaggcactggatacttttttattttcaaaagaataatcaaaatgtctcataactatcaaaatgaggcttagatggggaatatgtttaagacagactttgactaggggaaaaaaagagaaataacaaatccttgggtccaagtactccagtgacaagcttcaagtataaatgcaaatccttttagttgaatgagttacttattctagtttaagcagataatgctgatatcagacattttggtattatataattggtaggattaataattttatagaaaattggctcatttatctttgggatagcatgagatattaaaattaactctagaaaagagaaaataattttacttcaatatttccagtacatcttttggggcgtttcattttttaaggtacgtttttggaactacctgtaagcatatgataacaatatcagcacactagcaaacacactgttaaattttgtgaaaagacttattggcttatggattcagacatttacaaggttactatatccctcactaagaaagcataattaatttatcactgaatagatagactagttggcttttttttgaaagcccagagattatattaatttagagaatgaatataaaattgctttgcattttattgctatgggaataatttaaattgcttagtgactttttgctattttgattttgtggtggtggtggttgctgttaaattctttcattctagccatattttctcctcccaatttttcattcatttattaataatacatttattaattcatttattcattattcattatgtgaggaaacattgagttggaccacctgatgtagatataaaaacgaattaaatttttcttgccatcaagcataattgaggcagacataaaaatatttgacaaatattataattgttatagttgaagtcactattaaataacaaagtagcacagtttgagcttaaactccacctggagagtagaggaaggcttcatagaagtagggcatgaactggactttgaaggttgagaaggctcacttaagaaggctgcggggttggcagtcatatacaaagcctcagaaaggtataaccacatggagtaattgcagaaattgacataatttaatattgctttgaaattgcatagaagtggttacatataaaactggatatgtcagaacgagggtcaggtccatatgttcagctgaagaggtttcacattgtttcttgagaaatggggagtcatttcaaaaaagaggaatcatataaatagatttctgtactagtgaaattatccaagaaacagtgaagatgactgagttcatagtcaaaactggagtcagagagataacagaataattcaataaggtatatatgggaggaggagagtcgatttaacacaggcagagtgtaaatgatgagcaaagaataaatataagaaatcatataaatttcagagattatgaacctgaagtcagtatacatataggagaaatagaagtggtggatgcatgagaagtagtagttttgacaaagatcaattttctatgaaagaaaaggtacagtgcacattttgccttaaagtagctgagggtccttcaggtagagatattcagcgttgactaaaatatacagcaaaattctagaagaaaggtaatagaactaacaagattctatgctacaggtatagcattagcaattttcaatgcacagttagcagtcaaactctacccacttttcagtaactatattgtatttaactagaaatgatttttttgagaaatagattttcaataaaagttatctttagctaagaaaaagtgaaggaaagagtgggtatctagaatctaaagaaaaaagtattattcctctatggaataatttttctttctgtcaagcaacagttgagtaatgggagttatattgtccctcagggaccaaaactggctacgtaaaataataataagattatactcttaggtataaagtatggatataaatatagtaaataaatacacagtataactgtggcattaaaatttaatggaaggcaatgacttggaaaaagaaaagttcatgaatgctcctaggaaaaggtaaaaaatgaagttgagaaacattaatctgatagagggatgtgtcttcctttttttagtgaaggtatttctgagtgtaaggtatttttagtgaaggtaaaatttttagtgaaggtatttcgtatgtaatttgtgaaatcagctctcatactaaaagtgacttaatgatcacaaaatcacaaagactagtgatcttcctctcttaacattcttacatcaagttcacagtctgacattctgacatagtctgcccgctcagttgctgtggagttgaactcctctgtcgagtccatatccctaagggatcataagcttttatttctgagtaaggcagaaacttattgccaagataattagtgttagttattggaagatcattaatggcatcagcatcaaaaatcgctccaagtgggagagcttcctttctcttatggagttttcatttaataagccatgcttccacttaacgtgaccaaagaaatcggttgtattttataaattttttttagaatgtatgtacattcaaagtgagcatagatcttatacagaggatatttttaattgtatattaaaggtttttttcttagcacatatagtcttctgcataaagaagccaagaagaaactataatgataagacttctctggtactatcacataaataatgagttgtaaacaagcttaaaaaatacatacatatgatatagaatatataggcatgcactacttaactaaggggatacattctaaaaatagtgccattcaacatggtgaaaccctgtctctatttctaaaaatacaaaaattagctgggtgtggtggagcacgcctgtagtcccagctactccagaggctgaggcaggagaatcgcttgaacccatgaggcagaggatgcagtgagccgagatcgtgccactgcactccagcctggctgcagagcgagactccatctcaaaaaataaataagggctcagcgcggtggctcacgcctgtaatcccagcactttgggaggccgaggcaggcggatcacgaggtcaggagatgaagaccatcctggctaacatggtgaaaccccgtctctactgaaaatacaaaaaaattaatcaggtgtggtggcgggtgactgtagttccagctactggggaggctgaggcaggagaatggcatgaacccaggaggcggagcttgcagtgagccgagatcgcgccactgcactccagcctgggcgacagagcaagactgtctcaaaaataaataataaataaaataaatatacataaataaaaattaaaaaagtgccattaggtgattttgtcattatgcaaccatcattgggtatatttatacaaacctaaatggtatagcctactacatacctaggctacatggcataacctattccccttgactacaaacctgtgcaacatgttactgaactcaatacagtaggcaattttaacacagtggtatttgtgtatctgaacatatttaaacatagaaaaggtacctaaaaatacactattataatcttatcagaccactgttgtatatgcagtctgtcattgagactgaaaagtcattatgtggtgcatgactctattgtttaaaataagcaagtggcttctctgcctaacctatgcatgatggaaggtcatgagatttgtaatctaattcctctcatgcagagagtcactttggatagataagagcagcctaaaccctagctgaggttaagtgcaaatgggtttgcacctttaatttctaaattctagcaagcaaaattgtttaaagtatgtggaattaacagtctgactttaagttgtacttttcctgaattattttatcaacaaatgaatttaaggatttttaaaaagtatcaattgactgtgactcagtaaaattccatccaagaaagtcaatttctttctttcagtcttatgcgttcactagagatctagatctggggtagaaaacgtaaggttttcctttctaacattttactttcttacatgaaaaaagttttaacttagggtccataaattgctgctgcaagcaagggtctgttcagctgcaaaagtggtagaaaaaatatgaatgtgtattcttttgtttacttttccccctttaggagagatttttcaaaggagttcttgactcgcaagcattaacatttatctggtgctttttcggttcactcttccttttgtgtttggagggagctagtatcattctttatttggcaggagacagaaaagtcacctccatcacacgtttttatggttcccctttagccaggtttatgcttactgcagtgacagccaatttctctttcttagcacaggaagaggcaagctgacttgtgttggcttgctctctctccacatacacttctctcctcattgtgcctggacaatactaaagtctgtttgacaaggccaggaagtctcacataatctaacaaattatgtataatttttaaataaatttgatattaatcataaatgtttcatgctgcaggcattacaatgaatttcactagaatattggtaatggaagagctgaaacatctattgtgccactttgtttttttcttaagtgtaaattaatagaattatttaatgacactattggaagtgattatgaaaaaaaaacacaagagataaaccatgagacaagaacgttattcctttgcatatttcagtacagaccgacatgcagtaataccttaaaaatctgataataaataaaaccagaaaacattggcagcaatcttctttggggaagaagaaaggatttacttttgccatagggtataatacatttacatcataataacaccatacctgtgtcttttataacctagagaattgaactcttacatgatgtcactttttaataataaatgcaggaagttcaccttgagagtaaatagtagctagagctcagtaaattaactgaaggaagagaaaaaaacatatgaatagacaacagaatgttttcccttgaggaggagagcaatagaatattcacagaaaagcaattactgtgaaacatagtaaggtatgcagaaaaagtgaaaggaaagttaatgagtttaatagaaagatggcaataagaaaaataggttattaaattgttaaacttatcagtaaatacatatctatatgtaacatctgtagatcatctgcctgactgcatttatatgcacaacttaccacttttgctcgattgtaaactacatgagaacagaatctgtaatacattcattttaaaataactgacatttcctgttagaatgcctatcccggagttcagatctcagaaacacattctgtaactagggtctatccgaacctccagatccaacacgtataaattgcctgagaatatttcctgatctaggtctaggttgtcacttagaggttctcttgaacttaaaaatccagctcagaaaagatttccatatgtctttccccatgtttctctgtgttcaaacatctgagtcccaaaggctaatgatcattcaaatagaaacacaaaacaagagccttagcaaaaagtataatttctaaaccatgctgcagcaaagattccctggtaaatgtgatatttaaggaaataagtctaaacctttacctaatctaaatttcaatggcatatcatttttgccatcataaaggcaaatgctttgctagtttggtttaatttcttaaagtattgccttaatgttacaggacaccaacacttacccaaaggtggccattgggttagggtttctgcattatagtcccttctgtagtcaccagaaatatgttacaggaatagggttccaatccagaccccacgagagggttcttggatctcatgcaagaaactattcagggtaagttcaaagtgaaagcaagtttattaagaaagtaatggaataaaagaatggatactctataggcagagcagccctgagggctgctggttgcccttttttacggttatttcttgatgatatgctaaaaagcggtggattattcatgtctcccgtttttagaacatgtagggtaacttcctgatgttgcaatgacatttgtaaactgtcatggtgctggtgggagtgtagcagtgagtacgaccagaggtcactgtcatcgccattttgggttttggtgggttttgtctggcttctttattgcaacctgtatcatcagcaaggatttatgacctgtattttgtgccaacctcttatgtcatcctgtgatgtagaatgccttaactgtctgggaatgcacccagtaggtttcagcctcattttacacagctcctattcaagatggagttgtccttgtttatgtgcctctgatattaatgctgtgccttaaactattattgcaagaaatcaagaggatgttaatattcttttcagcatgactaatccttagacaggattcttcttattctaggcctctgacctctcttttcttagaacgtttacattggaacacttcccattccatattatctctttgcccctttgagatataaatcttgttaaaagcatcttaccagtttagaatttaggaatgtcttcctaaagaatctgggaaccatctctttgaaatgtaaatatttgaggagatagcaccccagtttccaatttccttgggagggcagactcctaacatcaatgagtaccaattagctaacacagatgacataatctcaaagaaaaacattttgaaaactcaggaataactaaatatgctccatacatcccacagatcagcctcccttctaacatcttgcaagacattttcactggcttaccctagtatataaaaactctcccacttcttgtttcatctgagttgagttcacagtgagttctggcctttaacatctactgcaatggctttgaataaagtattcctttcctatttaactttatccagtgcaatttttgatttgacaatagttatcaaaaaagtagtcatatcaaattgatgtttcatttaccctgtagttgttataaaatctattacctgtggactttgtttttgctgttttgagatagagtttcactctgtcacccaggctggagtgcagtggagtgatcttggctcactgcaacctctgcctcctgggctcaagccatgctcccaccttagtgtcttggactacaggtgtatgccaccatgcctgctaatttttgaattttttgtagagatggggtctctccatgttgcccagactggtctcgaactcctgaactccagcagtccaccagcattggcctcccaaagtgctgggattatgggcatgagtcactaacttgtcctattacttgttttgtgattgagggtctctgtgttacaggattctctccttagttcagttaaagatgggatccttgtcacatagccatgaaaaattagtcttgcagacaattcaaagggtgaggaaaatgggatttattgggaaaaaagggaaaaaggaagcctccacaaacccagagtccctgctgttcacttcctgccttgcagattgaataccaggttctgcccaggaagaggaggagcctggctcctctctgctgcaaatggctcagacttcctgaggctctaccacagtgcacaccaatcccagtgtgtgggctggtgggggtttgtcgaaaacacctttgtaccagctgtttcatgagaaatgtctttcataggatgatcacaaaaaatgttattttttattgttttttcaatggataaactttatgttgttgagttattgatgatatattgaaatggacttttcattaccagtgaggaaaaagtggcttccctttaccttcctagattatttcattagactacaaattaaatgatcataaaacagattaccaacaaaaaaactatagttaactatgtacatgcacaggagtccaacagaaatatgagattcaatgaaaagccagatgattgatgcttacatagcattctgagctatagagaaatatttgaggcttggggttagtgaaggatggtgaagacaagttataagggtgagggggtggagatgtatggtaaataaatgttgtcttgttctgcagatcaaaaataggtaataaaattgtctcagaggagctatcttcctgtattggacatctgtattaagtacttttactaaagcagtgaagaggcaaggagaaaacttccccttcacccttggaaggctcactgaaaattcaactctcaaaagaaagattaataagagaaaagccatctcatttattaaggtgcacatggagagatccggagtgattacccaaacccctagtggggtatagaagcttatataccaccatgaggttacagatagaatggggactcagagcccaggcaaaaataggttatgttggtaaatcaggttatagcagtaaggcaggttatggatagaagagaagcggaggcttggctagcaaaggtgaccttgtaatgtaaatgaaaccttgcatgtagctgccctcagataaaatagatggcatatatttctttcaggcctttaaagctgtcagactctcagttactctttgctagatccaggaaagggaagtcctggctgcatcaatgcagattgtccacagatgcaaatctctgccacaaaagatagctttgtaaggctacatctgtttgctggctctctgaacagccatctccatgtatgccaaataaccatattttggggtatgatactgttcgggtctgtgtcccaacgcaaatctcatcttgaattgtaatccccacgcgttgagggagggacctggctggaggtgatcaaatcatggtgaggtttcccccatccagttcttgtgatagtgagggagttctcatgagatctgatggcttaaaagtatgtggcagtttcccccttgctgtctgtttttcttcccccttgcgaagaagaaggtgcttgctttctccttcaccttccaccatgattgtaaatttcctgaggcctcccaaggcatgcagaactgtgagtcaattaaaactctcttctttataaataacccaatctcaggcagttctttatagcactgtaaaaacaaactagtacagcataaaatatttttttcttcagtagattttctttatagattacaaaaggacaattttcagagctactccttttctgcagtttctcaggataaccagctgaaaatataccaaaagaatctactttgcagtggcacattctgctctccaacagtcatatgagagttaggctcagatgtatcctgagccctaagagtgccaaatcactggtacaaaccaaaagtaaaattgtaaatcccctcagccatctgcatagaccacctcctctccgtcaagagcattccaaagttaacctgaaaagctagttgaggccatgatgggaatgggaaacaagccatgtctcattatactctcctctgttttggaattgctgatagaacagactctgagtctgataggaaacatttacaatctattctctgaaacctgctacctggaggtttcgtctgcataataaaaccttggtctctacaaccctttaacttaatccagacaattcctttccattgattctgagtctgtataatggcttaactcttcctaccaattgccaatcagaaaatctttgagtctaactgtgacttggaagccagtttcatgcctttctggagtgaaccaatgtggagtacaggagaaggtcagagagactttgcttccgaggcttccatttcctttatttcaaagtactcagcatgcccaagtgccatactttggggtatggttttctgagccctaacaagagtaaaatctgtacatgaggtaacagtgtgctagagacacagtgagaaatagctttgttaatggggtagctatttgaataaggcgtcttttcctaggatctgtcaattctcaaggacagctttaggaaatatgtgtctcctcccaaactaacatggagattttgtgatgtttatgtattttcctgggcaagaagtttttctatttaagtcagttctcaatggattaaatcttcaaactcttaaggccaaacccatttaaattaatagaagagcatctcttttgttggaccagagtgatttttcagctattccaatagtgatatagaggtagtatgtttagacattcctctgggcatgcacagctttctggtaagttcaggcccatcatctaaatatcatacttaaaaacataaatgggccgggcgcggtggctcacgcctgtaatcccagcactttgggaggccgaggtgggcgggacacaaggtcaggagatagagaccatcctggctaacacggtgaaaccccgtctctactaaaaaatacaaaaaattagccgggtgtggtggcaggcacctgtagtcccagctacttgggaggctgaggcaggagaatggtgtgaacctgggaggtggagcttacagtgagccaagatagcatcactgaactccagcctgggcgacagagcaagactccgtctcaaaaaaataaatacataaaataaaataaaaaataaaaaacataaatggaacaaaaatgattttattaaacaggggtcttccatttacattagccaatgttgctttcctcaaattgtgcacaatacccacagtgttgctaagagtgacagagattaatggaatcaaaaattatctctcactcatgcaggtgcaagttagatttcaaattgtatggccatttgctttgttctagggaaaactctttctttagtaatagcattctactttctatggtaattgagctttccaaaagcaaactgcttcttcaattatgtttccatgaatgaaatttttgcagaatatatgaagagttctgtttctttaaacactttaaaacattagtttacttttttatatactgcacaagtgcaatgaaatgaactcattgactattatttaactgtgatgctgaaagctaaaatattgcattgcaagagcttttagtgatcatcatttagcattttaaaggtactaaaagcactattcatccatcaaattgttcatttgtttaaaacacgtgcaacaaaagctgagtgtacctaaaagcacaaaataaatctgctcccttgcactttagttagatgaagcagaatgtgcacaggtaaggtcagtaaaaacacatacacacacgcacaaacacacacacacaaacacagtatgtttgtactccaagaagttcaataacagttgaatgcacattcataacacatctttggaaaacacatgaatatacttttaaatcctgaaacaataaaaaagagaattgtcacaagattggtttggattttagtatcattctattagaagtaaacttcataatcattttaagaactgcaatcatctgttttactttgcatttctttcctttccttgtttccctctgtctgcttctgggctattagagtttctcaaattgtttgtatcacatagatacccacgtaaatgctgcagggttaactccaagacactgttagacacaagtgtgcttgtatttcaattcttgtaattataagtggccccacttcagactattctgttctatgaaacacaacggaaagcatcaaattaggggaaaagagtggctcagactgccccaagcaattaattaaagaaaattactactggatgctttatgcacagcaggggctctgtgcatgaagaaatataactgctagtcacacctgtgctgattctcactgtggaattgaaattatcatgagtaaatgtaattacttagcaaatttaataaatgttgtttggggttctgaaaacagcacttggatctacaaattacacagtgataagtgtggcagcacaagttcagtggtctctaatagcactaaaatatgtagagcatcctggaatgtaccaggaaagcttatgagtaagtaaaggtaataaattgctacaaaaaaatgggtactaagccactcatagttacccatgctttcatgttttcctttgattatgtaattttgacaaagttatttttttcaaaatccccagtagtttagatatccaagcttatcctcctgaaatacaaataagtttattcctaacaaaaaatgagttagtatttggtaacgcttgaaatgaagtgctctaaataagtatttaattaagaataaaacagctattgctcttgggttgtgatgattggcaataattgctttacatgatttaatggttataaaattaacaagagataagtaataaaaataagaaattaagctacatttttcatcataactttaatttgtatgctcttaagaatcataatgatgattggtcttttattaaatgaatattaagatgaaccttcatataatctatattatctttgaagaatatgttaatcattaagtcataatttataattaaaatgcaatacaatttattttgtcaaaaggaaataaagtatttgtgtattttgtaaaattgccatatggtaaaagcctattcagagtataagccttctgctataatactaatagccataagtcttctactttaaatcaagaaaatgttagaaaatgtttaatagctttagtatatttaaacaattcatcaaaattatttaaaattttgctagggctgtcataacaacatgccacaattgggtgatcaaaagtcacagatacatattctctcacagttctggagactacaaatccaaaatcaagctttctgtgggaccatgatctccacaaagactctgggaattaatgcctccttgatcttctcccttctggcgtttgctgtcaaatttcagcattccttgttttgtagacctggcactgaaatctctactttctttatcacatggtcctctcccttgtgtcttcatgtcttcatgtcttcacatcatcttccttctctgtatattcacatcatctttcatctgtgtatgttcctatgtccaaatttctcccttattagggaaaggaatttatctagtatccaatgtcttaagttcaataatggattttgtggctgcactagtttaagatggctatatgtgaacttgattacagctataagaatcctatttccaaataaggttacattcgcaggttctgggtgggcatgagttttcaggggccactaattaaccgagtacaaatataaggtgttaatgttcttgtaagtcgtgtggctgacttctccctgttttgtcagtgccctgcaataaatacaattcccacttagtatgcacctatacacaaaaaagaatatttattatgctctaatggaggaatcagggtcagaacacttattctgtgaccagataatacatattttaggctttgcagaccgcatggtctttgttacaattgctcacccgtgctgtaaacaataggtaaatggattggaatagttggatttggcccccagtcatgattttgcctacctttcctatggtggaaaggaattctttattttgtttaacagagtaaatttaaatatctatatcaaggaaaatctgttctttgaaagcattgtccacaatttttcaaaacccagattttatttttaaagctatttcaagacctaggaaacataatgcattttaaaaatcaaacccatatgaacaattaagcctagagaaaagaaatacatatatttggggtgaattgtaaattcagacacaaagcccttctgagtgtgggaccccatgtgacttcacagatcatatgcccttgacattaattctgtctgaaagtatttttgaaatcttgttctttcaacacactaggtcctactaaatgggatttttataaagtcactagtaataactcacaaatggatcaaatgaataatatattacttaaagtgcctattataatgttttgcacattaagtgttgtcccagtacagaggtttttagatgtatttacacttttaataatataaatatcaagtggtgagtattgccccaatataaggttattttaaatgtgatttattatataattaacaatattactcttataatcatagtaatattttagtcaaatatcaacaaataaggtgctattgctttatgagtgttttgtagaaatagtcaaaagttctagctatgaatcctgaaaagtcaacacttagtgaaaactttggttcactaaaaaattatacaaccaattttgtgaaattactgttgcaagtctcattcatttaagtgtgattaacaaaggaggttaaatttcacatagcataaactttttctgtttttttatttttagtgtgagaactttctctaggaataaaaaaaaaccctcatgttattttcgttttaaatgtataacctttggcacaaaactgagaaaatggctgcttcactagatgtgaaactgcctttcccttgcaagggttaattactaaagaagaaattcaaacttaaacaacaaactctgcaatcttaattaaaaagaaactatcaactggtgactccgggtagtttagagatgacaagtatcaaatatgtggtaaagtgaaatgtaaaaagtaggagaaggtgattataaggcaggtcagcttttagatttgccatagcagagatagaaatactacgactgattttaaaatctgtatgttgaactttacctaatgagttttatgtggaggcagatgaatagagtacagaacacaaaaactacatttgcgtaatggaatatggttctgcttaactggcaagagaaaattattttttaaccattaatgcaaatatctactgtttcattttatgttatctgattattttaaataatgtgtctgagtagcaaatagaaggcttttttccaacaaaagatcattatatcatttcatttttccaattctgtataaatgtccaagttagttttttttgaggtcttgcaaacaaaatagacattcaaatattcagattttaatttttcttaaattaattttgttatttaaacaatgtaaaatcttataccacttgatatatgttgataatccataattccatttgatggcacaataaaaatcacatttgtgttttaaattttaaaaagcaggatttatttttaaactaaaaatttagactctcttagaataaattacacagtctcaaaatactattgcactctgctacaagtgaaaagcaaaattttttttattaaagaagttcaatcttagtgaaataatttacaataacctagtagggatggtgtttaagagattgaagcaacataattcacttgattctgatacatacatacaaaattttctaacagttacttttaaatacattggctctgaaagttcattttaattctttattctgagtataatacttttattacaattttaaacttaattttataaagacttttctgaagtataattttaacccctcatatattttctaaacaattgaacagaatatttatagattgaaattttaggcttaaaacagaccctcttaatattccaatcttttttgagtctaagcccacgttccctgatctaacagataactttaagaaaatgatattaattcatgtcaaacaggatttctgtctttgagagaatcacttactttcctcaaagttatttttgaccatctattgtgcttaatatgagatggttattgagttacttgataaacttgtagtttccatacataaaagtataaccattctgaatatcaaatacttcatgataataaaattataatttacatctatattttactttgtctattcaaaaaatgtttagaaaaagtacatggagactgtagtcagcatattatttcaaaattaatactaatgttaatgtatgttgaatacctgtgatgataataactgtacattctgaaaaaaatgttactatcctgtatctaattgctaagtaaatcactcaccatttttaagcacttattatatgccatgcagtgtgatatgttgtgaaaggatgtataaggtgacacaaggttctatcattaaagacatgaggaataaacttatcacaataaatgatatctaatggcttaaaaaagaaagaaaatattctgactgtgttattagagtttcaggctggggaaacagtcacaatgatgatgactaatagatcatttaggccttaaacataaatagaactttattaagcatatagaggaaggggaaacaaatctatgtaaacgaaatagtatgaagagaagcatagaagataaaaatttaaaaatacaagaaattttaggaaatttttaataaccaacctagaaaacaacttgagattcttccttatttttaatttcatttatacaccatcattaaccttgctgagtcttcctccaaaatgcctcttaattttattacttcatttctatttgtgttacttgctgaataaagtttcacgtcatcatgatcagggattcctgcctaagggtgattttcatgcgtgaaggatatttggcagtgtgtgaagacattttttattatcgcaagtgggggaagagcactagtagtatgtagcaggtagaggccaagtatattggctaaattgtagccaatactaatacactgaagaatatgctaaatattctacaatgcctaggtcaagttcccataacaaagaattatctgtccaaaatgtcaaagtaccaaactagcaataacttcctaactttatctccgccttagaaattcctattcttgattagaaatcatctagtcatgtaatgaatttgatctactataaaatatccaagaagagatatctatgagacagttaaaaatctaatgttaggcatcaacagggaaatcatttttggagatacaaattagtgagaaagtataaaggttcaaaatacagagatggttaacattttctagagaaaatctttaaaaggaaagaaaaaataataagataataaaatatttatatttaaaaggaggatgggctgggcgcggtggctcatgcctgtaatcccagcactttgggaaggaggccgaggcaggcaaatcgcctgaggtcaggagttcaaaaccagtctggccaacatggtgcaaccccatctctactaaaaatacaaaaattagctgggtgtggtggtgcatacctatagtcccagctacttgggagcttgaggcaggagaattgctttaacccagtaggcagaggttgcagtgagccaagaaagaaccactgcactccagcctgggcaagaaagtgagactccatctcaaaaaggaaaaaaaaaaaaacaaacagaagaatgaggatgtatctgccaacaaaatattgaacaaacaactgaaacagaaacattaagaaaggggaagaagagaacatctcttaataaagcacatgggttcagctactgaccacttccatgaatttggctgtcttcaacatgcctttaggattagtaataattccactttttccaaatatatgtttgttatctacacatacattagatattgtttcttatattgttaacccttgtatttattctcatttggtaaagtagtacaaccaacagagaataaaacaagttatttcaaaatgtaaaaatctggggggtcacaggatagaaggcaggagcacatcagtgggcacaaaatcccagatgaataccaaccatttctcagcttttggccccttcaatccactgcatgatgcaccaaggatgttcaggaaagtaaaatagcactctttcatcaatcatttctaaggcatctgtaaaatgctgccgttttcagggaagaggggctttttcccttacctgaaatgaaaatcagcttaacagaaattgagcttaaacatttacccaactcagtaattttggcatttgtgaattacctgatgaatacatacttgtttcttatctagaaattaaaaaatcttacagtggttttgtatggtgaaaaatctatttctatcattgacccaagtattcccagtaaggaaagaaaagcttttattgtattagatcctgcttgcattaaaattatctttaaatattttgacttcatctatttgttaaaactatcaaatagcttacttagcaaaatgaatatttaattcagaaaagaaaataaagcaattactgtgtgtatattcagccatatacgtagaaggtgccaacttaattgcttagaggggaagtctttctttttcattctatggtcacattcccttttaaattcatatgtgtgtatgtgtgtgtgtgtgtctgtgtataatttatatataattgatgtacaaatatatatgacataaatatatataaatatatgttatacataatatataacaatattatttatgacataaatatttgtatttacttatttgtcaaacatttagtgactgtcaacaatatgcaaggtgctaagcatgccactatgttaacaactataaaaaagccaaagaagctttgagcttggaatctgaaaggagagacagaaatcaaagtttatttctgtctacagaattagtttattaaatattaataaatgatgtttgagaaaattataagttgctatgaaagcataaaccacaggatatgacaagtctagagattttgataaagctttgtagggagaatttgaatgaatcaaactaagaatttatgaagattgagctggtaaggaaaagggataaattcattctaggaagaaaaggaacagcagaatgtccttaggaagaagtgagcatgaattatttgctaaaagtggaaaatgctaggaaattacatggagtgcaaattacacacccaagtagagatgtgaaagtgcataggaaaagatgcagcatttaatatgcatttaaagtttattattaatagcttgaaaataaatacatgaatgaatggatgaagaaaagatttagcagaagattatttactatcaagaggagcagaaaatacttattagacaaaagtgaaaaatgcacagaaaattgagttacttgccaaaggtcatctggaaacatcaaggaaagaattaaaacaaagtggaaaagaagcacaagcttatagaaattatgttgagaccagaggctatttatttttaaaattggaacacttttttctgaacttacaatacatttaaattgattggaaatattattcatacacatatctaagtcaaatatataatctacctaatggtttctggcatgtattttcctttcagtcttttcttcagcacataccatgaaaatacatgagatagaagggatttttaaaaagagacctagagattgtggggctacattattcagaataaataaaagcgaaatgaaatctaatttaaaaacatatcacaagatctaacttactgttatatacacaaagtgcattttagtagacaatatacagacaatgtttcttttaaatcaacatttgttgacaatgttatccattatccactattattcttattagttgtgtcttatttttattaatttttttttctattggattttttatgagagatttgtttggttataagattttaaatgtggctattatgtcagaatacatatctcaattcaaatgaaatctttttccaagtttacaatcaactgtgtccttccgtaatttaatttgttgaaaataggaagcatactggtagtacattttagtaattttaaaatcctttagtaaaggaaaaattacattttggctttgagaaatatcatcttcaagaataaaaacactctttcatattcatgtattcatagagcataaggtattcactctatagtacgtttttagatttgcaaatatttttgagtagaacataaaagaaatatctaacttcctaatatcaaggatggtgtgaacatcagaaagctacctttgttatcctaaaacaacttaggttttgttgagaaaatataattaaaaacagtcttattccaatcttgaaaacctctctacagaggtagaagagaaaaaaaaaagcaattttattattgaataagcatgaaaccaggatgtgatgcacatcacaggcaatccactaaagagaatgcagacagaaaggaatctcacccttttatatagccaaacagatgcaacctattgtatacaccttttcattgttgtgagataatcataggatgtaatggacttacacaaaattggatgttcttatagcacagaggctatatggtatagcctattgctcctaggctacaaatctgtacattttaccaattactgtaggcaactataacacaatagtatttgtgtatctaactgtatctaaatatagaaaaagtacatgaaaaatacattataatcttatgagaccgccatcgtaacatgatccattgttgaacaaaatgttgtgatgcagcacatgaatatgtaggccttttagtaattattcaatcttcctaaatagcttttttcagttttgcaactcagtagcatccatggccatcatctaatataaaagtcttggccgggcacagtggctcatgcctgtgatcccagcactttgagaggccgagacgggtggatcatgaggtcaggagttcgagacagcctggccaacatggtgaaaccccgtctctactaaaaatacaaaaattagctgagcgtggtggcaggggcctgtaatcccagctgcttgggaggccgaggcaggagaatcgctggaacctgggaggcagaggttgcagtgaaccgagatcatgccattgcactccaacctgggtgacaagagcaagactctgtcacaaaaaaaagtcttattataaggtacaaactgaaaggcaccgattaaactttgagtgtttaatgtatatagctattattattttaagtcttgaagacaaacctctagcctataggtattttttttcccagcgtgggatctaaaccaatagctctacattataatagtcaacaaaatattcatgagtaacagaaatttagtttcatgtatcaatctatacttaggtgggagagaagttacatcacaaagttaattaagtaacaatagacctgttttttgtggtcgctatcttacaatgccaagtttctatttttctattaactggaatgtttgttttcaattaagccaattaattgtttttgtttgttttacaagtagagcttgtcttagtccattgtgtgttgagatagcagaatactaagatggggtaatttaagaagaaaactttttcttacatttctggagactgggaagtctaaggttgaggagctacatctggagaggtcatcttgccatatcataacatggcagaaagcaccatatggctcagatttctcttccctttcttaaaaggccactaatctcatcacgggggccctattcttatgacatcatctatcactacatcccaaagaccctgcctccaaatagcaacaacacataaatttgggaatttaatttctgacacatggaatttggggacacattcaaaccatagctaggcttgaatacttggatgcatattagttttattttattatcaacaattataaagaagatggtgtcacttttactctgccaataataaaactgttggttatacaattccaggtcctgtttctgctgggaggacaatttgaactaactggaaaggacatcatgagaaccattactgggagtacagaaagaaaaggtcatgtaacaaataagttttgattcctagtaaaatgtgattcttaaagtagtcaaaataatccactggaaataagacagtaagaccatctaaaatgtaatatgtaaatatgttctctagagtacctcttcatctgaattcagtaccaagatcagttactcttgaaaacttaaatttcaaggccttgtgagaaccacagtcaagtcttgcccaggtgctgtctccgtgtgggaagcatgactccagctgagttgtttctcttttgttttggttttggtttttgttttattttgttttaatctctgatagccaaacgagtgatcagcagcactcgaaagccttctttccagcatggtgactgtattttctttctggaatacctttttgtagatgaaatttcctggtccacagagatagccaatttccactggtgtgtccttccagatcctattgtctttaagttttagggtttctagggaagatataaacccttttaggcattggaaatggttagaagaggatttgcttatatcaggcacaggatgtgctcttagacccaaattcatggacctgccaaatgtaggttcaaagagaagattctgtgcttgaatgcagaggcagcaggaaaaagactaatgataaaactctggagattttaacccagtacatagctgaatcttagctaattattttttaaaatttgatttatctactttatttatctggaggactgaggaatataaggtgtatgctacattatggaaatcagcacacgtttgcataaatcctaggcaatggtacagataaaataactttctctgtctgattcaaatactgtggtatcccaaaagttagaactaaggcttttaagagagtgtttaccattgcctgaaaatcagtttttatgttttgtttcttttttttttgaagagggtaaggcctcaggccatccagacatcatacacacagtaaacagacaaagctcttaccttttacatgtagttctatggaactcaactaccaaaaggctcctggtagttactcagagagcatttcctgtggtttcttaggagtagcatgtaaataattctgctgatgaatatcacatctctctaatatgtttgtattaaaaaaatcttttttggtgtgcaggctcagagtctagtgactttaaaaatcattttttcttgagatgatttgttgatgacataagaaccctaaccaagctgggcacggtggctcaagcctgtaatcccagcacttggggaggctgaggtaggtggatcacgaggtcaggagattgagaccatcctggcttccatggtgaaatcccatctctactaaaaatatgaaaaattagccaggcatggtggaagaagccaggaattcaggttctgggactttttaaaattttgacatgtatattgaatattcaagtggaatgcaaataggagttggaaagtcagaaaagtgttctgagatggagatgtaaatatgtgagttactggcttttcaagagtgtttagagcatggtaatgagtgaggtcatcaaaagcagtagcatgaatacacaagagatgtctaaggcctgatacctggaatactccaatgtaaagagcttggggagaagcagagaaactaccaaaggagattgagatagtgttgcaaataaaacagaagaaaaatcaaaagccatgtgatacccagctctaggaagcacaaatggtaattttgtgcaaatcaaaaatgtgtcctttcctcatggcacagtactgccatctgctggaatatgtttctaaaaactgtattaagattataatgcccccaaggtaaatgtccttcagtgcttagctgtaagcagtagagaaagtgtatgaaggtggaggaagtatatcaaatgtttctgatctgtttaaggcttatgagtattgaaaaacaattaatggatttagcaacattaagtatgtggtgacgttgacaaatgtcggtttgaagtcatgaaaatgaaagtttagttactgttgagtttaaaagaaaatgaaaaaaaattgtacacattattttcattttcttttaaacctacagtaactaaacttccattttcatgacttcaaaatgacatttgttatggtcaccaaataatctgtacaacaaacccccatgacacaagtttacctatataacaaactgcacatatgtccctgaacttaaaataaaagttaaaaaaaagaaataactgtagatagtgacaatggaccattctatcaagaaattttgttggaataagaggcagagaaataggttagtctgtagttgacatggaagttgcttcaaggaagtagggtggaaaaattggtaatgaaggagaaataagaaaaattaagaccacagcagtctgtagtagatgagagagaataagatctaaggcactaatgaaggaattgtctgtagagagacagaaatatatagttcatgcacaggagatggtgaaaaacagagtatgtgagtagtggctctaggtgggcagatatggtaattagagtccatagacactttcttcttttcacagtatagtaagaagcaaggtcagcaaaagcaagtagggatgaaaaaggagatgtgagagctctctggctagcatcttctcactttactattgctatgggaactgggagaatctcaaaagtatttacatacttcttggagaatacatttttctgatgaatatttatagcaccagcctaaacaaatattatttagtagaacatgcttgtttttaataatcttctttcctcacagtgttatctgttctactcatgtattgccaagtgaccatttcatctgaatattacccaacaggtttgcatccttctctgaccttggacagtggcatgtgtttctaacctggttttcttctccattaatgaaacacattattatttaatttccaaactctgtcaaataaatgtgtgaaaatatattcatgtgataaaaataatcactgataatttgtaatacatttgtagaagtgtgacttgtacctcatttgtgtgctgacgtctagtgcagatctcagagtcaggccaactctccattgtcctcactatcctacttgtcttagtctgttttctgatggttataacaaaatattttgtactgggtaacttagattgacaatacatttatttctaacagttatggggactgagcattccaaggttaagggctacatcttgtgagggctttcttgctgatgggaactctgtacggacttctgagccagcacagggaatcacatgatgaaaatgccacatatgataacatgcggtgctcaagtctctctccctcttctgataaaaacaccagtttctttcccatgaaaaccaattaattaattaactatttaaatacaccaaactatgaatgggctatttcatgaggccagagccctcttaaaggcctcatgtctcaatactgccacgttagggattacatttcaacatgagatttggaggggaccaaccattgcacttcacttccccattttgtgaccaaggccttcagactacaaagtagctatttaattctatgtttttgacattgtcccatgcctgccttttagtcgaagaggtatagtttccatggtttcaaacaatactaacagtcccaactatcttttctttataagatcaatatggaaaatttgatgaaataaatgaaaaaaactgtatatatactaaactactatgagctagttaatacagaatttcttgtctccattgttgatgggggtgactaaaatttgagttgagtttctgcctaatttcaacttttattcttgaatgggggatttccccatttttgaatactactatattcaagaagccaagcacaagaaatatttaaggataataatggctattttcttgcccaaagtggatattttgcatctctaggttttcaaactaatttatattgctcttaccaacttgttgcctgtaatcatattttccatattgatagtgagaatctttatctcattccctgcctttaaagataacttttattatagattttgttactgtttacaggatagaatgttactttaattcttagttttcaaagagtttttattaaaaccaagtattgaacttttgcttatctattacactagccatatatttttctactttagttaactactttggtgcattgaaaaaatacattttataatgcgtagtcaactttacagtcctgaaataaactgataattatgtcataattttattaatataccctgggtttgggctaaccactggttcatttaatggctttaacattttcatctgcctcactttgagtccaagataaaactggcctacggtattatatttctactttctttgttcaataatgttacaaatgttaccctaacctcataaaaacattaaaagaaattttagtatcatcaagtggtgagagaatttttgttttctatttcctcttactaattgtttccaagatacctggcttctctgtaaggctagtttaaaatgttacacttcttacagaattctagctctagataggccataattacataaataacagaggatgaaaatcccttcaaaggatgaaacatagaaattgatgtagtaaagctttaggctgtccaagataatgttttctatttaaaatattgcaaatctggccaattgaattaaattcactttgaacaggctataataagcacttacttttggtgtgagtaaataacaaataaatcacttaagaaaatacggcattattccccctcatggtgcatttaaactagaataaaaaattgttacgagaggaagatgaagtcaccaaaagagctgagaattgttaaagaatgtcaggcagaatactcataaggttgaactgataacataattaggtacttgctaaaaacttaccaagatacaacctgggcaataacaccctctagaatggcaaccagactatatagagtgttaaaaagaagaatcttggtaaaaatgaggctagcaattaaaaatgagaaaactaaggataaacagaaagggttctagaaacaattcaggaagagatatttgaaaggcatgtggtatgataaagttcaagtgacataaaattaatagtaatatcatgaagcaaaaagcagaaatggaaagatatagaacgaaaggggataatcacttgaatcacaagattatatatttgagttcagtacactgaaatatttcatttttcaatatgaaagacatatagtgacctctaggcactcattttaatatacaagagccattaaaaaggcacttcaaggtgttagcaggatctactccattataaccatggatgggaggtttgcattcactctgaaaagagtttcctttgcagttttatgtgagaaaaatacagtatcaaaatgattatattgtgatacagaatctccctattaaccaattgcaatgacccaaatatgaccccacaagaaatgaatctggtgcatataactaacgagatgggtgaaattgttcatcctgtaaaattgatggtcagtcactgaagagaagaatttgggactgcatttcaggaaaaagaaccaaaacagtaacagttctgcttctacataattatacggatcctcatgagtcacctgtgaagaaaacaaaacaaaacctcttctcaaaattctgtccactaatttctaaggaaaaaaatgtggtagataggaaacatgatactgctagagcacagagatgcagataatgaatgagaaatctttctctaaattaagatttttaaacattgattttgctatttgaatataggaagatgactcctgttttctcatttgatatatttaatggtgagttcacagatacaattgtttcctcggcttaaggtcaatgatcatggtggaataggaaaatagagaaaaatgctgaaagttttcagctttagtgtactatctgttaaaaagagtatttcaaagacactgtttttacactgttttaatgaattcagactatgtctcatgatcttttggaaaattgaaataatctcaaattattttcctgagtacaaaatgtcaatttaatgagagtttaaatgtgatgacccaattatttcaattaaattatacaatatttattagactataagttgcaaactgctatcatataactatgaattgcagaagatagaagaggatgaaataatacataagaccataaaattaattatatcattctctctttcatagaaacagacaatatatgctcattataatatttgatgacttagctatcataatcagttctatgttttcacaatactgtttatcctgttataaacctaaattccgtttgatcaattatcggtctcagagcaagggaatcagtcttgcatgtattaattgaagcttatggtatgaagtacagcccaaagattaattttgcaagaaatataactataaaccagattctgacacctctatacaacacattaacacatctttgtcataagcacgattcaagacaacaccactttagaactttagttctctgctgttgaaggttgggagattttgtaaaaattttttacaaagataatctagtcatttcaaaaatctgccataagagaaagattttaagtttgaaagaagtcagaactatagttaatgatactgtattgtttacttgaaatttgctaagagggtagccttaagtgtaacactatgttatacgcatgtacaagtgagtcttaaaacaaacactcatgattttacttgtagcaactttgatttgctctctttacaaccaaacttcttgaaagtgattttgactcccagttttcaattcctcatttaatattattttaagtcataacacattacttcatttaaagccctcctagtcatactcctaattgttcttgtctctaccaggcacttgacatttatccaaccattcagttattaaacaaatattttttcagtgcttgacctgctgcctattgctgggatatgtcctggaaatccaacagtggatgcttctattgttttgtctacctccgtaaatagctctgcttctgttggtctccagcaatgctgtccaatctcaaccagttagttatgcagaaaatgttgtaaaactcatgtgccagcattatctttatttttgcctcaaaaacagagcctattgacaataagagtaaaatgtttcagttcagaggcaagaattatacaagtgaacattttgaagtaatgacaatgagtgactataacaaaatttagagacttataaaggaaactacgtgatgcccaggtgctgaaacaccattcatagtggagaaatcaaagtcacgccatgtgtgttttacaaatcattaacacattcagaataaatgcttgaaaatatgaatagcttagagaggaaagagtttttctgtcctacttacttacctatctgataacttgtgaaaatggctgcttcaacctgtatgcacattcagtgtaacatttccaaaacctatactttctctaatatcaccgagccatgtcaggtgaaaatacacgtaatttctgtagctattgttttgtgctaactttacagaattttttcagtcaaccaacagtattacattacttagtagtgcccttgtctcagagccagttaatcataaacattccgacaggttgaaccatctaacaatggaatggattctcatgtgttttctgcacactcgctccccaattatgttctatgagaagatccagaagagactcccttcactaagggattaagaaacatatgggtaaggggagattttccatcagtgaaagttctctggttgctcacttctgtgggccagatatgactataaaagaggccacaattgagaaatgctcacagatttcaataagaatgatgtgattccagaaaatcacatgcaacattgtagcacttaaccaccaaacaaaatgtgggcatacctacaatcaaggctggcagagttgtacaggtcatcagagtgtcttggaccaagaaaacttgggcaggggctaaatgatattgacatccttagaacaaaatagagaccctttcagaatattgcttaattcatatgacaagaaattcttcaggtctggagccaaaaacttgactccagtcaccactgtggagatatagcctcccaccaagttttatgttaattttctgattcagagccctttgattaaatagggtgcctggagggctctgcactattgacgcaccactcacagtaaatctttccccatgccttccccaaagagacctgtggccttctttatagcatatctactctgtgaagcaattcactgtgaatagcttttcctggcacctgagaagtttacctagactactcttcttcatggatttcatagtctgggactactggtcacatctttctttccagaatactttcctattttttgttgttgttgctgtttgttgttttgagacagggcctcattctgtcccccaggctggagggcagtgacacaatctccactcactgcaacctccacctcccaggctcaaacgattctcccacctcagcctcctgagtagctgagaccacaggtgtgtgccaccgtgcccagctgatttttatatttttgtagagacaaggttttgccatgttgctcaggctggtcttaattagagggctcaagtgatctgcctgccttagcctcccaaagggatgggattacagatgtgagccaccatgcccgatctgcttttccatttggattcatggaatagcctctcctgattctacttctatatttttagctactttgtattattggagcataatatagacacagaaattgtcctaaattatgagagtgtaggtcaatgagtttctcaaatagaacaacctcatataatcactacattgatcaacaaatagggcagcccccacaccttagatatcatcattttgacctcttccagttagtaaccatctaggtttgtcattaccttgacttctaacactatgaattagtttcgtctgattttgagcttaatataaatgtatcatactgtatgcattcttttatgtatggcttcttttgctcagcatgataaatctaatgtttggaagattgcttcaatgttacatatcattatagtaacattcattttcttacctcttttgtatgagtaaacacaaattatccattctacttttgatgaacatttgagttgtttcccaaatattactgtattataatgaaaactgttatgaacattatgtacaagtctttggagaacatattatacacttctgttgtttgattcactcattaaatattatttttaccagtgttctgaaattggtcctctttggtgatcacgcatcacttttgttactacttatttctttaaaatttctacaaacacatctgtctgctgagaacttctgaacttttaacaggtacttccagtacttaatatttaattatttttcttctttaattttcctttctatattaccttcttagattaatgtgtgcaagacacacggtagagttacttaaagtattgcctttttcttatttggtaatgaaatgtgtcaattctacttaattaacaaccctatacttaatgatcttctgccacggtcttagtttctgccttcatcttatttgaaagtgtttgtaaaactaattttctgatagcaatgctgatgtctagtgatttagagtagttgggttgttaaaaattagttactgcattccaagataaaagttgttattatcacaaactctttgagcaatccttattgtagcagtgcacgagagaatgaagtgaatatcaactgagaaactggaaaataataagcaataaaatgcttgaaaagaaaaaaaaaaaagaaaacagtttttgtgaatgtttggcaggtgaatcccctgaggaatgaatgccttggtatttgtgactccacataaatcaaacggacataaaaagagatctcaattttggcacaaacaaattgatctgactggatggtggctgataaaatgcatctttaccccaagttcaaaaagatcttggctgatcaaggcagcaattcagaagataataaagtctggagagacttgaacaagttttgtggagtttatataaaaggaagactgagagggaaatgtcaaaatattgaggagtacaataccatgatcattataaacattacattactgaaggttgcatatatggatatatgcaaatgatatgaaagggatgaaaccttttcataaaaatataaaaaatcaacattcattttcactggtaatttattctaagccttatttctaatgatgctgtgtgtgtgtgtgtgtgtgtgtgtgtgtgtgtttctaggattaaataaatatgtgcctttcttctgggattaaatcttttcactcattttctcgttgctgctttgattgtgtccaaacatcttatgacagagatttggcttttgctttatttctaaatgcttctcattagcacctaggttcctgctgtatcaaactttaaatgtttgaaatactatatataattttagttttcttggccttggctcatatggtttaattttcctggaatagttttaccttacttgaccatttggaaaattcctattcttttctaagattccggtcctggatctcagtatttttgaaagcttctcttgaccttcataagcaaacctgtgttgttacttcttcttgtgtcatttttttcataatatacagccttggctcttcacctttagcatttacaaaaattgccattattttttaaatggactttctagccccaatgctaaatttgctcacaataatttttagaataaattcaaaaatatactaagaagattcttatacaaaaagtttgagtatcttactctgagaacactgttccatagctattatcacttttcacattaatattttctaacagtctttgttttccttaagggaaggaaaggataacatttattttcctagcacctgttatagggatagacaagtagtattaatttaataattgataatttttgtttattatacacttatgtggaacttaatgtaggtctgtacaattgtaagctttttataagtattaaactgattaagtctcattattaacctgtgaaggtgctactcttattccttgttttcaggtgagtaaactcaacagacaagttactaacttgcctaatttcaggcagttagaaaggcagctctaattaaaatataagaaatatgatttcaaattaaaggaatttatccacttcataacactctggaatgttgatttttaaaatatgtattgtagtataacactgacatatgtaccaacatcaaatgtacaggctgaaaaattatccaaaagtcagcacagcattataaagatgactcatgtgaagtaataaaatctgagctgaatcctaggaaattccttctttcccctacacagtagtaactctccctctcaccattatcctcacatctgttcatactttacagttatttatttcactcaacatgcagtttgtgtgtaaacaacacattgtacttatttattccatatttgatatctatttttccagtttggatctaatataaattatgtttctagaaagattattatacatatctttaggaggaagtatatgtacacatttatgtatttctatatacacactatatatacacacactgtatatatgaatacatacacacaaacatgcaaacacctgtatgcatatatagtcaggatggatttgggcaatgaggtcgaaaggatacgttcattacgttcattacaagattaagtcgaatgtttttcagagtcgtagtgatttacattcccttcatcagtgcgtgcaaatttcgtttgtgcagcttctatagaaaccctaaatacactttattttttaaagtttagctttttagtaattatagagtagaatttatttttatttttaatttgtatttaataaaagtagcttgatttccttttatttttttctttctttaattttttttttaattctgtgtggtaaagtgctttgaaaaggcctttcttgatgtttcatttggttgtacttttatttcttatttattaatttttttttttttggagatggttctaactctgtcacccaggctggagtgcagtggttgattagagctcactgcatccttgacctccccgactcaaaagagcctagctactcaggagtagctgggactacaggccagagccaccatgcctggctaattttttaaattttttgtataggcagagttctctcactatgttgcccagacaggtctcagatccctgggctcaagtagtcctcccactttgccctcccaaagtgctgggattaatgttgtgagccaccgtacctgaccatgttttttttttcaaaaaattcatttgtgaagtttaaaaagtatcttttaagagttcttactgtatttatattgcaaatttcattacccattctgttgctagccttttcactctcagtgagttattttatgattacaaatccttgtttatgttattttattactattaacttatttatcttatttattagccttcagtggttagttttttagtctttttttaaatcttaaggtcatagaagtgccctctatattactttttaaaaactgtactgttttatgttacacattggcttctatatgaaataatttttgtgtatgttgtgaagttggatgttaatattcatttttctctatggatttatgaaagacagcacaatttattgaaaatacatcttttccttgctgtactgaagcactatttttttcacaaatcagctaaatatattgttgtgtggttctctttatgagttctccattctgtttcattgaaatatctatacttgcaccttttccataatgtcataattaatatacatttataaaaactttaataaagtcttcacattatattttttcttcaaagttatttatgcactgcgtttttatttgcattttacagtcagtttttcagttgccgccaaatataatgcagacaaattacactattactaatcacagtattgtgattttcagtgtattacaaatatagatttatttaaaatactgactctttcttctaatactaggaataacaaagaaacatggtacatctttatttctgttgaatgtctttaatttctcttaatctttcacaattttcagtaaagggattgaatataatatgttatattttatattaggaattcaatgtttcttcctggaaacatttcagatttttaatattttacttgatttagactcactacatttggaaagcttcaattacaattttacttttaacagatatagagctactcagatttgctattcttgtgtcactatttacgattttttagaaatgtcttctatttcatcaaattatttcacaatttttgacttaaagttacttattacattctctttttctctctcgtgactatagaatctataatgatttcctcattattcatgatatttagaatttgtggatattcttttttaatttcatgcataatcatggtatatttttatcagtcttttcatagtaactttggcttttgctgatttcatttattttatgattgtttctttttctcctgcttcttatttatattctcttttttaattctttggatttaatttgacattacatttaaaatttttgagattgacgattacattattaattttcaaactttatttttttaacatatttatgtaaccatatatttatctccaagctgaggtttgcctaagtctcccaacttttaacaagcagtatttttactttcatttttattaaattcaaaatatattttaatgttcactgtaattacttttttgatccatgaataacttagaaatgtgatgcttaatttccaaacatttgttaactttcaaagtcttgctatagatttccagcttaataacattgttgtacaaaaaacactgtcaaagatttcaaatttttggtatttattgattcttgcttggggcctaacctcagcctctatctatctatctatctatctatctatctatctatctatctatctacctatctatcatctatcatctatctacctagacagagatatctatagatatctatggtaaattttgaaacatgttccaaatacactataataaattgtatgttttgctgtttttgagtgcagtttttatgtcaaagtatttaattctactgctttaaatgtttgtattattgatattttgtatcctttttgctatcatgtatcaaaaatgtgtattaaagtctttatgattgaagatgtgcctattgctccttttagttctataaattatgcatgcgcattaactgtgtgtgcgtgaatataaatacacaagttagacaacttcctcaataattgattcttttatgtgaatgatgtatacatcttcctctcaggtaataatttctgccttaaaatctctattgtctaatattaacatagctaaacaaattttcatttggcttgtgtttatcttttatatacatatatgaaatttttaaatttagatggttccatagatagaagatagaagatatatagatagaagatagtatatgtcttctacagatacagatatgtatatgtatatatacttatagatatattaatatttatatctatgtttataaatgtatatatgtagatagctatatatgtatatctacatatatatctacataccaatatatatctctaggtgtgtatatgatatctatatacatatagatatagatatgcaggtatatacatacatagataactatgtatatatatctatgcacatgtagaaatatagatgtagatataaatatatatctgtatagagttatgtgtagacatatatagatatatagataggtctatatagagaaccatctacctatatctagatagatatctatcaattgatatctctacctatctagctctagatagattatctaatctatctataaaactatcttgaaacgatcctaatttaaaaatcaagattcgttttaattcaaaaatcttaacttaaaagttaggaaccatctttattttgtggttcatatacaccatggaatactaggtggccataaaaaagagtgagatcaagtcatttgcaggaacatggagggagctggatggaggtcttcatccttagcaaactaatgcaagaacagaaaaccaaatactgcatgttctcatttacaagtgggagctaaattatgagaacacatgaacacatagagggaagcaacaggcactggggtctctgggagtgtggagggtgggaggaagttgaagatcaggaaaaacaactaatgggtactaggcttaatagctgggtggtgaaataatgtgcacaacaaacctctgtgacactagtttgccacataacaaacctacacaggtgccattgaactgaaaataaaagttaaaaatgatgaaaatacggaaacaaaaatcttcaaccaacacaaaacggttcatcccaagaatcatcttaatttaaaaatctttacatcttaagaagctacacgggaggctgaggcaggagaatcgcttgaacctgggaggcaacggttgcagtgaggcaagatcgcgccattgcactccagtccaagtgagagtgtgagactcagtctcaaaaaaataaaatgaaataaagagcaactttgatcttaaatagagtatatatccgtttacatttaatgtggtgaatgaaaaatttggttttcatttaccaccctacaatttgcctttctcaactaatactttatagataaaaggacttacggaaagcaaatatatgactcaatattccaataaaagtgcttgaaataatttatattgagcacgttatccttctttcttaaaaaccttaagctatacacattacatagataagcactgatgagaatctagtactaaataaccattatttcaaaggcatagatagaatgctttccaggtatggagtgtttccatacttcccttccatacattttcaagccattgcataacaaatacggaattttgtggagaggagtgaatttatatcctttaatattttctcactttagaaatgcagtcttggaatgatataaactctgtaaacagactatcatgttgtatttacgaagaattatattaaggtgtctatttttaagacaagaataaatatgtttttgttctaataatagaaatggataagcagaattctggcttataataatgagaacatactatcccctagtttgaaataagttaaataatttaactttctcatgttatcttgaagtttgtattgaatgtatcagtgcactacatgaaatgggacatttggtgctgtcaggcctctgagcccaagctaagccatcatatcccctgtgacctgtaggtacacatccaaatggcctgttcctgccttaactgatgacattccaccacaaaaggagtgaaaatggctggcccttgccttaagtgatgacattccaccacaaaataagtgaaaatggctggtccttgccttaactgatgacattaccttgtgaaatcccttttccgggctcatcctgactcaaaaagctcccccactgagcaccttgtgaccccccatgcctgcctgccagagaacaagccgcctttgactgtaattttcctttacctacccaaatcttataaaacagccccacccctatctcccttcgctgattctctttttggactcatcccgcctgcacccaggtgattaaaaagctttattgctcacacagagcctgttttgtggtctcttcacatggacgcgcgtgaaagttaccatcccttttatcctacacataaaatgattcagtggtttaaaacacttctttccatatcctgcagttttgcatagcaaaagaaacatgcactttgaggaaaatgtaccttttaattttttgtattttaaatattatgggtacaaaatatttgtatgtaattatggagtacatgtgatgtttcaatacctcctttttgatcccagatcttccctgaaatttttgtccaatttgtattgcattatttaagtttgagaaggagtaatgatgtttagtatatactgttataaaataactgattccaaagatgtaaagtatctgatacttactatgtccaaatataatttttaaggaaatgttcctaacgatgtgtaaataataacatggaataaaataaattcatataactttatgataataattttacttaaattaaaaagtgttatgtgcaaacagatggtatacgacgcgtggcatgcaataatgcaattgagtccaattaaatatattgtttgatttatttccacaatctgataaatgtattgtagaccaaaacatcaaaaaccataagtagggctgggcgcggtggctcaagcctgtaatcccaacactttggccaaggcaggcagatcatgaggtcaggagattgagaccatcgtggctaagatggtgaaaccccgtcgatacgaaaaatacaaaaaaattagccggacgtcgtggtgggcgcctgtagtcccagctaatcaagaggctgaggcagaagaatggcgtgaaccccggaggcggagcttgcagtgagcggagatggcgccactgcactccagcctgggcgacacagcgagactccgtctcaaaacaaacaaacaaacaaacaaacaaaccataagtagcctgtataatgtctttttattcgctgccatgtttttaatataaatatataagagcatcttaaattatttaaataagtcaattattttataagtgaatttagtattagaacatatatattcttttgcacaggaagcttttttaagtgtcagaaattatatacttatatagagacttttgttcacaaagtagttagttgtaggtacatacaacatacttgaaaaatatttttgtcgacattggatgcatttttctcttatagactcttaaaaatgttaacaagccaacatgtgaatatactgaagtattttttaatcttttctagtgtcgataacgagttggttgatataaagtcattagagtggcaattcaacaaatattttctatcgcataacaaatgtcattaacttgctagtctgtcatgctgttgcaaagataaagccacattcattagtgttttttgttgttgtttcttattggtgctttgtttgttttgtaacatgaagtggcccacttcttgtattaaattatttattctttctgaaaatgttcaatcagaatgtaataaaacctttgaaaaatgatttaaaaatttattcctgtaggtgggaaattgaacaggtgagaacacttagacacagggcagggaacatcacacccctgggcctgtcgtggggtgggggcagagaggcagggatagcattaggagaaatacctaatgtaaatgaggagttagcgggtgcagcaaaccaacatggcacatttatacctatgtaacaaacctgcacgttgtgcacgtgtgccctagaacttaaagtacaataaaaaatatatatttatttctactgaacaaaatgtccatatattagatggcctaggactggtaggggtctctaatccaggggattgttgataaactgagacaacttctataatttttacattgttactcttaaagtcttgtcattgtctgactgtctcaatattggaaaataacgtcaatattcagtgtaataaaccagaagaaaaatgggccgatatcccattcaattaaagacattgaaaagaatgtgtatgtattacttttactcacatcttaatgctcatcgtgttgtcaccaagccagatagaaccatatactggggaatgtaatgtttatctgagaaaccaaatgcctaaatacaaattttaatagtatgaagtaagaggaaataaatatgggggattttctagtcttctccattagatataaattgcaagatttggccactttaaaaaatattaatatttactaatttttcatcaattcaaatatcatatcatagagagcaatttaatcaaattagataacagttctaaatataaaatttaactgtatatctcccagaaaccaaaaaatgagaaattatctgtggcttttggctagacaaaggtttcttagatgtggcccaaagaacaacctagagaacaagcaaaaaaaccaattacaacaacagtaaatatgacttcataaaaacaaaaaattctatatttctagcctaaatgactcaaacttgtaatagacatttccaaattatgtctgataaaggatgtgtatccaaaatatgtaaactcaattttaaggcaaattacagtccaataataaacaataaggaaaagaatatatttgaacacatactttgccagaggaaattcagagacagcaaataatcacatcgaaagatgttcaatatctttagccattggagaaatacaaattaaatgagatgccattccacacctactagaataaatataattaaaaatactcatcatcttgtgtgttggtgatgatttaaaaaatctgtagctctcaaatactgatggtaggaaagtaaatgatacagccactctggagaaaaaaatggattgtttcttacaaagttaaatagacacccactattttacctacttactctactgttgttctttaagcagaaaacagtagagcatattatacatataagaatgtgtttacaagtgtccatggcaaacttatttataataagactaaactgtcaacaacccaaagtttatcaatgggtgaataaataaatccaacacggtatactcataacatgagatataacttcacacacacataaaaccatattttcagcaaatggtgctggaacaattggacatccacatccaaaaaaagaatctagacactgtgtttacacaatatacaagaatggataatagatttaaatataaaaatgcgagactatagaagaatattataaattgaattttatataagttagtacttctgctctaggaaagacatagtttatatttaaaaaacaagccaagactgggagacaatatttacaaaacatgtatccaatgaagaactggtatgagcaccccacagaactcttaaaactcaaaaagaaaaaaagttaaataatccagttaaaaagtgggcaggagatctgaacagacatttcaccaagggaaacatattaatggcaaataagtaaatgaaatatgctcaacatcatatattgttagagaactgctcattagaacaagataccaccacatgcctactaaaatggctaaaatccaaatcactgacaacactaaattgtgttgaggataaagagcaagggaaacttattgattgcttgtgggaatgcaaaatggcacaaccacgttagaagatagttttgcatttcttacaaagttaaatgtagtcttaccacatggaccagtaacttcacccctatccaaatgagtcaaaaatctttctacacaaaaatgtcacatgactccttaaaacagcttttctcgtaacaaaacttggtagctactaagatgcccccaacaggtgagtgatggctcaataaactggcatatctataaaatgggatattcagtgttaaaagaataagctatcaagccatacaaaatatgcaagaacctagagtacatataactaagtgaaagaagctaatctgaagaggctgtacactgtatcattccaatgatgtaacattcttaaaaaggggaaaatctataaaaagatcagaatttccagtagtctccaagggaaaggatgaataaatcaagcacagaaatttttaagaaagtaaaactattcttataataccatagtagtgggtacatgacatatgcacttgtcccagcccatgaaatgtataatgccaagagtgaaccctaatataaaactaatatatggactttcatttataataatatgtcaatacggatgcatcagttataacaaaggcaccacactaatgcaagatactaatcataaagaatatggagggtagaagaaagtgtttggaaattctctgtgctttgttagttttttctataaacctaaaattgttctcaaaataaaatctattaatttaaaaaagaatgaactattgttaccagtatcaacataggtgaaagtcagagtagttatgttgagtgcaaaagacagacaaaaaagaatagattttgtgtgattacatttacataaaattctaccaagtgtaaaccattctgtagtatcagaaatagattagtagttgcatggagattaagtagggaagaggggaagaagccattactaaagacacaaagcaactttggggaaatgaatatgttcattatcttgatcgccatggtgttttcttatgtaccaatatgccaaaactttaaaaataatatacactggattatgttcagtttatgtcaattacacttcaatgaaaaacatttaaaaatattatgtatcttgattttatatttattcagagatattattattctctacctgccatatatgccttttggcagtgtaaagatatataaacatagtatgtaaatatggtatttgtaatattcttattcatatgcaaagatagtttacatttaatttttttaacttttcttctatttttattctgtatcctccagacattaacattgagaacttcatatactattacatatttaaaaatgagtcatgtccagtataatacaaaatttcagcaatgtgacatgacaggaacaaaatataaatgaagttgctttatatagattcattttgctcattaaaacatttcatagaataaatcacttattcaaaagtattaacatatatatttaagagtgcactatgaaaaaacagaatcaagaaatggataccagattgatactcactaaatcgtatgttaaagcattttgaataattttgtagtttttcaaaagtaactcacacatgtcacatattaataatgtatatatttatttttaggaactccttttagataactattaggtatatagttttatgctgagttttatgagaactagaaaaagcatatcattttatgtcagaaatagtatattggttcctaggtcattttctatagctgtcaaaatgtttcaatgtcttttaaaactcaagaaaatgaggaagaaatacagaaatattcctaggttaattgtttttatatccttatctagttctttctattcttaattatattaattcttcccaatggcttatttaaaaatgggtcttcaattgtctttcattaaaattctatggggtctcattacctgtaaaaaggttttatttcacacgaagtattttttggttatgtaaaaggaaactaaagctctgggctaaataaataacttttttaaattttccctattgggaagtagttgaatatatacattgctgtattcagctaaaacatattagaatgtgcttttatttacaataaaaatgaaataaggctgcgttacattggcaagctgtaatgggaaatgtatttgtcaccctaggcaaactgaaaaggcaggtatattgaattcagtaatgctgagtaattaagccttcacttacaacccttatattagataattcaacttaataagttaagtcattttccaagtgtttgttaatgtatcaaaaggatttatacatttcacaaacggggactcaagctaaggtaaagatttataaacacaaccaattcactagagaaagaattttaagcttgtttttcttgtttttccaaacctaactctttcatggaaaaaaataaaggcaatattataaaacagatgaaagtgcaggtaattaccttaagtgacattgagaagcctagagctcacctggtccacactatttgataagccatgtcacccctcatttacttccacggttcccttcaagattgaagagctgtctgaataccacagtcttagtatattatatttttgtaaggaaacctgctcactcaagaacatcttctgtgagagccaatccattcagcatgttaggaagtttccttccatgtatgattcaggcccacctgatccagtggattggacaatgaatgaacacttgatttaggtggaagttatccatttattgattagaaatcagtaagcctctttcacttgagaattccaattgagatgaagaatataataggtatgcatactggatgagcaaagccaaatagcctccgtaatgttataaagaataatattgagccacaggcaagcagtggagatacaaagagtacaagagtaagggaacaaatgttgccctggagtgagagaaattgataaaaagccactgccttgatgttggacaggttcttagttctatgttcagcctttattttctgctcttggattctacactgtacatttcaagtttatttacaaatggttttgactacagaaaaagcaagtgtgccattatgtaatttttgacgtattttgggagaaataaagtaaaaagtattttttccttttcttttatttatttttatatttatttatttatttattttttgagattgagtttctctcttgctgcccaggctggagtgcagtggcgtgatcttggctcactgcaacctccgtcccccaggttcaggtgattctcctgcctcagcctcctgagtagctgggaatacaggcgtgtgccaccatgcccagctagtttttgtatttttaatagagttggggtttcaccttgttggccaggctggtctcgaactccagatctcaggtgatccacccaccttggtctcccaaagtgtttggattacaggcgtgagttactgcacccagccacaaaaagtattgagagtttttcaaagtagtttctgagttacatgtaaaaacaagataaaaaaatttactaacagctctgcagctttcaaaattaagcagtcagatttctatgtggctgagaatttctagcagtctcctccattagaatttgccatgcccaaaatgtcctatgctgtacagttaaatgattgatgtttaagtaatattcagtttgaaagctgactttaaatgtttccttgaggggaaaacatgcttagcatttcattataaaattatccaagctttgctctcatttctatgttcaaattcaatgcatgagttaaagcatcttaagacttccttttaagcaatttatatatttgccctaagatttcaactagtcctaatatcagaggatcacttcattggaaaagttgtgcaaaagtaaaatgaaatggagattaactactaaattgtcatgttgagattcgtgataaatttagttacaatgatattattcaaattggaattaactgcaactttcctaggtatgtaaatgaaagtggagtgaaattgctatataaacctagggttatgaccatcaaaatacatgatatagcaatacaataatttaatgttgactcagggagtaataaatcagatatttcattcaacaagctgtgattttttaattataacttaagaattataagttaacatttataagtattgtttcttaataatgagttgacaaaaataatagttgaaaaatacaattatatagcatgattatattgtgaaaatttacattaaaaattaaaataatgaataaatcacctttggaaactactgttatttaaaatatcaggagtccagaaaattgcaacttattttgatctacataatcatttttacatgaaaatttaattccaaaaccattgcaaagattattttcttaataaccatagtattaagaatcagtttctgtgaaagtacaatagaatacaaacatatcctagatgtattgttttctgcatttatgcaagaacaataagattttttaaatgtttgacttatctgtggaaatatgatagagacaattgtatgatttggtttaaggattactcatttctgtacttagatgaggtaattttttcttttctagataaactctaattccacttttttcatacagtacacacctatacatgcatatataagtttccgttaaacaacagtagtaagatttgaacagattatttacctacctttctgaaaagtgtctgttaacattgttataagcctataagggaagaaagggactatattacaaaagaacagaaatgatccaggagagtatgaacacaactggattctaagaatactgggctattgggtatcgggatgtagattgggataaaagattatacccctatcagaacactgtcagtttcactattgatgtggtacaaacacatgataggatggtttgcagcatcaaggaaaaagtgatggcctcaggtgaggttgcaatgtcaaatttcccatggaagctgacagaagatgcacacgtcacaaagaaaataacatgtagaatacttaaaatctactctcaataatttttaagttattttaaattatatactattgttattaactatagtcactattgccatagtcgctataactacagtcactatagatctattacataatgtacaatagatctctgaaatttacttctcctgtcaatttaaattttgtttcctttgactaacattgagatagcaatttttatcacaatttaaaaattataataacataaaacaatataattttacagcaaggaaaaggcatttcttgaaagttaattcacaacattgaatgaattgctaaacaaaacattgtcaagaaccaaaacaactctagatatctcaggcagaatgaattcaaagaaaatgactgtgcatattatttctcaacattagattcacaatggaatcacctggggcaattttttaaagaaacaaatgcctaaatatcatatccagattctaatttatttgttattagatatggtctggaatcactctactcctgacgtccctgctcaagaatcaacttccaggaagagagactgggactcactgattttggtgctattcagttgaactatgcccctactgattttccacctgctggttctattcattatagatagggagatgttaacatctccaattataatagtagatttatctgtctgttcttgcagttctatctgttttcacctcatgtgttattgacagcccgttacatgcaaacacattaaggattgttatgttttcttggaaaattaaaccctttgtgactatgtaatatcgcttttgtatccccctataattattcttgctctgaagtctttttgttggaaattaatatattaatccagctttcttttaattagtattatcatgttatatatttttcaaagttaactctcaagcttgtccacaatgcgcttccagaaattaatcaactacatgttaaagttttctgctccattactaacatctatgggggctcctgggcttttgctccactatgctacaattctttgcatttccccatctctctaattaagtggagatttagggtgggggcagcagtttgttctgtggcctcagtcccctaacggatttaaaatgagttgttgatactctgtttatacagcatttttcttgtaaggatgggagtgatgacttccaagtttcttacatgcttgaataactgacattttttactatattctcacccctatggtggtagaaaaatgctataatttttggatccacagaactaaagtactaggagaggggttttttcacaggaaagatggttgctactgaaaaaaaaaagaaaaaaaaaagataaagtcttctctgctatctctgctagattctctaaactctcttcctgtctctggagtccagacacacaagcctccttttagttttgagctttcactatgcttttatcttaaaaactttgcctactatgtcctttctgctgagaaagcaccttatcccctcaattacctagttaacatcaaatatcaaatcatacttcttactgaaggccaagtaccacctctagaagttttccctaagaacagcctacatacacttaattctgtgagcccttttcttatatcctttgaatgctcttccttcacattactcttccttcacagcctttagccaggcaatatattacaggaaaacagggagaacataatttttgccatttactcttacctttgcctagcccagtgcctggcaaacaatagattctcattatgtattttttttgaatgaattaataaatccaagtaaaataattgatgttttggaattatctaagactgttaaaatcagttaaatatagttaatgtgaagcaaaaaacagtaaacaaaattaatgtaatatacatgctgatgttattttagaaaaaacacaataatttacaaattcctttcaataattcaattaacttttatgagatttgattgaagacaaatctatgaatgctttgttgtaaataaaaggtaatccttgtaataagcaaaaataaattaacataacaaatatcaatttacagatagatgaaaagtgattgttttctagatgaaaggaagattattaatagttggcataagaaatcaaaaattagttcaacaattagtcatacggaaatgttgaatattgacattaatgtgataaagaaaacgagagtttctgcaaataacctcccatatctgatgtgaatctttcacgtcattctatagttcaactagttcttaataactcaaaaacaagaaggataaaatccatcattttgtttggctacccagatccctcctgtagctgtcatacagagtgtgatttatgagttgtaagttgtgctgtggagcttgacaagtaagtttgatttcatttagtatcttctttaaaccatcttagatcttctctttgacaagaatttatgttagtgttctcaaaatgtaaaatgggtaacttaatgagaacaaaagttgtaccctaagatatatttgcattatctacatactcacaattaaatcttaacagttcaaatatacccatttgtaatagaatctaacagttttcctcttgaattttttgacaccagaaatttttggtcccaataatgtttagcttcctagtcacaaaccaaacagaaagcaaatttcatcagcttagaatggttaaaaccaacacagctgcaatatttttatttttgttttaaaattttgtttagtcaaatatagttttaagatgagtagaaattctcctgaagataataaagaaaaagtatgtcatataatatcttaaataaaaataataatagttattaattttttctgctcattatgttccagaatctgtactaagcattttagaggattattttatttaattcacacaataatcccttgagaaatatataattattatctttaattcacagttattgaaaatgagacacaaagaggttaagaattttgtccaaggtcaggcagctaatgtgacttagcaagggtgtaattaagaaaaaataagtctttcttatcttatgggaaatttggaaaagcaaatatctaggttctctttttaattaaaaaatataaaatgtaaaatgtgagtctctcttaaagcagggaatcaactttaattaaattgaaacaatacagaatcttttgttattcaggctctatattattattatctctgctgatagcaaaagctaagaatagaaaatatttctgacccaagttggtaaattatgaatcaacctgctagataatcagaataggctaacaagtggaattaaatgtaattattctatattaaatataatataaacaatttcttattataattttactaagattctaccagttgcaactgaaatataacattttaaatccaagcttaataaaagaacttggcatgagatgttttcataggaaatagtgacaattcatattatttttaagtgtaaatgagatgtattatttctgtatttcattttccttctaaaagttatttttaaagttttagtttttctgaagttgatagctattactaactcttttgggcaaagttttttgagatagattaatttatataattaggaagaaactaaagtagttgtgaaagtttctaaaaagataataaagtagttgtctttatgttataatagaaaatgagaatgtgaacgcagatcattttgactctcagagtttgtgttttcagcaaatattacctgaatattgatatataaattagaattccccaaaggaaaacatttaaaaatgttaaaattaataaaatcattagcttatatacttgtccttagtatcaggacattctccagtggattcaatagagcatctgcagttttattttttgaacaaaggtttctgcaatatagactcatggtgtgagcttactgggtcatgttctttgttccttcttggagctttgggaggcatttataaaagagctgctgtagtagaaggactgagttgtatcaccctgaggatttaagtttctgcgggagaatcaaattcactttagtatagggatttagtaggtttccctagccttattaacaaaatatcatggactggattattaacaaaatactaatacgacatgaaaagtgcatactttgtcttacaataatccagttaagacactatttttgtatagcaaaattctttactacacactagttacaaatcaagtgagcaagaggtggtcatactgctctgcttcctattcctgccctttcctcctaccccagctgaaaatacttgctgcaaatgtccttttataggagactttgaccccagggtgtagaaagggaaaggaaaaggtcagaaatatatgtcttgtctataacttaaatctaataccagcacaaaagcctgaaaggactgatttttagagagcgttggcaggaaactgctctgctatcatctgttttaagctacttttatacattatttttttcggcttctactctgctactattcaactgcaatttgttttattgtacacttcaacaccatgaacagtatcttagttattattgaaatgtattacaagttcataaagaaaacagcattttgtttcttcagtcatctactttggatgaaagtgttatttagaaaagactaaatgggaaaaataatacattaaaaataaaaattgcatattaattttttagatcaaataaaccaattttcagcattttcatggacctttataaccaaaataaataaacatttaaagacagatgatttaattcagtattttgtttcttgaaaatactggaatatgtgttttagataatgtatatatttctgttattgaaaagttttcaatagtcagctgacttcatatgcaactttttgcaaataataataccattttaaacttattcaaggattttaggtgttcttaaatattattttataacttattttactcccctaaagtaaatatttatggcatctgtaagccattgtacaattggtatagcatagtattaggattgtcctttgtaatattttatagtattcacatttgtatttaatcgcaaatttgatataatttagccaagccttcaatacatttataaagagagcactactgagactttatacaatggaataaaataacaaaatgtgatggcagcattcttccactcaaagagatatatatattttttattctatccaatttttaactaattttattttttgcacccaatggaggggaaaattactaaaagtgtgattaaggctattataagatacataaactgtatgacacaagcattctcaactcaactttacacttcacattgtttatgaacttagtatgccagctttttaagtgtggtggggtctggtattccacacttatatgtctctgaatcccacccttgtgctgatgctaagatgaactgaagcagggatgaatttttctcttacatggaaacatgaatatattccaaactggagggagctctcacaagcagttcgcctacggtaattactttgtgccttgtaatgggtcacacagtatcctcaaaaaggtgtgtctgagtcctagaccctctcccctcccagtacctgtaaatgtcaccttattttgaaataggagctttacagataaaataaagttaaagatctcagggtgagatcatccggaatttagagtgagtcatggatatttgggacacagaaacacaagcaaggtcatgtgaagatagagacaaaggttacagttatgctgtcacaagccaaggagtaccaggaaccacccggaactagaagaggcagggaaggattcttccctagagccatcagaagaagtacggtcctgagtacgcctggattttggtctttttgcctctataagtgagagatattattattattactattattattattattgtaacaattttaagccacaagttttgtagcaatttcttttggcagcactaggaaactagttaatgcctctattatttggttaaacaaagaacactattaagtatttttaaaacaatgtatatgaatgttgattatggtaagcaaacagtttataatcagatcagtttctatgtaaaatttcatgttattatattgattttgttttgttttaaccatacaagacttgcttggatgtggtaccattgaataccatccccattccctcctgtcccacaactttttgaaatttatggggctttgttctagactgaatatttcttttccctcaaatttcatatgttaaagccctaccccacaatgtgacagtattgggaagtgaggtctttgagaattaattaggtttagacaaagtcatgagcttaggaccctcatcaatggaattagtgtccttataagaacaggaagtctatagagtgctctctctctctctctctctctctctgtgtctctctctctctctgtccatctgctacgtgaggaaaaagcaagctgggaagaagacctcacgaggaaacaaatttgccagcaccttaatcttgcactttccagcttctaaaattctgagaaataaatgtctgttgtgtaagccatccagtccatgacattctgttatagaatcctggactgactgatatgggctggaacatgctggagagatggtacaaaatctaattttagaaaaatattttaagttgtaagatctgaggcaaaaatcagttaaatattaccatttacattaaccaaattactccatttgcagtatcaaattaaggaaatttatgttttattcaagcttttaaaatcagcacacccactttgcagaagtaattaataacccatgattattaattatgtttgccaatttaattttcatccagtattacttgcagggaaagtttgaaatagataaatcatcttccttttgagatgtcacttgtatcactaaaggctacctataatttctgtaattgttactctttaatgcaactttaaacttcgaagaaagatgtttcaatatttttttttggtttttgttttttcttttcttttttgttcattttgtttgataatgtatctttttatattattattatactttaagttttagggtacatgtgcacaatgtgaaggttagttacatatgtatacatgtgccatgctggtgtgctgcacccattaactcgtcatttagcattaggtgtatctcctaatgctatccctctcccctccccccaccccacaacagtccccagagtgtgatgttctccttcctgtgtccatgtgttctcattgttcaattcccacctatgagtgagaacatgcggtgtttggttttttgtccttgcgatagtttactggcaatgatgatttccaatttcatccatgtccctacaaaggacatgaactcatcattttttatggctgcatagtattccatggtgtatatgtgacacattttcttaatccagtctatcattgttggacatttgggttggttccaagtatttgctattgtgaatagtgccacaataaacatacgtgtgcatgtgtctttatagcagcatgatttatagtcctttgggtatatacccagtaatgggatggctgggtcaaatggtatttctagttctatatccctgaggaatcgccacactgacttccacaatggtcgaactagtttacagtcccactaatagtgtaaaagtgttcctatttctccacatcctctccagcacctgttgtttcctgactttttaatgatcgccattgtaactggtgtgagatggtatctcattgtggttttgatttgcatttctctgatgcccagtgatggtgagcattttttcatgtgttttttggctgcataaatatcttcctttgagaagtgtctgttcatgtcctttgcccactttttgatggggttgtttgtttttttcttgtaaatttgtttgagttaattgtagattctggatattagccctttgtcagatgagtaggttgggaaatttttctcccattttgtaggttgcctgttcactctgatgggttgctgtgcagaagctctttagtttaattagatcccatttgtcaattttggcttattgttaaattgacttaaatgactaagactgtagcttaaatgaatgagattgtggtggagaggatattccccaaactaactctgtctctgacatttaggggtttgttgtaatagtaacaccttgctagcaatcatctactagtgatttgctcatggaacatgctggagagaaggagtgtctgagtcctagaccctctcccatcccagtacttgtaaatgtcaccttattttgaaataggagctttacagatataataaagttaaagatctcagggtgagatcatcctgaattaagattgagtcatggatatgaatatatgcatatatatatatatattgcatgcatgtggaggcaggttgtatataatataatatgtatatatattacatatgtatagtgtgtgtgtgtgtatatatatatatatgtgtgtgtgtgtgtgtgtgtgtgtgtgtattatatacaccctgcctccacatgcatggcctccctcattatcagtatcctcccctagagtggtacaactgtcaaaattgacttgcctacattaacacaatgttgtcacccagtggtaaatatacataacataaaagatataatttaatcattttaaattctaaaactcagtgatattgaatacattcacaatgttgtgtaattaacactgttttcataacttttatatcacatcaaacagaaattctgtaccattaagcaataattctccattccccttgccccagcctccatgccctagaaacaagcaatctgcattccccctgcatgaatttgactattcgtgatctttcatataagtagaatcatgtactatttgtccttttgtatctggcttattttatttagcataatgttttcaagatttatccatgttgtaaacatgtatcagaacgtcattccctttttatggctaaataatattcccttgtgtgtacatgccacattttgtttatccacacatacaggtttgttttcactttttgactcttgtgaataagaatgagtgatggtatctggcatgtgcaggcagccactttcttgctaaagaccaatagcatcaagcactctactaatggttgtaatttatctgattaggatccagatttccaaaaatgttaattcttattttttccagttcaatggcagttttcatggaggtattgacttctaaaacttcctattccaatcttctgaaatccactttaaaagagtggtttaaattctgtgtttgtaggatgaaattgataaaaaaatattttaacaactttcaaaattgcattacagagataatgtctttggctattgggtgttcacatatttggtatgttataaacaactttctggaaggtaaaggccttttatctcacacttaatattaagacaggaaccattgtcctagcaatagcttttggatttgatgtgatatatttgtatgtaatgagtttttaaaagttagagtgaaaagtcacctcatacaaaacaaaataatttttactgttataagaaagtagttattaattacttataaaacatgcaagtatctttgtgatatttggtgatttatttttctccagtcatcttgtgttgttcttagtggagaaaaaaatatgggtgctctttgtctatgacaatgtgaaaagtaagtatatggtttccctaaaaattcttctaagtttttaatcctctaaaatgatcattgatatgtaaaaataaatattaataatagcaacttaaggatcatttttgctgttatcagaaattgaaaatactgtaacagtccatcaataaatggttatgtatattatgatatatagcatacatagcgtatgtccatatatagaatatgtaagaaatgtatacaacaaagcacaatgaatacacgattatactaagatggatgggcatggatccacgtattattctgtttgtacatggtcttttccaaaaagaaataaaatgtaagaaagaagaaaaaaataaagagaaagagaataaaggcaactaaataaaatataaaccaggatgtgtaagtggtctcatcttaggactggaacaccagtaaagcctctcttctctggaaaaagtttatgtctctgaagttttctcagtgcatcacaactgacagcagcaggaatgtgtttttgctaacagcaatagaaaagcaaaactgtctcaagattgtaatattaatccaaaggttaaaacttcttaccttagtgttgctgctttctctatgcacatcccaaaggacctaggaaggtggaaaggacataggagatggaaaatgtagaaaataaaaaaataaggtaaatttaaaaggtaataagactaacatccattcattcacattaagctcctaattgtaacacattctctggtagacactgcggatatagcagtgaaaaaaaaaagaaaaaaaaatatgcctttttggagcttatattctcttggaaggagatattatatagcttaattacttttgttattatatatgttaagtgttgataagtgctatggaggaaagcaaggcagacaaagcaatcaggcaggagaaagaaagaaagggtattcaattaggaaaagaggaagtcaaattggccctgtttgcagatgacatgattgtatatctagaaaaccccattgtctcagcccaaaatctccttaagctgataagcaacttcagcaaagtctcaggataaaaaatcaatgtgcaaaaatcacaaacattcttatacaccaacaacagacaaacagagagccaaatcatgagtgaactcccattcacaattgcctcaaagagaataaaatacctaggaatccaacttacaagggatgtgaaggacctcttcaaggagaactacaaaccactgctcaacaaaataaaagaggacacaaacaaatggaagaacattccatgttcatggataggaagaatcaatatcgtgaaaatggctatactgtccaaggtaatttatagatttaatgctatccccatcaagctaccaatgcctttcttcacagaattggaaaaaactactttaaagttcatatggaaccaaaaaagagcccgcattgcctagtcaatcctaagccagaagaacaaaactggaggcatcatgctacctgacttcaaactatactacaaggctacagtaaccaaaacagcatggtactggtaccaaaacagagatatagaatactggaacagaacagagccctcagaagtaataccacacatctacaaccatctgatctttgacatacctgacaaaaacaggaaatggggaaaggagtccctatttaataaatggtgctgggaaaactggctagccttatgtagaaagctgaaactggatcccttccttacactttatacaaaaattaattcaagatggattaaaggcttaaatgttagacctaaaactataaaaaccctagaagaaaacctaggcaataccattcaggacataggcatgggcaaagacttcacatctaaaacaccaaaagcaatggcaacaaaagccaaaattgacaaatgggatctaattaaactgaagaacttctgcacagcaaaagaaactaccatcagagtgaacgggcaacctacagaatgctagcaaatttttgcaatctactcatctgacaaagggctaatatccagaatctacaaagaactcaaacaaatttacaagaaaaaaacaaccccataaaaaagtgggcaaaagttatgaacagatgcttcacaaaagaagacatttatacagccaacagacacttgaaaaaatgctcatcatcactggccatcagagaaatgcaaatcaaaaccacagttagataccatctcacaccagttagaatggcgatcattaaaaagtcaggaaacaacatgtgctggggaggatgtggagaaataggaacacttttacactgttggtgggactggaaactagttcaaccattgtggaagacagtgtgatgattcttcaaggatatagaactagaaatatcatttgacccagccatcccattactgggcatatacccaaaggattataaatcatgctgccataaagacacatgcacacgtatgtttattgcagcactattcacaatagcaaagacttggaaccaagccaaatgtccaacaatgatagactggattaagaaaatgtgtcacatatacaccatggaatactatgcagccataaaaaaggatgagttcatgtcctttgtagggacatggatgaagctggaaaccatcattctcagcaaactatcgcaaggacaagaaaaccaaacactgcatgttctcactcataggtgagaattgaacaatgagaacacttggacacaggaaggggaacatcacacctggggcatgttgtagggtgaagggagaggggagggatagcattacgagatacacctaatgtaaatgacgagttaatgggtgcagcacaccaacatgacacatgtatacataggtacgaaacctgcacattgtgcacatgtaccctagaacttaaagtataattaaaaaataaataaataataaataatttaaaaaaattaaaagaaacaaaacaacaacaaaaaacaaagcaaataacatgaggaggagatacaattttaagtagggaataaaggatggcatgacagagacagtagcatatgagtgaaaagcttgaaagaggtgatatggtttgactgggtcccccactaaatctaaagcttgaattgtagttcctgtaatccccatgtgtcatgggagggacctggtgggggttaatttaatcacggggtcagttacccccatgctgctgttcttgtggtatgagtgagttcttatgctctctggtggttttatcagggtctttttccccattttgcttggcacttctccttgctgccaccacgtgaagaaggatgtgttgcttccccttatcatggttataactttcctgaggtctcaccagctgtgcagaactgtgactcaattaaacctctttcctttataaattacccagtctaggatatgtttttattaacagcatgagaaggaactaatacagaaggtaagaaagcaatccaggggggatttgaagacaggtgttttcagtcacagaaaccatgtaaaaagcatctaatgtgagagtgctataatctgaatgttgacagccccccaaattcatacattgaaatctaattcacagtatgatactattaaaagctaaggtctttggaaggtgattatgtcatgaatacagagccttcatgaaggagattggtgcctttataaaagatgcctgaggggttggtttgtcccttccaccatatgatgactccaccatatgaagaagatgggtctatgaactaggaaatagggcctcatcatatatggaatatgtgagcacattgatctgggacttagcttccagaactgtgaagaataaatttatgtcctttataagctacttactatatgatattttgttatagctgctcaaatggactaacacagagacaattcccagcctgcccaaagagcatcaggaagtgttgggtacagtaaagctggaacagagccacgaggggaagagcaacagggctgtgatcaaagaggtgtgcctggtggggagcatgagtagagctgtataatctgtacaataatgacccagagtggaattagaagtccttaaaagtgggtgagcagagtggcatgatctctattatattatgttatattcttgcttggatattgagaatagactgaaggtgagggctaatgcagaagcaggaagggagataaaaattcagaggagacatgatgttggcttagcctgggtggataacagcagtagtaaaaattatttaaatgttttgaaggtaggtttgctgagaagtaattttggaggtacattaccaagactaaatttatattttataaaatgaacaaatttaaggtgtataccttaactttatatatttatgcactcatattcacaccacccatattaagataaagaacagaaactcttctggtgctttattccgcagaaaaccttctggtgctttattccagtcaataacaaacactggtcaaaggatattctactatgaccatagttttcttttgcctctcgctaaacttagtttgtctggagtcatacagattttaagcttttgtgtctgacctattttactcaacatgatgttttggagatacatccatgctgatttatgtgtctattttattttttattgctatgtattattactctgtaagtcaatatcataatttgtttatctcttctcctctttatagatgttacatccagtttttgcctacaaagaaaaacaaactgctatgaataaatttatatctgtctctatcgtgtgaatacacaccctcatttatttttggaatatacctattaattgaattatgatgtcattgggtatgtgcgcagtttaactttataagaaatagccaaacttatttaaaatgtagctatacaatttactttcccaccacaaatgtatgagattttctttgtttcataacctcttcagaattgctatattcagttcccaattttttttcttaagagatggggtctcgctctgtcacacaggctggagtggagtggcataatcatagctcactgcagccttgaactcctgggctcaagctatcctcccatattggtctccaggtatttagccattttaattttaccagttctcttggacatgtaatcacatctcattcaggcttttattttaatttttctgatgaccaactgtgttcaacacatttttttatcctgatcacccacttggctgtcttcttttataaactgactgttcaagtcttttgcccacttttaattgagtgatttatcttttgcataacaatttataggatttgtttactctccaaagaaatcttttgtcaggtctatgtatttcaaatatgttatctcactgtgacatttctattcatttttaattgggataaaaacataacttgtgatctatccttttaataaggttttaaatgtaaaatatagtactgttaagtataggcatgatgttgtacagaaaatctctggaacttatgcaacttacacaactgaaattttatacccattgaacagcaacccttcttcctccttcccctaaccattctactctctatttctatgagtttgacttttttatttttattttttttgagacggagtctcgctttgttgcccaggctggagtgcaatggcgcaatttcggctcactccaagttccacctcccaggttcacgccattctcccctcagcctcccgagtagctgggactacaggcacccgccaccacgcctggctaattttgtgtatttttagtagagacgggggtttcaccatgtttgccaggatggtctcgatctcctgaccttgtgatccgcccgcctcggcctcccaaagtgctgggattacaggcttgagccaccgctcccggctgagtttgactattttagaaagctcatagaagtgaaatcatgcagaatttgtccttctgtgactgacttaccatgctgacatgatatcctccaggtttatccatgttgttgcaaatggcaaaatgtacttcttaaaattgaaaatattccattgtatttatacaccacattgtctttatccattcatgcagtaatggacatttaagtttttaaattttgttttttgtgagtaatgctgcaaagaacaggggtatgcaggtacctgtaccacatcctgatttccattcttttggacatatgcccaagagtaagatggggggtcatatagtagttttaattttagtgtttttgaggaacctccatactgttattcacagtgactgaaccaatttacatcccaatttacagagagtgtacaaggattccagtttctccccatcactgctaacacttgttatgtcttgttttgttttataacggctctcctaatgggtgtgaagtgatatcatattgtggctttcattcgtatttctctgatcattagggatgttgaacatattttcatataccttttggctatttgtatgtctttgaagaaaatttattcaatcattttgcccccctttttattttttctgttgttgaaggagttccttatatatgtaatgaggtttttagaataaatgaatataagtttaatatagtaaaaacattaatacaatttttatttttatgtttaatacattctgtgctccagaaaaaaatatcattgtttatctcacccaagatcattatgatgttcctcaaagttttcttctagaagctttagcattcatgcttaggtgtgtgatccatcttacattgaattttgtggatgatatgagtaagatattaagattaatgaaaatgttaattataataggttctcaggtcctagccaaaggttttgtatattaggatctcttgagatctaggttatttaaaggtaatagacaataagtattaatgaatttgttttctttatctatctggtggttcttaaactttgttgcatattagaatcaagtggtttgcttgcttgctttgttttgtcttgcttttaatagcactgccccaatcataccttcaaaaattctaatttgataacctggacatcaggatttttggaggaggaggggacagggtctcactctgtcacctaggctagtgtacagtggcatgatcatatcccacttcagcctcgaactcctgggcttgagggacccttctgcctcagcctctcacgtagcttgaattacaggtgttgagccaccatgcctggtgacattgggattttaatgggtctctgggtgagtgaatataaagtcatgtttaggaatcattgacaagctccagaagcctggaaaaatgtattcatgaagacagaggttagtgttactgtctccttggatgaaaacacctgacaagatttaggtatttatttattgatttattgatttatttattgggaaacaacattggaagcagtttctgatctgcctctttaatcccttggccaatgcaatcttgagttctttgtagtctcaccattaagtcttgtagggagaatacatctttacttcaagttttcatgcactttatcttcatcttggagaattattatttgaaaaaaagttctcaatatataactcatattaagtaaaatatgtataatacattgcaataattcaacaaatattgcttgtgatgttgtacttactttacacttgtgaaaaatgtaagcaaaatttttaaatagtattacattattttcatagaagaatcacagtaaaataagaactctacaagtccatattttactaagttgcattatttgaaaagcaaactaattttgaagtatctgatgatttcaaaacacagttcactattatttaattagaggatttgaaatataatttttaacattgacttagatactttcctgaaatctattagacataaaagtaaatggtatttatacatttgtttgtaagatgctatgattttaaatttaaaagtctatgtagctttttctgaaggaagctgttctacaattgtagaagcaattttggggcatttctcttacttgattgacttttttcttatccagatgctaccaattttcaagcttgcacaaagtccacttctatgagggaactcagcctacaaggctgtcatgtacatcagtaacatctatatctttatagtaccacatacgccttgccttatcaaatgaaattatataccacgaagtcaggatcgtatctcaactgttctgtaaactccacaatgcatagcatagtgtcactcatgggaaaaatgaaatacttgtgattgaaatggattaacattcttctcatgttaaggaacgtacttcttttattgtacctgttgttatgcagggtgtaagatttattattttctccagaattgatatcaataattaaaaatatataaaaattgaagataaatggggaaacgaacaatttatgaaggtcaaaactatgaagtaaatttcagttcatggatatttggtagaaatactaggttggagagtatggttcacatttgagaccaaattaaatattatttaatagatttctttcatacttagttgaaggaaagcatgtaataaaaacctagcttgaccaaaaacctgacttgctcttggcaaaaattgtggtgtagagagagagaaagagagagagaaggaagtaagaaaattaataacctctactctgtgggaaagtcgttccattccaaatgacacaaatagagaatctgatgaatccgagcctaagaaagtcgaaaaggaagcagattggtatctaatcattgaagacaataaacctgaacactaaaaagacatgactaaataaatgtcaggttctgaacaattaaactggttacttctcttacattgaagtaaagagagactggaaatttctgcctcaactctccctatcaactcaataccttagagtcgaacatagtgttccaaataaaaatataatgaggcagaagatgacaccttgtttactaaattttctagttcatattgaatagttccatctgagcttgaaagccaaggtcttggggaaccatttttaatgtgcttttcaaagagctcatattaaaataattactttatatgtaattagcaaataattagatatgaggctcacaaaggaaatatttatgttcatataatatggctaatgtatggtaacaatagtattaaatctatagatctatgatgggagaattactagaaaaacaatagtgggtctcccaatccatgagcatggaatgattttccatttgcttagatgattagttttcagcatacaaatcttacacacattttgctacatttatttccaagggtttatttttatagtattgtgaatataattatttcttaatttttttttaagagagaaagtgtcttgctctatctacctggctggagtgcagcatcttgcaatcatagctcactgcaaccttgaactactgggctcaagcaactctcctgcctcagtctcctgagtacctaggactgaggtgaatgccaccaagcctagctaattaaaaataaataaatacatttgtaaagaagatctctgtttgttgcgcaggctggttttgaactcctagcctcaagtaatcctcctgacttgacctcccaaggcactgggattacaggcctgagctctttagcccagccacttccatttcctgatggttttatcaatgtattcttcattgtattgactataatctccagtgcaatattggatagaattggtgagagtgaacattataaacatctttggcatgtcgccaattttgaggggaaaacatccagtctttcaccattagatgtgctgtaaaacacagtgtttttggtgattgttgttgctgatgtcctctatcaggttgaagaaattccattctatttttttattcatgttagattctgtcaaatcattttcctgcatcattgagataatcgtttcattttagttctttattttacaacataatatattacattatttactttttaaatactaaaacaatcctgcatttctgggattaatttcacttagttatggagtgcaatcatttgtatacatggttgaatttagtttgataatattttattggagattttcgtgtctatatttgtgaggtatactgatctgtaattttatttttattttttcttttttaaaatttctttttctttcttctttcatttttgcttttgaatataggccttataacatcaattgggaagtttttctctttctctattttctgagtatgagtatcatttcttcattgactatgtgaaataatttaccagtgaagtcatgtggtcctgtatattctcttatggaagacttttaattgttaattcaacatatttattcagattttctattcatgtttgtttcagctgtggtaatttatacatttttaagactttctaccataaatataagttgtataatttgtggtcacaaagtatttaatagtatttcccttataattcatacatttggacaggatgggggagaattggcagtagtaacctttgttcctgattttggtaatcaacactttatctcttatttcttttcttttttgagacagagttttgccgttgtcacccaggctggagtgcaaaggcaggatctgggttcactgtaacctctgcctcctgggttcaagcgattctccttcctcagcctcctgagtagctgggattacaggtgcccaccaccacgcccggctaatttttgtaatttttggagatggggtttcaccatgttggccaggctagtcacgaactgctggcctcaagtgatccatctgccatggcctcccaaagtgttgggattacaggtgtgagccaccatgcctggtcttttttattattcatcatctaaatatttctcaattttgtttaacttttcaaagatttagattttggatcattaaatttctttgttttttgttttcttttttctgttatttttttttagcataacatttttatttaaaaaataactattttccacaagaacaaaagtgtagcgagaggagtggtgataaaggttacatcctggcgagtctctctaaggtctggctagcagaggattgctgacttctcatacctgcttctgcattcaccctgctgctaccacacccttatgtagtctctggaaaactccactgtgttcttgtgacagaatgacagtaaaaatggcaaaaacatttattaaggactgaattctatcccccacaccacccaccgaaatttatacactgaagtcctaacccctggtgtgactctatttggagtgaagatttaaggctaatgaggtcataagagtggaatcctggttccatacaattaatgtccttataagaagagacactggagagcttctctctgccatgtgaggccacagcaggaagacagccatccacaggccaggaagagagccctcactaggacctacaacgggcaaacacctcgatttggaacttccctgcctccacaattgtgagaaatcaatgactcgtttaagccttttttttttaataggatttgagattggttatattaaggtaacaatggaaacatgaatacaaaattaatccacacataggaaaaaggaataatacataaaccactgaggttgctaataataatgatgcctgtttccaaggcaagtgaatacattatgagaccactgaagtgacttttagttaccttgcttagtgcctctgtctttttttttcctttattattattattattatacttttaacttttagggtacatgtgcacactgtgcaggttagttacatatgtatacatgtgacatgctggtgcgctgcacccactaactcgtcatctagcattaggtatatctcccagtgctatccctcccccctacccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaattacatccaagtccctacaaaggacatgaactcatcattttttatggctgcatagtattccatggtgtatatgtgacacattttcttaatccagtctatcattgttggacatttgggttggttccaagtgtttgctatcgtgaataatgccgcaataaacatatgtgtgcatgtgtctttatagcagcatgacttatagtcctttgggtatatacccagtaatgggatggctgggtcaaatggtatttccagtactagatccctgaggaatcgccaaactgacttccacaatggttgaactagtttatagtcccaccaacagtgtaaaagtgttcctatttctccacatcctctccagcacctgttgtttcctgactttgtaatgattgccattctaactggtgtgagatggtatctcattgtgcttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggtttcctgttcactctgatggtagtttcttttgctgtgcagaagctctttagtttaattagatcccatttgtcaattttgtcttttgttcccattgcttttggtgttttatacatgaagtccttgcccatgcctatgtcctcaatggtaatgcctaggttttcttctagggtttttatggttttaggtctaacgtttaagtctttaatccatctggaattgatttttgtataaggtgtaaggaagggatccagtttcagctttctacatatggctagccatttttccctgcaccatttattaaatagggaatcctttcccattgcttgtttttgtcaggtttgtcaaagatcagatagttgtagatatgcggtgttatttctgagggctctgttctgttccattgatctgtatctctgttttggtaccagtaccatgctgttttggttactgtagccttgtactttagtttgaagtcaggtagtgtgatgtctccagctttgttcttttggcttaggattgacttggcgatgcgggctcttttttggttccatatgaactttaaagtagttttttccaattctgtgaagaaagtcattggtagcttgatggggatggcattgaatctgtaaattaccttggacagtatggccattttcacgatattgattcttcctacccatgagcatggaatgttatcccatttgtttgtatcctcttttatttccttgagcagtggtttgtagttctccatgaagaggtccttcacatcccttgtaagttggattcctaggtattttattctctttgaagcaattgtgaatgggatttcactcatgatttggctctctgtttgtctgttattggtgtataagaaggcttgtgatttttgcacattgattttgtatcctgagactttgctgaatttgcttatcagcttaaggagattttgggctgagacaatggggttttctagatatacaatcatgtcatctgcaaacagggacaatttgacttcctcttttcctaactgaatacactttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatggcttttattattttgaaatatgccccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgaccacggtggataagctttttgatgtgctgctggattcgttttgccagtatgttattgaggatttttgcatcaatgttcatcaaggatattgatctaaaattctcttttttggttgtgtctctgcctggctttggtatcagaatgatgctggcctcataaaacgagttagggaggattccctctttttctattgattggaatactttcagaaggaatggtaccagttcctccttgtacctctgttagaattcggctgtgaatccatctggtcctggactctttttgttggtaagctattaattattgccacaatttcagatcctgttattggtctattcagagattcaattcttcctggtttagtcttgggacagtgtatatgtcgaggaatttatccatttcttctagattttctagtttatttgcatagaggtgtttgtagtattctctgatggtagtttgtatttctgtgggatcggtggtgatatctcctttatcattttttattgcgtctatttgattcttctctctttttttctttattagtcttgctagcggtctatcaattttgttgatcctttcaaaaaaccagctcctggattcattaattttttgaaaggtttttttttgtgtctctatttccttcagttctgctctgattttagttatttcttgccttctgctagcttttgaatgtgtttactcttgcttttctagttcttttaattgtgatgttagggtgtcaattttggatctttcctgctttctcttgtgggcatttagtgctataaatttccctctaagccaaaagaacaaagctggaggcatcacacttcctgactccaaactacactacaaggctacagtaaccaaaacagcatggtactggtaccaaaacagagatatagatcattggaacagaacagagccctcagaaataacgctgcatatctacaactatctgatctttgacaaacctgagaaaaacaagcaatggggaaaggattccctatttaataaatggtgcgggaaaaactggctagccatatgtagaaagctgaaactggatcccttccttacaccttatacaaaaatcaattccagatggattaaagacttaaacgttagacctaaaaccataaaaaccctagaagaaaacctaggcattaccattcaggacataggcatgggcaaggacttcatgtataaaacaccaaaagcaatgggaacaaaagacaaaattgacaaatgggatctaattaaactaaagagcttctgcacagcaaaagaaactaccatcagagtgaacaggaaacctacaaaatgggagaaaattttcgcaacctactcatctgacaaagggctaatatccagaatctacaatgaactcaaacaaatttacaagaaaaaaacaaacaaccctatcaaaaagtgggcgaaagacatgaacagacacttctcaaaagaagacatttatgcagccaaaaaacacatgaaaaaatgctcatcatcactggccatcagagaaatgcaaatcaaaagcacaatgagataccatctcacaccagttagaatggcaatcattacaaagtcaggaaacaacaggtgctggagaggatgtggagaaataggaacacttttacactgttggtgggactataaactagttcaaccattgtggaagtcagtgtggcgattcctcagggatctagtactggaaataccatttgacccagccatcccattactgggtatatacccaaaggactataagtcatgctgctataaagacacatgcacacatatgtttattgcggcattattcacgatagcaaacacttggaaccaacccaaatgtccaacaatgatagactggattaagaaaatgtgtcacatatacatcatggaatactatgcagccataaaaaatgatgagttcatgtcctttgtagggacatggatgaaattggaaatcatcattctcagtaaactatgacaagaacaaaaaaccaaacaccgcatattctcactcataggtgggaattgaacaatgagatcacatggacacaggaaggggaatatcacactctggggactgttgtggggtcgggggggggagggatagcattgggagatatacctaatgctagatgacgagttagtgggtgcagcacacagcatggcacatgtatacctatgtaactaacctgcacaatgtgcacatgtaccctaaaacttaaagtataataaaaaagagaaaaaagaaaccccccccaaaaaaagaaagagatatttattccttctatattttcctataaactcaaaagcctattaaaatgttaactatatggaaaatacataatacatactgatgacaaatttatttataataaaaatatcttagtatctttatatgtggatgatattgacaaagtttttctctttagttattttacaattgacttttaaaatgtcttgttattcagtaacgtctctaagtgctttccaacaataactgagaaaaataggtgattgaaacttgagagtttcacaggcttagtctacttctgaggtgagatgagaagccacagacagactatctctcaactatgatagtaatcttaattgatctcagaattttgctttactaggtcttaagcttattgttctttattacccattatttcacactttgcaactgactgggcattttgccagtgatcacaatgaataaaatgtggcttcagcggcctattactgtgctcaatgtctttgcaagttgctggcaaacatgattttattttagatactgttatatgaagtaattttttaaaatttatagtttgccaatttattcataaatttcttagtatcattttcattattaacacatttacataccgtgcttcacacttacctgtaaaatagtgaattctacatcaaaagtatttaacgagaacactggtggatgaagtgactatacttccaaagcaaaatcatctctttttaattcatcagcttagacggagaatgtttaatgttacttgtaaataatggactaacaaaaatccactaaccctaccttttgtgtttttatatgcaaaatagagttgtgttagactgtcttgaaattgactgacctgctctatataaaggcttgaggtgatcaggaatactctattctaaggatatgggagttttgacaattataatatccagaaaatataatatccattcatacaatatgaatggggaatgcaggtgtacttgtttatatatatatatatatatatatatatatatatatatatatatatattctattcatgtatacacattctgtgttactttctgtgttagcctgccacagtgtcatgaatgctaggagaagatacaggacccctggttcatggacaaagactttatttctcaaggcacagcaaggggcatgagttactcattcttattgttccttttaccccaaaagtctaacaagacaaagtagagggacctgagtagatactacacacagtggatttacatcagagcttagctactctaggctgaaggagcccaatcattttatcatgagatataagcaaacctccccaggatttgccttggagggagacatctttattaccaataagtaagaaaatatattcttgctttaaaaggggatactttgtctttcagaattgttctctacacaaagatcctttaaaagggagcctagtgcagaataacagttgtgcagaaatgcaaaagacacttggaggactgtctcctaacacctatcaaatgcagagtactacattaggtatcagggaaagaaagatgaaattatttgggctgatggaaatcagcagctcacttaaaagaagcatgagtggaaagttagttatggtaacgcaggagaggaagtgataccataatgtttaaaacagggagacatttagccaagtctaggaggtcagggagtacttttcaaagttaatacctgataagagttttgatgtaaattttctaaaaacgcttctatgtagctgtatctttcttactttcttaggggttctaggttatacaaaagtcaagaatttcaaggctttttattaaaaattgctcaacatatgtttctaagatttgtttgctaccagtagcctcctttagccaaaatttcataaggtttcaagattatataaagataatgaaaactaatctgaattagagtttttgcttaattagtaggatcttggaaattatcttgaagaatataagaagattttaataataattttatgtgcaaactcttgcccataacaataatgttttataattttatctccttctcatctcacttgaatatgcaatgttcaactaaaatcacttataaaagaagcaggaatatgggaatatttagcctttggggaatcttatttcctatgttgttgactatggcctccaaggaggaattttagatccctatttccctgcaagatgatctattatggtggattataacttctatgtctcattttatctcataatggataaagaaaacttggcacatataccatggaatattatgcagccataaaaaaaggatgagttcatgtcctttgcagggacatggatgaagctggaatccatcattctcagcaaactaacacaggaacagaaaaccaaacaccacatgttctcactcgtaaatggggctcgaacagtgagaacacatggacacagggagggaaacatcacacactgtggcctgttgggggttgggagggctagggtattaggagaagtatctaatgtagataatgagttgatgggtgcaacaaactctcatggctcatgtatacctatgtaacaatcctgtatgttctgcacatgtatcccagaagttaaagtataaaaaattccatatttttatattttgatgtacatattataccagtatagttatatatgtaaaaattttaagggtaaatacatataaaacatatattagtctttgatcagaattgtattaccaatataaataagaatatcatttagaatataaaattcctgattctgcaacaaatgacttaatattatcaatattaatcataattatttaaatgctttttagctgcccatcaccatattaataataggaataatgacagctaattttaattgagtacttcctaaatgtggcccagttacagtaaaacaaacactattagatacaccccatcaatcattacagcaagtctatgaaacatactgcattactaagtcaatattagaaatgaaaaactcatgggaaggatatgtataaaacttgctcaaagttacccagctaataagaggctaggacaagattaaacatctatgtagttttctttcctgagctgaagttcctaaatccttggctgcatggcgcctcattcaaaagtcctaaattggctaaaatatatataacagaaaattcacagaatcatttccttctacttgtccactaccagggctgttaacagtcccaagcaaaaggacaaaaattttttctacttgagataagaaaaatatacagggtgacagaaggtgttctaccaatataaaaacactttaccaggaaaattgagaagagggctgttaacctttggggaaatgtaggccttcagtggattcttgttagaaacataaagatgtagagagaagattttcatttaaaagcctcttccattcagcaaagtatattctgaatcctttatggtattaggctcccatatagttacaagtaaccccatgtggttttagaattcttaaatattcgcacacatagtcatctgaagaatgaataaatccatgaatgactaaacagagtttattcccatatcattttcaatatccctaaattatgcttacatccttaaatctgttacttcattctcaaagcacatagtctgtaactcataaaaataaactcctgttggccaggcacagtggctcacgcctgtaatcccagtactttgggaggctgaggtgggcggatcacctgaggtcaggagttcctgaccagcctgatcaacatggagaaaccctgtctctactaaaaatacaaaattagccaggattggtggcgcatgcctgtaatcccagctactgggaaggctgaggcagcagactcgcttgaacccaggaggtggaggttgcggtaagccaagatcaagccattgcactccagcctgggcaacaagagcgaaattctgtctcaataaataaataaataaataaataaataaacaaacaaacacctgtcttcctagtgttttatgtctatagttcagaaatgctttacctacttcatgatgtgtagtttgttctgatctgttccttttcttcattgtgtctagcctcataagtcatcttcctagttttggaataacctaatcccgtaaggtcattgctaatgtttcagctttgaataatttcctattttctgccctatgtattgaacccttctgttaattatgctgtctttaatatatcttacttgctttgaatagacttctgtaccattctacttataggttgttccagccaaactcattctaaataggtcaggcatggcctaaacattctaaataggccaggcatggtggctcacgcctgtaatcccagcactttaggaggctgaggtgggcaaatcaaaaggtcaggagttcgagaccagcctggctaaatgttgaaaccccatctctactaaagatacaaaaaattagccaggtgtggtgacttgtgcctgaaattgcagctactcaggaggctgaggcagttgaattgcttgaacacaggaggcagatgttgcagcgagccgagatctcaccattgtactccagcctgggtgacgggccgatactccatctccaaaaaaaaaaaaaaaaaaaaaagtaaagaaaaacatttatgaaagtgtgcacaacaaaattaaaatgttgactctaaagtgagcaactgaatgactgggatgcataagagaaaagggtacttaacatttttatacctattgaattgtatcctatgtacgtattataaatttaaatgtgcaataatgcagataactgaaatgtgggtatgctttgattaggactttgcatttcccatttgctcaaactcctcatgattctggatgcatatgaatagaaatacaaaatgtaaggggaccgaggacttctcatagccctttcttctttccacattttgtgtctctggctgtagtttgccatatgagtctatatggctaatgagcaaaatatttttcagatggatacctgtgaccaagcattgcattttaaagatatttctgaatcttggacctcttatttacagtgaagccccctcatgcatagtaaagcagacaggaatgtaaaaggttgctgcatcgataatcaatttctggtgagcagtaattataggtaatgtaaacagggacaattattgcttttcatcatatcttgagagaaatcctacagccaatgattttgaaaaaaataaaacatctaagttcactcttttctataatgaaaagacattatccagtagaagttcaagagtacagtctgaaggcagcttatctgacctggccacatggtcttgccactttagttaaagacaacttcctacacagtaacctctccagacctcagatcctcaactctctaaaatggaaacctagtagtatttacctctagaactgcagctgaactgagcattttaggaaaggaacaaacacacacacgatatatataatcagattatgaacgcagtgtggcccagagtgcaaaaatttctcagtactagagattctcaagagaaaaatgagatgtagtctatctcagtggcctttcatgtggcaaatgaaaagtgaaagtccataatgagaaatacatgggcagccagtgacaccacccattcaatgtagactctcaacatctctgacagtcattacctgttgtaccctgacctgcttatatattggggtaatatcaccttttgatcaaaacatacataaacctcaagcctcagtaagaaatatttatggacaaccagattttctgtgtttccagtcaaaactcaggtagaccacattttatgtgacaggagaaggcacagttgatgcccagttaaccctgagatcatctctgcctgcagcttcctatcatcatagcaagctctttccctgaagtacatcatctgtatctgctctttgctatataagtagcaaaaataagcatctgaaaagatgctcagcaccatatgtcactggggaattcaaattaaaacaacaatgagataccactacacatctattagactggcttaaatccaaacgctgacaccatcaaatgctggtgaggatatggagcagcaggaacactcattgattgctgctgggaatgcaaaatggtaaagccactgtggaaggcagttttgcaaattcctgcaaaactaaacatatgcttaccataagatctggcaattgcattctttggtgaatactcaaatgacctgaaactttatccactgaaattctgcacgtgaatgtttaaagcagcttatacatattcgacaaagattggaagtaaccaagatatcctacaatagggaaatggataaactatctctgaaacattcatacaatggaatattcttcaggaataaaaagaaactaccaaggcatgaaaagacttggaggaatcttaaacacgtatttctaagtgaaagaagccaatgtgaaaaggccacatagtgtagagttccaattatatggaatactagaaaaggcaaaactaggcagatggtattataaaaagttcagtggttgccaggggcttgagcaaagggaaggatgaataggtggagcacagaagatttttcgggcagtgaaacttttctgtgtgaccctataatggtggatatatgtccttaagcatttgtcaaagcccataaatggtagaacacaaagaatgaatgttaatataagccatgaacttaataatatcaatattggctcatcatgcataacaaatgtaccacattaacaagatgataatagaggaagtgtgtgtactatggtgtgaggcagatattagagcacaataggccttctgctctatttttctgtacgcctacaactgttctaaaaattaagtcaattatttatttatttattatttattaatttattttttgagatggagtctcactctgttgcccatgctggagtgcaatggcacgatcttggcttattgcaacctctgcctcctgggttcaagtgattctgctgcctcagcctcccaagtagctggaattacaggcacccagcaccatgcccggctaatttttttgtatttttagtagagacagggtttcaccatgttagccaggatggtcttaatctactgacctcgtgattcacccaccttgccctcccaaaatgcttggattacaggcatgagccaccgtgccaggcctaatttatctttttgagacaggttttagctctgtcactcaggctggagtgcagtggtgcaatcatggctctatgcagccccaacctccagggctcaagtaaccctcccacatcagcctcctgagtatctgggaccacagggatgtgccaccatgcctggcacatttcttagacctctgaaaagatgctcaacaccatatgtcactaggaatattcggtattcaactagaggcttcaatgggctctgaaatatcccctggtaaactctataaatgtgtttccaactggctgaatgaaaacaaaggtttacatctgtgtgagatgaattcacatatcagaaagcattttcactgagaacttttctagttttatagcaggatgttcgttttttcaatattggtctcaacgggctccaaaatgtccctttgtacagtctacaaaatgttttgccaacatactgaatcaaaacaaatgtttagcactgtgagatgaattttcacatcaccaaacatttttacagatagtttgtgtctagtttttaatcacaaaattttgaatttttcactgtaagcctcaaagggctctaaattgtcccctcttagcttctactaaaagagagttttgaacctactgtgtagaaacaaaagtttaactctgtgaaatgaattcccacattgcaaagctatttcacaggtagcttgcttctagtttttatcacgaattatttggcttttcactataggcctcaaatgggctccgaaatgtcccttcatacattctacaaaaagagtgtttccaacttagctgaatcagaggaaagtttaaactgtgtgagatgaaactgcaaattgcaaagcattttcacatatagcttctatagtttctatcagataatattcagtttttcactataggcctctgtggactatgaaatgtcccttcataggttatacaaaaaggtgtttccaacatgctgaatgaaaataaagatttaactttgtgagatgaacccacacatcacaaagcatttttatagatagattttctctagtttttattgcagaatattcaatttcatactataggcctcaatttgctccaaaatttcaccttgtagattctacaaaaagaatatttccaacccgctgaatcaaaaccgatgttcaattctgtgagatgatatgcaaagctttttcacagatatcctgtttctagtttttatcctgtggtgtttggtttttcactataagcatcaatgggctctgaaatgtccctctgtagattctacaaaaagagtgtttccaacctgttgaatcaaaacagttttaactttgtgagatgaagccacacatcacaaagcattttcacccatagcttgtttctaatttttaccatgggttattggtttttcactaaatgcctcaatggactaggaataattgccttgcagattgtacaaccaaggagtttccaacctgcagaagcaaaacacaggtttaactttgtaagatgaatctacacctcgcaaagcatttttacagataggttgctttgagttttcatcaagagatatttgattcttcactgtatgcttcaatgggctatgaaatctccccttacagattctacaaaaaaagtttccaaactgatgaatcaaaagaaaagttcaacttttgagatgaaatcacacatcacaaagtattttcagaaatagcttctttatagtttttatcacaggatattagattttccaatattagggtcaatgagctctgtaatgtccctttgtagattgtacaaaatgagtgtttccaacctatggaataaaaaggaaggtttaactctgtgagataaatccacacatcacaaagcatcttcacagatggcttgtttctaatttttattgtgggatattctgtttttcactaaaggcctcaagcgctccgaaatgtccctttgtagattctataacaagagtgttttaaaactgctgaatcaaaacaaatgtataaccctttgagaggaatccacacatcacaaagcatattttcagatacttgtttctagttattaaagcaagatattcagtttttcagtatatgcctcattgggctcagaaatgtctcatagtagattttgagacatagtagattttgaaacacaaaaatagtgtttcctacctgccgaatcaaaacaacagtttaaacctgtgagatgactccaaacctcgcaaagcattttcacagatagtcgtttcctagtttttatcacaggatactcggtttttcagtataggcatcaatgaactctgaaatgtccactcataggttctataaaagtgtgttcccaactccctgtataaaagcaaaggtttaactctgtgaaatgaatctgcacattggaaagcattttcacaaatagcttgtttctagcttttatgatgagatatttgattttttactattggcctcaatgggctcagaaatgtctctttgcagattctaaagaaaaaaggtttttcatttttctgaataaaaataaaggtttaactctttgctgtgaaatcacacatcacaaagaatttttacaaacagcttgttcctagggtttatcactggatattgggtttttcactataagcttcagtggagacttaattgtaacttaattcacaaaaagagtgtcccccaacctgctgtatgtaaataaaggtttacctctgtgagataaatcttcacatcacaaagcattttccccgatagcttttttctagtttttatctcgggatattgatttttcactataggcttcaatgggttttgaaagtttcctctgtagattctacaaaaagagtgtattaacctgctgaatcaaaacaacgtttaactttttgagataaatccacacatcataaagcattttcacagatagctctttttttttttttttttttttttaagatggagtctcactcagtcacccaggctggagtgcagtggtgtgatctcggttcactgcaagctccgcttcctgggttcatgccattctcctgcctcagcctcccaagtagctgggactacagatgcccgccaccaggccaggctaatttttttgtgtttttagtagagacggggtttcaccatgttagccaagatggtctcgatctcctgacctcatgatccacccgcctcagcatcccaaagtgttaggactacaggcgtgagccaccgcacctggccgatagcttttttaactttttattttgggatattggtttttcactacaggctgatactggcttcaaattgtaccctcatagattctacaaacagtgagtttccaagcatctgaaatgctagatattcggtttttcactgtaggcatcaatttgctctgaaatgtcctattgaagattttaccaaaagagtgtttccatcctgctgaatcaaaagaaggtttaattctgtgtgatgaaattacccatcgtaaatcattttcagagacagcttcatatagtttttatctcagaatattccgtttttcactttaagcctcaatgggctttgaaatgcctcctcataaattgtacaaaaaaaaggagtttccaacatgttgaatcaaaacaaatatttaatgttgtgagataaattcaaatatcgcaaagcatttttacagattttttttctcatttttatcgcggaatattcggtttttcactagtcctcagtgggctcagaaatgccccttgtatgttctacaaaaagaatgtttctaacttgctgaaccaaaacaaaactttaatgctttgaggtgaaaccacacattgcaaacattttcacagatagcttgtttctagttttgatcacggaatattggatgttttacaataggcctcaacgtgctaagaattgtcccctcttagattctactagaagagtgtttccaaaatgctgtataaaaataaaggcttaacactgtgagatgaactgacacatcacaaagcattttcacaggtaggttgtttcaacttttcatcatgtgatattcagtttttcaatatattcctccatgggctctgaaatgtcccttcatagattctatgaaaagactgcatccaactgactgaatcaagacaaaggtataactctgtgagagaaatgcacacatctcaaagcattttcactgatatcttgtttctagtttttatcatgggataatttgtttttgactataggcctcaatgggtttcaaaatgtccctttgtagattctacaaaaagagtgcttccatcctgctcaatcaaagcaaaggtttaattctctgaaatgaatccacacatcacaaatcattttacaatatagcttgtttctagtttttattgtgggatatttgattttttactttagacctcaatgggctctgaaatgtgccttcttagattctacaaagagagtgtttctcacctgctgaatcaaaacaaaggtttaattttgtgagataagtccacacatcaccaagcatttttataaatagcttgtttctaatttttatcatgggatattcagttttttcagtgtaggcctcattggtctctgaaatgtcccctcatagattctacaagtagagtttttgcaacctgatacaccaaaacaaacatttaattctgtgagataaatctataactctacacgtctgaaagcattttcacagatagcttgtttctagtttttatcacaggatatttgatttttcactatagacctcaataggctctgaaatgtcccctcaaaaattctacaaaaagagtgttttcaacctgctgaataaaaacaaagttttaactctgaaaaataataaatcataaaacattttcacagttggcttgtttctagtttttatcacgcgatactcagtttttcatgacagggcacaatgggctccaaaatgtccctttgaacattctacaaaaagagagattttggcctactgaataaaaacaaaggttttatactgtgagaggaatccacacataggaaggaattttcacagatagcttgtttctagttttcaacacaggatgttcaggtttttcatatacttcttgatgggctctgaaatgtcccttcatagactctacaaagacagcatttacaacctgctgaataaaaacaaaggtttaacctgtgagttgaatccacacatcacaaagcattctcatatatagcttgtttctagtttttatcttgagatataacgtttttaactttaggccttaatgttgtctgaaatgtgccattttagtttctacaaatacagtgtttcaacctgctgaattaaaacgagatttaactctctgatatgaattgacacatcacaaactattttcacagatagctttttactagtttttgtcatgggattttaagtttttcactaatggctttcatgtactctgaaatgtccctatgtagattttacaaaaagagtgtttccaacctactgaatcaaaacaagggtttaaatctgtgagatatatccatacattgcaaagcactttcacagattgctagtttctagtttttatcatgagatacttggtttttcactatagacctcaataggctcccaaatgactctcatagattgtacaaaaagagtgttttcaaagtgctgaatcaaaataaagatttaactcagtgaggtgaatccacgcattgcaaaatattttcacagatagcttgtttttttttttgtttgtttgttttgtttttattgtgggatatttcatttttcactacaggcctcaatgggcaccaaaatgtcttctcctagatcctacaaactgactgtttccaacttgcttaatcaaaacaaaggtttaaccctgtgatatgaatacacacatcccaaaggattttcacagatagcttatttctagtttatatctccacttattttgtttttcactgtaggtttcaatgggctttgaaatgtttctttgtagattctgcaaaaagcttttcaaatctgccgaattaaaacagtatttaactctttgagatgaatccacacactgcaaagcattttcacaggtagctttttttctagtttttatcatgggatatttggtctttcactgtagtagtcctcaatggactctgaaatggcccttagtagattctacaaaaaagagtgtttccaacctgctgaatcaagataaatgtttaactctatgaaaggaatccacacaatgcaaagcattttcacagatagcttgtttgtggtttttattgcaggatatttggtgttttaatgtacttgtccatgggctccgaaatgtctcttcatatattctacaaaaatagtgattccaacctgctgaaaaaataacatgtgtttaactctgagagatgattccccaaatcacaagacgttttcacagacagcttgtttctagttttcattgtgggatatttaacttttcactagaggtcttaatgagctttgtaatgtccttttgtacaatctacaaaaagagagtttccagtctgctgaatcaaaacaaaggtttaaacctgtaagatagatccacacattgcaaaacattttcacagacatcttgtttctacttttcattgtagcatacttgctttttccaaatacttctccaggggctccatattgtcccttcgtaaattccacaaaaagagtgtttccaaccagctaaatcaaaacaaaggtttaaatctgtgagttaaatctatgcattgcaaagcattttcacagatagcctgtttctcatttttatcatgggatatttggtttttcaccataggcctcaatgggtactaaaatgtcttctcatagattctaaaaacagactgctttcaacctgcttaatcaaaagaaaggtttaactccatgatatgaatccacacattgcaaagcattttcacagatagcttgtttctagtttttttctccacatattttgtttttcactataggcttcaatgggctttgaaatatttctttgtagattctgcaaaaagagtttttccaccctgtgtatttaaaacactggtttaactctgtggcatgaatccacaatggcaaagcattttcacagatagcttttttcttgtttttttttttttttttttttgggtggggtgggggcgatatttggtctttcactgtaggtctcaatgggctctgaaatggcccttcatagattctacataaagagtttttccaacctgctgaatcaaaacaaatgtttaattctggaagatgaatccacacatcacaaagcattttcagatatagacttttattgtttttattgtgaaatattttgttttttactataggcatcaatgggtgtgaaatgtccattcatatattctataaaaaagtgttttcaacctgctgaataaatgcaaaggtttaaatatgtgagatgcacccacacattgcaaagcattttcaaagacagcttgtttccacttttatcctgagatattttgtgtttcactatgggcctcaatgggcttcaaactgtccctttgtagattctacaaaaagagtgtttccaatctgcttaatcaaaaaaatgattaactctgtgagatgaatccacatatcacaaagaatttttactgatagcttgtttctggatgttatcacgggataatcggttttttatcaacctgctgaatcacaagaaagatttaactctgtgagatgaaatcacacatcacatataactttcagacacagctttttgtagtttttatcacagggcattaagtttttcactacaggcttcaatgggctttgaaatatccttgtgtagattgtacaaagagagtgtatccaacctgctgaatgaaaacaatatttaattctttgagataaatccacacataccaaagcatttttacagataggttgtttccatttttcatcatgagatattggggttttcactataggtttcaatgggctctgaaatgtttcttcatagattctagaaaaggagtgtttcaattcgattgaaatgagtgttctgattctgctgaatcagaaggaagttttaactctgtgagatggatccacacattgcagagctttttcacagataccttacttctggtttttttcatgggatatttggtttttcactataggcctcaatgagctccgaaatgtttttatgtagcatctaaaaaaagagtttttccaaactgatgaattaaaacaaaggtttaaatatgtgacattatttcacatatcacaaagcattttcacagataccttgtttgtagtttttatcacaggatattctgcttctcactataggcctcaagggtttgaaatgtctttccttagatttatgaaaaacatgtttctagcctactgaatgacaaatgtttaactctgtgagatgaatccagacactgccagtcgttttcacagatagctgtttcctagttttgtgtgtgggggatattcgctttttcacaatatgcctcaaaggtctcagaaattcccattagtagattctacaaaaagagtgtttccaacatgctaaataaaaaaaaaactttaactctgtgagaagaatccacacatcacaaaatattttcactgatagcttgtttttagttttcatcgtgtaatatttgttttttgtttttgttttttgatttttgttttttactataggccccaatgagctctgacattttttctttttagattcaacaaacagagtgtttccaacctattgaatcaaaagaaaggtttaaatttgtaagatgaatccacacatcgcaaagcatattcacagatagcaagcttctagtgtttttttttttttctgcaggatattctgtttttcactgtaggcctcaatgggctctgacatgtttgttggtagatactactaaaagactgtttcaaacctgctgaatcaaaataaaagtataactctttgagatgagcccacacatcctaaagcattttacagatagcttacttctagtttttatcacgagatattctgtttttcactatagacctccatgggctccgaaatgtccccttgtagattctacaaaaagaatgtttccaaattgctgaattaaaacaaaggtttaactgtgtgacattatttcacagatcacaaagcattttcacggatagcttgtttctagtttttattgcaggatatttggttttaaactctaggcctcaatgtgcttcaaaatgtctcatcttagattctacaaaaaacatgtttccaacatgctgaatcaaaacaaaaggttggctctgtgagataattccatgtctcacaaagccttttgacagatggcttgcatcaagttttcttcatgggatattccatttttctccataggcatcagtgggctccaaaatgtccctttgtagatactacagtgaaagtgtttctaaactgctgaattaaaacaaggatttagttttgtgagataaatccagacatcacaaagcatttcactgatagtttgtttctagtttttatcacaggatagtcagtttcttactataggcctcaatttgctctgtaatatcccctgttagattctagaaaaggagaatttccagtctgttgaatcacaagaaatgtttaactctgtgagataaaatcacacattggaaagcattttcagacatagcttctttgtagtttttatcgtggtatatttggtgtttcattataggcctcaatggattttgaaattttccctcatagggacacaaaaatgtctttatccttctgaatcaaaacaaagttttaactgaaaaaaaaaaatccacacatagcaaagcatttttaccatatctgccaagaaggaaactcttgttctcccaattttatcagaaggctgcctgattcctataggatgagaagcaggcagcggtgtctggatttgcctggtcatctaggctctgttacatatcatctgcatgttctttttcattgtggaggggatcttttatggatctgttgctagcggggactgcctctctttacagatcttttggctgccaggaatttcaaggagcaaaaagtactttgggtaggctggctgcactccaggttgtgagtagcggtctcactgtgggggactgagatgtttgcagtttgcaggaggcttttgggttctctggcaggaatccttgaacatggctttgactctagcacaggccctctcattctccaagggaagcattgattttccattgctttcatgaggagtccatactactcttcatcagcactcctaaacacactttttttggcttgcaattgcctcaggcggccactgagacgctctctgaactgcatctgcacctgtgaagtcagtccaaagtgtgagacttctgcttcactttgaacttgcctttgtcatggttcctgcctttcccaaagagccatgttgagaagcaggagcccctgtgaggcccaggatgaagggaggcagtgagctcaagggcccggccattttctgctgacatctgcctctggggtctcaggtatgatttcatcacctggacaccccttaacatctcagcagactgtattcccttcccccatgggacccgattcttgcacacagcctctttcgggaatggaatcggaagaacagtttctagctcccacctcagtctccaagtgcctcctcctccagcgggacctgaccatggagacagcccgaagaggcctgcatagagggttcgggggtgagtctttttgaaacttgccccctctgtgatgtctaagtacagcctgcctgtgttccccaggctgctctctcccaggaggggcttcctgcagaaacacacagcctctgaagctgctgggatgtgtgtttctttgggaatgtttcaagttgtggatatctgcgtgtgggtgcagacatgtgagtgtgtgtgtgtgtgtggggggtaagtggagtctgctgaaagaaatgtggctaacgcactgcagcactttgttttttgtcaccccaccttccggtggcctgtctctgtggctctgcttgggctgagggtctccatgttcttcatttttccatggctcctgagtccacagtaaattggaagaatggctgacaaccgccagggtcaaaatcacctccccttgcaaaaaaaccacatttctaaaaagaagagaagcacaccacaccccaaaacagacaactccccgtgctttattgttctgtggccagccctgggccagacccccgcagtccagtcgcagggctttttgaatttacctcgattttggtttgtagctgagcaggtgcttcaggtcatcaggaagcactcctccattgtctcggaattttattctgggatgcagagtgtgagcaacaataaggtcagataggggtgaggatacagtctgttgaggtatggatgggatctcgcaccttcacctcaaaaaaggtgcagacaaatgacacagaagttgcttctaactgcatcccctcattcccttcattgcacagtcaacagcatggcccggtgcccaggtgggatgactcaatcgtgcagagaaaagttggattgtaaactggggcccttcaggccagctccagaattgagctttcattcctggagccacattggagtgagacggattgatgctgggttggatgtggcctccacactggcctcctcttttcctgacttccatgtcccttgtgggcctagagtttcctaggtctggcttagagtttcttccatgttcctcatgaacctggggtttttaagggtctggctcaaagtcttccacacaaaaagtttctcagttcatggaggacgactctaatgggaatcaattgcatcagtgttttcttataaacactgtcatgttttaatgactgggcagttgtgatagttttggaatcgtaaattttgagtatatccacgatcaaggtaactcttgttctcccacttctaaaggacagctgcatgactcctgtaggatgagaaacaggcagctgtgtctggcttttacctggcaatctaggctctgtttcatgtcatctgcacttcctttctcattgtggatggggcttttcattgggctgttggtgggtgggactgcctttcatcgtggatgttttggttgccaggaatatcagagagcaaaaggtattttgggtaggctgcctgcacaccaggttgtgggtagtggtctcatagtggtggctggcattgtttgcactttgcaggaagcttttaagtcctgtggcaggaatccttgaacatggcttggactcctgcgcaagtctgctcattctcccaggaaagccttgatttttctttgctttcatggggggtccacagtgcccatcaatggcactcctggacgttattttcaggtttcaaattgccccagacagcctctgagacactctctcaacctcaagtgcacccgtgagaggcctgttagaggtgtgagaacactgctccaccttgaacttgcttttgtcatggtttctgcctttcccagagagccgtgctgagaagcaggagcccctgtgaggcccgggatgaaggaaggcatggggttcaagggcctggctgttttccactgacaccttcctcttggatctcagatatcccatcacctagagacctcttaacaactcaccagacattattcccatcctcaggagacccaattcatgcacacatccttttttgggaatggagtcaggagagcagtctccagagcccacctcacagtcttcaaactcctccttctcctgtgggaccctaccacagagatggatcataaaggccctatgttcgagactattagcgtgctgcagttggttgctgcaggcagcctttttctggcgactaggccggttctggctgtaccattttcctgagctttggcaggcttacagccctgacagccaggtgcctgagcctgcctggtgaatgcgcatgtgacagccaggtcaccaggcaccagtggtgagcagtggctcacgtcacagtgaatgccaccgttgcctggtgacaagtcccttcatcttggcagagaaggaatcctctgtggatgtgtgtcagtgttggactctcacctgtctactctgagggctctatgggatattcccacaatccttggagtgggcagtggtgagccagcctgaagaaacatcaagtggagccccaggaataaaccacgaaatccctaaggatccaaaaggatacccatgatgagtcaggcctgcctagacggtgtgggggtgagtctttttgaaacttcctccttgtgatttctaggtacagcccacctctgtttcctggagctgctttctctcagaaggggctttctgcagaaccacgcagcctcaggagctgccaggctgtgtgtttctgtggaattgttgcgagtgttcggatgtctgcatgtgtgtgtggctgtgtgtgagtgtgtttgtgtgtgtctgtgtgtgtgtgtaagtggcatctgctaaaaggaatgtgactaacgcaccgcagcactttcttttttttgagtcccttcaccttctggtgcacctgtctgtgtggctctgcttggcctatggggctgcatgttctttgtttttccatggttcctgagtccacagtgagttgggggggggggatggctgagacccacaggtgtacaaatcacctccccatacaaaggagccactcttctagaaaaaagaggagcacatcactgtcaggaacagacacctgtcagggcctcattttcctttggccaacccagagtgggaccctagcagtcctgtctgcaggccccttgaatccaattcaaattcagtttgcagctgagcaggtgcttcacatcatgaagggagcactcctccaacatcttgggatttcattctagaactaagagtgtgagcagcaataaggtcagataggggtgagcatacaatctgctccttcatctgcaaaaaaaggtgcagacagatgacacaggaagtgcttccaactccatccttgcattcccttcattgcacaagctgtccacaacgtggccctgtggccaggtgggaggactccaacttgcagggaataaaaaataaggtttaactgatacaaaaagtttatctctgtaagatgaatccacacatcacaaatcatttgcaaagatagcttctttctagtttttatgccaggatattaggtttttcactgtagtctacaataggctccgaaaagtcccttcatagattctacaaaaaaggtattttcatcctgttgaattaaaacaaaggtttaactctgtgagataaatccacacttcacaaagcattttcacagatagatagtttttagtttttatcgtgaaatatttggtgttttactttagtcctcaatgttcacaaaaatatcttttctgtgtatgctacctaaagagttttgtcaacctactgaatgataataaaggtttaactttgtgagatgaatccacacatcacaaagtattttcactaatagatcattgctggtgtctatcgtgggatattcagcttttcaatatacttgtcagtgggctccaaaatgtccttttgtagattctttaaaaagagtgtttccaatgtgctgaatcaatataaaggtttacctctgtgagatgaatccacacaccaccaagtgttatcaaatattgcttgtttctagtttttatcttgaaatattcattttttcactatcagcctcagtgagctccaaagtatcccttcataggttgtacaaaaagagtgttgccaacctgctgaatcaaaacaaaagtttaagtttgagttcgtgagacaaatccacacatcagaaagcattttcacagatagcttgctgctagttttaatcactggtattaggtttttcagtatatccctcaatgtactttgaaacgtccctttgtagattctattaaaagaatgttttcagcctgctgaatccaaacaaaggtttaactctgtaagatgaacccacatatggcaaagcatttacacagatagcttgtttctagtttttatcagagaatattcaatttttcatggtaggcctcaatgggctctgaaatattcctttgtagattctacaaaaagagctattccaacctactgaatcaaaaaaaattatctctgatagatgaattcacacatcacaaaatattttcacagatattttgtttctagtttttatcacaggatattaggtttttctctataggcctcagtggtctctgaaatgttcctttatagattctacaaaaagagtgtttccaacctactgattcaaaacaaaagtttaactccatgagacgaatccacatatcgcaaagcattttcacagataacttgtttcaagtttttatgatggggtattttgttttccactgcaggcctcaattgacttcaaaatatccctttgaatgttctcaaaaagagcgtttttgacttgctgtaacaaaacaaaggtttaactttgtgagataaatccacacattggaaagtattttcacagatagcttgtttcctgtttttacagcagaatattcaattttacaaatataggtctctatgggctgcaaaaggccgcttcatagattctacaagagttttcccaacttctgaatcaaaacaattttaactctgtcagttgaatccacacagcacaaaggattttcactgatagatttttctagattttatcaaggaatatttggtttttttattatagttctcaataggccctgaaatatcttttaacacatttcacaattagactgtctgcaacctgctgaataaaaacagaggtttaactctgggagatacatccatacatcaaagcattttcacagatagtttatttccagtttttattgtgagacattcgattttttaaaaaaggcctcaatggtctccaaaatatcccttagtagattctccataaatagtgctttcaaactgctaaaccaaagcaaagctttaaccttgtgatatgaatccactcattgcaaagcattttcacataaaactttttctatttttcatcatgggacatttgcatttttactacaggcctcaatgggctccaaagtgtctcttcataggttctacaaaaaaaggtgtctccaacctgccttccatagattttccagaaacagtgttttcaacccgctgaatcaaaacaaagatttaactctgtgtgatgaatccagacatcagaaagcattttcacagatagcttgtttatagttttaatcacaggatattcactttttcactataagcctaaataagctttgaaatatccctttgaagattctataagaagaatgtttccaacctgctgaattgaaacaatggtttacctgtgggagatgaattcacacatcacaaagaattttcacagatatcttgtttctactttttatcatgggatattcagttttccactgtaggcctcactgggctttgtagtattccttcatagattctacaaaatggatgttcccaacttgctgaatcaaaataggtttatctccgtgagataaatccacacatcacaaagcattttcacagataccttgtatctagtttttatcacaggacatttggtttttccctacaggcctcgatgggccctaagtggtcccttcgtagattctacaaaaaggaatgtttccaacctactgaatcaaaacaaagtttaaccctgtaaaacgaatccacacattgcaaagcattttcacagataccttgtttctagtttttatcagaggacattcaactttttctaacaggcctcaatgggatcaaattgtccaatcatagatcctacaaaaagagtgtttccaaactactgaatcaaaaccaagtttaactctgtgaaatgaatccatacatcgccaagcattttcacagatagcttgtttccagtttcaattgtgggatatttggtttatcgctatagtcctcaaagttctctgaaatgccccttcatagattgaacaaaaaagtgtttccaacttgctgagtcaaaataaagtttaaactctgtgatatgaatccacacatggcaaagcattttaacacatatcttgtttctagtttttattgcatgatatttggtttttctgtatagacctcaataggctttaaaatgtctcttcatagattctacaaaagtgtttctaacctgctaaatgaaaacaaattttaactctgaaatgaatgaacacatcacaaaacattttcacagataggttgtttctagtttttatcatggggtattcgggttttcactataggcctcaatatgattttaaatgtccctttctagatgctacaataagagtgtttccaagctacagaattaaaaaaaaaggtttttctctgagagatgaatccacacattgaatagcattttcacagatcgcttgtttctcatttttatcacaggacattcgctttctcactataggcctcaatgggcttcaaaatatttcttcctagatcctaccaaaagagtgtttccaacctgctgaatcaaaaaaatggtttaacactgagatgagtccacagatcacaaatcatcacagatagcttgtttctattttttattgtggaatatttagtttttcattatgtaactcaattggctttgaaatgttcctttgtagatcctaagaaagtagtgtttctaacctgatgaatcaaaacaaaggtttaactctgtgtgatgaatccacacattacaaaggattttcccaaggagcttgtttctagtttttatcatggaatattatgtttttcactataggcctcaataagctctgaaatgtccttttgtagattctacaaaaagagtgtttccaacatgcagaattcaaacaaagggttaactctgtaaaatgaattcaaacatcacaaaacatttttatggatagcttgtttctagttctaatcacaggatattcaacatttcactataggcctcaatggtctccaaaatgtttcttcatagattttttacaaaaagagagtttccagactgctgtgcaatacaaaggtttaactctgtgagatgaatcctcacattgcaaagcatattcacagatagcttatttctgtttttatcacgggatctttgatttttcagtataggcctcaatgggcttagaaatgtcacattgtagattctacaaaacagtgtttccaacatgctgaatcaaaacaaaggtttaactttgtaaaatgaatgaacacatcacaaagcattttcacaaatagcttgtttctagtttttaattgcaggatatttggttttcctctgtacgcctcaatgggatctgaaatgtctctttgaagatggtaccaaaagagtggttccaacctgctgaaacaaaaaaaaaaggttgaactctgttacatgaatccacaattgcaaagcattttcacatacaacttgtttctagtttttaccatgggatatttggttttccactgtaggcctcaatgggctctgaaatgtcccttcacaggttctacaaaaagagtgtttctaacctgttgataaaaaaaagatttatctctttcagataagtctacacgtcaaaaagcattttcacaggtagcttgtttccagtttttatcatgtgacattttgtttttcactatagacctcaaagggatcagaaatgtctcttttacattccactaaaagagtgtttcaaacctgcagtacaaaaaaaaaggtttaactctgtgaggtaaatccacataatgcaaagcattttcacatataacttgtttctagtttttatcctgggatattctgtttttgtccctaggcctcaatgggctttgaaacatccctttgtggataatgcaaaaagagtgtttccaccttgctgaataaaaaaaaaaaaaagtttaagtctttgagatgaatcaatacatggcaaatctaattcacagatagcttgtttctagtttttttgagggttgttcatttttcactataggcatcaatgggatctgaaatgtcccttcggagattctacaaaaagagtgtttccaagctgctgaattgaaacaaagttttaacttttgaagatagaaccacacatcacaatgcattttcacaaatagctggtttctagtttttatcatgggatattggttttcactacatgccaaaatgggctccaaattgacctctcatagattctacaagcagagagtttccaaactgctgacgcaatacaaaggtttaactttgtaagataaatctacaaattgcaaagcatttttacagatactttgtttctagcttttatcacagtatattctgtttttcactacaggcctcaatttgctctgaaatgtcctgccgtatattctacaataagaatgtttccaacctcctgaataaaaagaaagatttaactctatgagatgaaatcatgcatctcaaagcatttttagagatagcttctttatagtttttattaggattttaggtttttcactatcagcctcaatgggctttgaaatatctcctcatcaattgtacaaaaagagagtttccaacctgctgaatcaaaagaaaggtttaatattgtgaaacaaatccacaaattgcaaagcgtttttacagattacttgtttctagtttttatcacgggatatttggtttttcactataggcctcagggggataagaaatgtcccctcgttgattctgcaaaatgaatgtttccaacctgctaagattccaacctgctgaatcaaaactaacattcaactctgtgagatgaatccacacattgcaaagcattttcgcagatagctagtttctagtttttatcatgggatattcagttttttactacaggcctcattgggtttgaaatgtccccttgcagattctagaaaaatagtgtctcccacctgctaagtcaaaataaaggttaaactctgtgagatgaaaccacacattgccaaacatttttacagatagcttgttctagtttttatcatggcatatgtggtttttcactataggcctcaatgagctcaaaattgtcccttcctttattctacaaaaggaatgtttccaacctgcccagtcaaaacaaggtgtaactctgtgagatgaatctacacattgcaaaacattttcacacatagcttgtttctagtttttatcctgggatatttggtttttagtacaggtctctatgggctccgaaatgtcccttcatagatattacaaaaagagtattttcaaccttctgaactaaaacaagggtttaactctgcaagatgaatccacacatctcaaagcattttcacagataatttgttgtcagtttttatgagggatttttttttataataggcctcaaggactcagaaatttcttattttagattctactaaaacagtgttctcaacctgctgtatacaaacataggtataactctgtgagataaaaccacacatcacaaacattttcacagatagcttgtttctagcttttatcacaagatattcagtttttttcactacaggcctcaatgggctctgaaatgttccttcatagattctacaaaagagtgtttgaaacctgcagaatcaaaataaaagtttaactctgtgagatgaatccacacatcacagagcatttttgctaataatttgtttctagtttctatggtgggatattttgtttatcaatataatcacacatgggcttcaaaatgtcccctcatagagtcttaaaaaagactatttccaatctgctaagtcaaaacatatgtttaactctgagggataacccacatatcacaaagcattttcacagatagattgtttctagtttgtatcgtggaatattgggtttttgactatgggcttcaatggactctaaaccatcctctcttaaattctacaaaaagagtgtttccaacctgctgtatataaacaagagtttaactctgtgagatgaattcagactcaaagcatttttatggatagcttgtttctgtttccattgtgaaatatttcatttttcactataagccttaatgggctccaaaatatcccttcgtaaattctaaaaaaagagtgtttcacaactgcagaatcaaaacaaaggtttaactctgtgagacgaatccacccattccaaagcatttttactaataattcgttgctagtttctataatgggaaattcagcttatcaatgtactcgtccatgggcttcaaaatcgccattcatagactctttaaaaagagtgtttccaatgtgctgaatcaaaacaaatgtttaaatctgagagatgatttgcatattgcaaagcatttcacagatagcttgattctagtttttatcagggaatattcagtttttcaccataagcctcaatggtctttgaaatgtcccttcttagattctactaaaagtgtgtttccaacctgttgaatagaaacaaaaatttaactatatgagatgattctatatgtcacaaagcattttaccacatagcttgtttctagtttttattgtgggatattgtttttcactgctggccccaaagggctctgaaatgtccctttgtatattcctcaaagtgagtgattccaaactgctgaagttaaaaaaaaaaaaagtttgttgtgcttttttttgttgttttttttgagatggagtctctctctgtcacccaggctggagtgcagcagcgtgatctcggctcactgcaagctccacctcctgggtccatgccattctcctgcctcagcctcccgtgtagctgggactataggcgccggccaccaggcctggctaattttttgtatttttagtagagacagggtttcaccgtgttagccaggatagtctcgatcacctgacttcatgatctgcctgccttggcctcccaaagtgctgggactacaggcatgagccactgcacccagcaaaataaggttttactatgtgagatgaatccacacatcacacagcattttcagaagtaaatttttaattgtttttatcatgaaatattcgttttttttactatagactttcataggtatgaaatgtcgtgtgttctagaaaaaaaggattcccaacctgctgaataaacacaagggtttaactttgtgagatcaatccacacattgcaaagaatttttactgatagcttttctctagtttttatcacgggataatcagtttttcagtacaggtctcaatttgctttgaaatgtcctctagtacattgtagaaaaagagtgtttccaacctgctgaatgacaagatagtttaaactgtgtgagataaaattacatattgcaaagcatgttcagacatagcttctttgtagtttttgtgttttttttcccccgtgggacatttggtttttcactgtatgcctcaatgggctctgaaacgccccctcatagattgtacaaaaagattgtattaaacatgcagaatcaaaagaaaggtataactctgtgagataaatccacacatagcagagcattttcacagataggttgtttctagtttttatcatggaatattctgtttttcactacatgccttaacgggcttcaaaatgttgcttcatagattctataaaataagagtttacagcctgctgaatcagaatgaaggtttaactctggaggtgaatctgcacattgtaaagcattttcacagagagctttcttctttcttttttagtgaggaatatttggttattcattgttggcctcaatgggctccaaaatgtcctatcatagattccacaaaattaatgtttctgacctacttaagcaaaaaaaaagtcttaactctgtgacatgaatccacacatcacaaagcattttcacaagtagcttgtttgtagtttttatcacgggatatttggttttacactatagacttcaatgggcttcaaaatgtcttttcttagattttacaaaaaagtgtttcctacctggaatcaaagcaaaagtttatctctgcgaggtgaattgacacattgcaaagtattttcacaaatagcttatttctagtttttatcatgaaaaatttgattttttactattggcttcaatgggccctgaaatgtccctttgtagattctacaaagagagtttttccaacctgctgaatcaaaacaaaagtttaactctatgagatgaatccacacattgcaaagcatttttagagattgctttttcattgttttcatcgcgaaacattcgttttttactgtaggcgtcaattcgtgtgaaatgtcccattgcatattctacaaaaaaagtgtaccaaacttgctgaataaaaacaaaggtttaactttgtgagatgaatccacacattgcaaagcattttcacagatagcttgttactagtttctatcttgcaatatttgttttttaaatataggcctccatgggctccaaaatgtccctttgtagattctacaaactgagtgtttacaacctgctgaaccaaaacaagggttcaactctgtgagatgaatccatatatcacaaagcatttttacagatagtttgttttcagtttttattgggggatattttgtttttcattataggcctcaaaggtctcagaaatatcttcttttagattctactaagagagtgttagcaaactgctgtatataaacataggtttaagtctttgaggtaaatacacacattgcaaacattttcagatatagcttatttctagattttgtcacaagatatttggtttttcactagaggcgtcaatgggttcagaaatgttccctcatagattatacaaaaagtgtgtctccagtctgctgaatcaaaaaaaaaaaaaaggtttagctctgtgagataaatccacacattgcaagctaatgcataatgcagagatagtttttttctagttttatcacaggatattggtttttcactataggcctcaatgggctcagaaacgttcctttgttgattctacaaaaaatgtgtttccaaccaactgaatcaaaacaaaagtttaactctgcaagatcaactcacacatcacaaagcattttcacagatagcttgtttctagtttttatcaagagatactcgatttttttttattgtagacttcagtgtgctctgaaatgtcctttcatagattctacaaaaacagtgttttcaacctgctgaattaaaatgaaagttaaactctgtaagatgaaatcatacatcaaaaagcattttcacaaatagattgtttctggtttttattgtgggatatttggtttttcaatataagcatcaatgggcttcgaaatgttccttcttaaattttacaaagagactgttttcaacttcctgaataaaaacagtggataaatctgtgagatgaatccacacattacaaagcattttcacaggtaattattttttagtttttctcatggaatattgtgtttttcaatataggcttcaatggactctaaaatgtcctctcttaaattttacagaaacagtgtttgcaatgtgctgtatataaacaaaagttttcctctgtgagataaatctacacacacaaagcattttcacagataccttgtttctagttttcatcataaaatatttgatttttcactataggcctcagtgggctccaaaatgtcccttcatagattctacaaaaaaagtatttccatccttctgaatcaaaactaaggttttactctctgtgatgaatttacacattgcaaagcattttcatagatagcttgtttctagtttttattgtgggatatttggttttttattataggcctaaaagggctcagaaatttcttcttttagattctactaaaagagtgtttccaaattgcactataaaaaccaagtttacttctgtgcaataaatcaacatatcacaaagaatattcacagatagcttgtttctagtttttatcacaggatattgtgtttttcactaaagcctcaatgggctttgaaatgtccctctgtagattttataaaaagagtgtttttaacctgctgaatcaaaacaacgtttaactttttgagatgaatccacacattgcaaagcgttttcacagatagattgtttctagtttttattgcaggatattgttttttcactcaggccaatatgggcttcgaattatcccctcgtagattagattatacaaacatcgagtttccaagatgctgaagcaaaacaaaggcttaactttgtaagatgaatctacatattgcaaagcatattttacagatagcttgtttctagtttttattgctggatatttggtttttcactgtaggcttcaatttactctgaaatatcctatcaaatattctacaaaaagagggtttccaacctactgaaccaaaaaaaaaagtttaattctgtgagactaaatcacacatcgcaaagcattttcagagacagctttataaagatttattgcaggatatttggtttgtcgctataagcctcaatgttccttgaaatgtctcttcatcgattgtgcaaaaacagtttccaactttttactgtaggcctcagtgggctcagaaatgactctcaaagattctacaaaaagaatacttctaacctgctgaatcaaaacaaaagtttaactctttggggcaaatccatatatcaggaagccttttcacagatagcttctttcaagattttatcgtgaaatattcgtttttttctatagacctcactgggctcagaattgacccctcttagattctactaaaagagtgtttccaaaatgctgtataaaaataaagttttaactctgtatgatgaatctacacatcacaaagcattttcagatatagctcgcttctagtttttatcacgggatattctgtttttcactataggcctcaaagggctccaaaatgtccctttgtagattctgcaaaatgagggtttttaacctgctgaacataaacagaggtttacctctgtgagataaatccacacatcacaaaacatgttcaaaggtagttttttatctagtttttatcacatgatattcagtttttcactataggcctaatgggctctgaaatttccctttttagattctacagagtgtttacaacctgctgaatcaaaacaaggttttaactatgtgagatgaatccatacatctaaagcgttttcacaaattgtttgtttttatagggggatagtcagttttttactacaggccacaaaaagctcagaaatgtcttcttttagattctaccagaagagtgtttccaacctgctgtatataaatataggtttagctctgtgaaataaatccacacattgcaaacattttcacagatagcttgtttctagtttttatcacgggatatttggtttttcaccataagcctcaataggctcctaaatgtccctttgtagattctacaaaatgtttccaacttgctcgattaaaaaaaaaaaaggtttaactctgtgagatgtatccacacatcaaaaatctttttcacagatagagtatttctagtttttattgtgtgatattctgtttttcattaaaggtctcattgagctccaaaaaatccctatgtagattctacaaaaagagtgtttccagactgctgaatcaaaacaaaggtttaattctaagagatcattccaaacattgcaagacacttttacaaataggttgtttctaggttttatcatgggatatttaattttttaatataggcctcaatgggctccaaaatgtacctttgtagattctacaaaaagagtgttttcaactggctgaatccaaacaaaggtttaacactgtgagagaaatgcacacatcgcaaagtattttaattggtagcttgtttctagctttatttcaggataatcagtttttgactacaggcctcaatgggcttcaaaatgtcccctcttatattctacaaaaagagtgctttaaacctgcttaatcaaagcaaaggtttaattctgtgagatgaatccaaacattgcaaagcattttcacttatatcttatttctagtatttaatgcaggatattttgtttctcactatagacctcaataagctctgaaatgtcccctcatagattctacaaaaagagttctttcaacctgctgaataaaaacaaaggtttaactctgtaaaatgaaatgacacgttgtaaagcattttcacagatagcttggttctaatttttgtcgtgggatattcagtttttcaccacaggccacagtgggctccaaaatatccatttgtagactctacaaaaggaattattttggcctcttgaatcaaaacaaaggtttaactctgacagatgaatccatacattgcaaagaattttcacagacagctttttctagttatcatcacaggacattctgttttttcatacacttcttcatgggctctgaaatgtcccttagtagattctacaaaaagagtgttttcaacatgctgaatcaaaatgaatgcttaactctgtgagttgaatccacacatcacaaagcattctcttatatggctggtttctggtttttatctcgagatataaggtttttaaatgtaggcctcaacgttctctgaaatgtgtcctcttagattctacaaaaacagtgtttccaacctgctgaatcaaaacaaagttttaactccatgagatgaattgacacatcacaaagcattttcacagataacttttctagtttttgtcaagtgatattcggtttttcactagtggcctttgtggtctccaaaatgtcccttcatagagtctacaaaaagaatatttccaactggctgaatgaaaacaaaagttcatacatgtgagatacatccacatattgcaaagcattttcacaaataacttgttcctagtttttatcatgggaaatttggtttttcactatagacctcaataggctccaaaatgtccccttgtagattgcacaaaaagtgttttcaacatgctaaatcaaaacaaaggttttaatctgtgatatgaatccatacatcacaaagcatttccatacatcacaaagcatttccacaatcaaaacaaaggtttaactctgtgagatgaatccacatgctgcaaagtatttttgcagatagcttttttctattttatgtcatgggatatttggcttttcgctgtgctggtccgtgagctccaaaatgtccctttgtagattctacaaaaagagtctttaatctgctcaatcaaaacaaatgtttaactctgagagatgaatacacccatcacatatcattttcaccgatagcttgtttctagttttatcacaggatattcagtttttcactgtaggcctcaattggctacaaaatttcccttcgtagattctacaaaaagtgtgattctggcctgctaaatcaaaacaaaggtttaactctgtgagatgaatcctcacattgcaaagcattttcgcagatagcttgtttctagtttttgtcacacgacatttggtttttcactatatatctcaattttctccaaaatgtcccctcatagagtctataaaaagagtgtttccaattttctgaatcatgataaaggattaactctgtgagatgaatatacacatggcaaagaatttttacagatagattgtttctagtttttttgttgggatatttggattttcactgtaggcctcaatggcctctgaaacgtccccacctagatggtacaaaaggactgcatccaatgtgctgaataaaaataaaggtttatctctatcagaagaatccaaacattaaaaagcattttcacagatagcttgtttctagcttttatcatgggatattcagtttttcactaatggccctaatgggctctgaaatgtcccttcttagatcctccaaagacagtgtttccaacatgcttaatcaaaacaaaggtttaattctttgagatggatccagacatcacaaagcattttcagagatagattttttattgtttttatcacaaaatattcatttttttactataggcatcaatgggtgtgaaatgtccttttgtatattctataaaaaagtgtctttaacctgctaaataaatacaaggtttaattctgtgagataaatccacacattgcaaaacatttaaaaagatagctcgtttttactttttattgcagtatatttggtatttcactatgggcctcaatgggcttcaaaatgttactttgtagattttacaaaaagagagtttccaacctgctgaatcaagacaaaggattaactctgttagatgaattcacacattgcaaagaatttttactgatagcttgtttctggtgtttatcgtgggataatcagttgttcatcaacctgctgaatcacaagaaagtgtaactctgtgagatgaaatcacactttgcaaataattttcagaaacagctactttgtagtttttatcatgggaaattcaaattttcactgttagtctcaatgggctttgaaatgtcattttgtagattgtacaaaaagagtgtatccaatctgctgaatcaaaacaaaggtttaattctgtgagataaatccacacattgcaaagcatattcacagctaggttgcttttagtttttattgtgggatattggggttttcactataggcctcaatgggccctgaaatgtttcttcgtagattctacataaaaagtgttttaaacctgctgaatcagaagaaaggtttaactctgtgagatgaataaacacattgcaaagcatttttacagatagcctgcctccagtttttgccatgggatatttggtttttccatataggctgcaatggactccaaaatattactttgtagactctgcaaactgctgaattaaaacaaaggtttaactctgtgaaattgaatccacacatcacaaagcattttcacagatagtttacttcggtttcttactgtaggcctcagaggtttgaaatgtcttttctttgtttctacgaaaagtgtgtttccaacctgtggaatcatagtaaatgttaaactctgtgaaatgaattccagacattgccaagcattttcacagatagctggattctagtttttattgagggatattcgtttttttactatagacctcaaagggctcagaaatgcccatttgtagattttacaaaaagagtgtttcaaatttcctgaatcaaaacaaaggcttaactctatgagatgaatctacacatctcaaagcattttcacagagagcttgtttctactttttattatatatattatatatatttatacttggtttctcactgtaggcctcaatgggctccaaaatgtttcttcgttgactctacagaaacatggtttccactctgctaaatcagaaaaaaggtttaactctgtgagctaaatccacacatcactaagcattttcacaggtgccttgcttctagtttttattacaggatattttgtttttcaccctaagtctaaatgggctccaaaatgtcccttcttagattctacaaatacattgtttccaacctgctgaatcaaaacaaaggtttaactttgtaaggtgaatccacacatggcaatgcattttcagagttagattttttattgcttctatcatgaaatatttggttcattactataggtgtcaatggctgttaaatgtcccttcatataacctataaaacaagtgttcataattggctgaataaatacaaagttttaactctgtgagatgaaatcatacattgcaaagcattttcagacatagtttctttttagtttttatcgacgaacattcattttttcactataggcctcaatgggctcagaaatgtaccttcacagattgtacaaagtgtatccacttgtggaatcaaagcaaaggtttagttctgtcagataaatcctaacatcacaaagccttttcacagatagtttgcttgtaatttttatcgtcggatattctgtattttactgtaggcctcaatgggctctgaaatgttttctcctagattctacgaaaaaaagtgtttccaactctgtaagatgcatctcacattacaaagcattttcacagaaaacttgcttctagtttttgctgcaaatattcagtttttcactataggcctcaatgggctctgaagtgtccctttgttgattctacaaaaagactgtttatgaagtgctgaattaaaacaaaggtttaaccctgtgaggtgaatccgcacatcacaaagcattttcacaggaagcttgtttgtactttttatcgtgggatatttggtttttcactataggcctcattgggcttcaaaaagtattttattagattctatgaaaaacatgtttccaacctgctaaatggaaacaaaggtttcactctgtgagataaatacacacattgcaaagcattttcacagatagctttttttctagtttttatcatgggataatcgatttttcactataggcctcaatgggctttgaaaaggccctttgtagattctacaattaaagtgttttcaacctgttgaaacaaaacaaaggtttaactctatgagataaatccacacattacaaagcttttcactgattgataggttttttctaggttctatcgtgggatatatagtttttctttttctttttcttttttttttcaggggacggagttttgctcttgttgcccaggctggtgtgcaatggtgctatctctggctcactgcaagctcctcctccccagttcaagccattctcctgcctcagcctcccgagtagctgggattacaggcatgtgccaccacacccggctaattttgtatttttagcagagatggggtttttccacattggtcagggtggtcttgaactcccaacctcaggtgatccgccctcctaggcctcccaaagtgctgggattacaggcatgagccaccatgcatggcgggatatagagtttttcactgaatgcctcaatgggcttcaaaatgtcccttcattgattctacaaaaagagtgtttccaacgtgctaaatcaaaacaaacaaacaaacaaaaaaaactttaactctctgagatgaatccacacatcacaaagcattttcactgatagcttgtttctagtttgtactgggaatatttggtttttcactatagaactcaatgggctccaaaattttcttttgtagattgtaaaaaaggagtgtttccaacttattgaagcaaaagaaagatttcactctgtgagattagcccacatatcgtaaagcattttcacagatagcttgcttctagtttttaccaccagatattctgtttttcactctaggcctccatgggctccaaagtgtccccttgtagattctacagaaagagtgtttccaaactgctgaattgaaacaaatgtttgactgtgtgacataattttacacatcccaaagcattttcatggatagcttgtttgtagtttttattgcaggatattcagtttttcactatagacctcaatgtgttttgaaatgtcccttcttagaatctacaaaaaatgtgcttccaaatagctgaatcaaaacaaggttttaactctgtgagataaatcaacatgcagtaaagccatttgacagatagctttcattaagtttttattgtgggatattctgcttttctctataggcaccaatgggctttgaaacgtcccttcataggttctacaaaaaaaaaagtgtttacaggctgctgaatcaaaacaaagatttagctttgtgtgattaatccagatatcacaaagcatctcactgatagtttgtttctagtttttatcgcaggataatttgttttccactatagtctcaattggcttctgaatcaccctggtagattctagaaaaagagtgcttccaaacagctgaatcacaagaaaggtttaacactgtgaaatgaaaccacaaatcggaaagcattttcagtgatggcttctttgtagtttttatcacgggatattcggtgttacactataggcctcaaagaattttaaatgtcccttcattgattgtacaaaaagagtgtatccatccttctgaatcaaaacaagcgtttaactctgtataacaaatccacacaccctaaagaattttcaccttatcccccagcaaggaaactcttgttctcccagcttctatcggagggctgcatgattcctgtaggatgagaaacaggcagccatgtctggcttttacctggtaatctaggctgtttcctttcatctgcccatcctctctcattgtagagggggtctttcactgggctgttgctgggtgggactgcctctcactggggatcttttgtctgtcacggatttcagagagcaaaagggatttcaggtaggctggctgcgctccaagttgtggatagcgatctcattgagggggttgggttagtttgcactttgcaggagacttttgggtcttctgacaggaatccttgaacatggcttggactccagcacaaatccgcttgttctcccaggcaagcgttgatttttctttgctttcatggtgggtccacagtgcccctcaacagcactcctagacaccattttcaggcttgcaattgccctaaacggcctctgagacaccctctcaacgtcatctgcacccgtgagatgctagttcgaggtttgagaacactgcctcacctcggacttgcctttgtcatggttcctgccttctagagtgccctgctgagaagcaggagcccctgcaaggcccagaatgaagggacgtagtgagctcaagggcccggccatcttccactgacccccgcctctggggtctcaggtatgattccatcacgtggacacccgtcaacaactcaccggactgtattttcattcccatgcgaccggattcttgcacacagcctctttctggaacagagtcagaagagcaatttccagcacccacctcacagtttcgaaacgcctcctcctccagcgggacccgacctcagagacgtgccgaggaggccttattgtcgagacatttagggtcccgcagtgggttgtcgcgggcagcattttcccgagaccaggtgcgctctgcctgcaccattttcctctgcttaggtaggctgacagcactgacaacccggcgcccaagactgcttcacgaatgcgaatgcgtcagtctctaggcaccaggcgccagtggtgagcaatggctcgcgtcacagtggccaccgttgcctggagacaactccctgcggcttggtggaggagacctctgtggacatgcattggtgttggactctcgcctgtgctctctgggggatccacgggatagtcccccgattctaggaactggcagggggaagcaagcctaaagaaacatctagtgaagcttcaggtataaatcgcgtaatttctaaggatccaaaaggaactgcaggatgcgccaagcatgcctagtggtctccttgaggggtctggggtggtttgcagtttgcgggaggcatctgggtcctctagctggaatccttgaacgtggcttggagtcaagcacaagtccgctcgttctcccaggcgggccttgatttttctttgattttatgggggttccacagtgccaatgaacagaacttgtggacacccttttcaggcttgcaattgccccagtgggcctctgagacactctctcaaccttatctgaacccgtgagaggccagttcgaagtgtgagaacactgctccaccttggagttgcctttgtcttggttcctgccttctcagagagccgtgctgagaacaggagtccctgcgaggcccgggatgaagatcttctctctggatccggaagaatcataatatttatcaactctgtaaactctcgggaaagcacttgtgctagcaaggtaacctggcctttgtgaattcatgcactagtctccatttctgggaagagcttcagcaccagcagcacataccactgtgagggcaagtgaaaaagtatcactttgggtagatggatataatcctcccgtaaagcttcatttgcaagaaaaccactatcacccttttccacctgtggaataaagatccttcttacatgtccaagatcacctgtgtttaacatatttatgttggctccccagtcatctccgtcttgttcacaggcagtatttgggattgagattcgagatgtaaaagtaatactagattttgtatccctgtgacccaaagacattgaatgaatatacctcaagccctggctaccttgcaaaaggagagccttcaactctgcttctttaaagtaatttatgattctgcagttttcattcacttcagtatcagctaaatttccaccatgacaatattcatcctgtgtaagcataggaccatcttctgcccagacagagaaatacggaactgcatgaggaagccgtccaggcactgcagtagagcctgtgctcctctcagagttctttgctcactgcagagtcggcttaaggctttcctgatcacctaatgtggtgcatgcacccatgctgcctcttcacacagtaaacacagaaccaaaacctccagagcaactttctgcagctcctgaaactgctgtgcgccttaacctcgctttgctctcagtcactgcagttctctcagcaggccacgtttcatctcccagctcctgagcactggcttccatgtcttcactacaacaatcatccccatacccccaacagaatccggagtgaaagaatccggagtgaaaggatccgaattcacttgaagtctgttgcacatccaattcccatttcctgatttttctgtatcacgaagaagaacggtcccagagtttaacagggctgggatcaattcttccagctctggagagaaaaaccgggagtgcaagtggcgggtggcagaggcgaagcttgcaggagatccactgggacccccgggatccctcagcgcccagcagggccctccccgcccgggcccccacagtcctgcgaagcctccccccagtgcccccagcactcgccagaaccagtagcccaggaagcaggtgccgctggccaccaggagcccaagtaccctccccgcaccagtcacacagagacccgctgccaggccggtcagcgcagggcagggccccagaagctcctcaggctccagctccaggggctgctgggcctggcgggcaaggttccgctcacccccagaaaaggagacggagacccacaaggacctcagcttgtctggtgctggaggcctgggctgtcagaatgcctctccgccttccggcaggcgggagccgcatgcgccccctagtggccgcggccagaagctgtcacatcccatgggcgcaggcgcctcagccccgcaaggggcgggctggaggtgccactcccattcatagaccaggaatcagagccctgggctggaagagtctggtcaaaattcttccaaactgagtggggacagagaccaactcacccccagctgcagtgtatgcagtgtagacagatctggactttagccattcctgagcccccccttgcctcacccgtacatgcccggcccacctttcccttcctcgccaggaccccacatccctccctctgagtcgcttcctctctgaaacaaatagtggtgatagcgagtaacacatcagtaacaagaaactagcaggtgctcagtaaaatggtctaccctggcctcttccacagtcaagtgagcattaacaggaaaatgctcattggaagtggagagtcgccggcagcccctccgcctccctccggcttggccttcccgcagagcaaactggggcccagaaagggtgtgggcgaagaccctgtcacctcccagcagggggcgtgctgcccgcggttttcgggatcctgggcgtggagccatcctcacaggaccctcagaggtggagaggagaaagagcacactcatttgacaggtgcagagactgaggtccgtggggcaggggtgagcggcccagggcagccagacctgtgaacagtagagctaggattccagcaggtccccagccagtcactgggtgagcccctgttgtgtggggatcactgaggtgcaggcattctgataaccaccggcttgaggaactcatggtgctccatcctgaattctggggcgctttctaggatacaatatggtaaaggttgtgtaacatgtgtgaggtccagcatgtgcacgaagcaaacagggatagattggggtggtagtacagggacagaatcacagttgggacccttgagaaggcagttggaatttttctgccagagcaggagaaaccctctgggcacccaggctggcatgtgcaaaggcgtagaggcaagctccccctgacacacggctggaggggaagctctaagtgctgcgcacaggctgttcacactgcatccttctccctggacttgctccccccacagcacctccatccttccagttagctatccaggccaccaccctcaccctctcacacccacatcctgtgggccccacatttgagagacaagaattcagttgcttctcaccctccatgggtgctcatcacctggtctgagtccccatcctctctctccccatacttggtctctgcttccatccttgactcctgacgtctaattgcaactcaatactaggtcagatcatgtcacacttctgctctggtgcaagaattatgtggttccttcagttcagtgtccaccaggatttgatattcccaaggcacatctctcactcctttgttctcattttaccttcacacaggaaaacactttttcttcttgaagtgtgctgttatgtagctactcttggcgatgaaatctctgttattacttttgaaattattttaattgtctttatgccctaaagatatttagctatatattcaatgctagcttgaataataatttttctaagcatgcgttttgactttttaaaatttaagatgacattagatgattttattatgtacatcatgatgttttgaacattccacatatagattgttgaatggttaaatctaactattaacaaatgcattatctaagatcgttatcatttttgttgtgagaacacttatcatccactatcgttgcaattttctagaatgcaatatatcatcagtaactgtagccaccttgctatacaatagaattattgaaatttgtttttttctatccagttttaattatgtgccctctgaccaacatctccccatcctgttcccctctctaaccactccagcctctgctcatcgccattctgctctctacttctatgagaccaactagtttagatccctcatatgaatgagataatgcagtatttttctttctgcacttggattatttcacttaatatactgtcctccaggatcatccatgttgacagtaatgacagcattttattctgttgtatgactaactaaatatcattccattgtatctgtttatgtaatacatacataaatgtatgtatacaagcatatgtagatataccattcttcaaatatattattttgcatttatttttattaaaagtatatttctcccttatctaaatgctgataaaaatatgaggtattttcagtccttcctcttaataaaagccaaagttaaaggtctgtttccctgttttttaataagattctatttcttgctgatttttttgagttccctgcacattctgcatattactgcttaatcgtaagcatggtttggattttttttttcctttctgtataatgtctgtttcctctgtggtttatttgttttctttgccaaaactttttattagtttaattcggtcccatttatttatttttgtttttgttgcatttgcttttggggtatttgtcataaattatttatctaggccaacgtctggaagagtttttactaggcttttcttctagaattgttatggtttcaggtcttagatttaagtctctaatccacctggagttcatgtttggatatggtgagagatacaaacacagtttcattcttctacatctggccacccaattttcccagcaccttttattatgtatgtgtatgtttttgtctaatttgtcaaaggttgttattgtttggctgtatttgttagattctctattctgttacattgttgtatgtgtttatttttataccagcacaatgctgttttggttactgtatccttgtagaataaattgaagtcaaaggaaagacaaaggaaagttgttgtctttcctttattttgaaggagagttttagcaaatataagtgttcttaattagaattttttctttcaatactttgaatatgttatcccctttggccctggcctgaaagaagaatttgagaattgcgctgatagttatgtgatgagtagattttctcttgctgcttttaaaattcactttttctctttgacttttgacaactttattaaaatatgtcttggtgtaaggttcttcatgttcaatctacttaaggactcttgaacttcatgattctggatgtccacctcccacctcaaattcagcaaattctcagtcagtatttctcaaaataagctttctattctttcctctatttcaccttcttgtatccacataacgcatatattgctttatttgatgatgtttcataagtctcatagattttttttactctttatcttttgctatttttttttttgttttttgcacctctgtcaggataatttcaagatagctgtttcccactttgccatttcctcttcatgactgaacctgctgttaaaactctctattaaatttttcagtttagtcattatattcttcagcattaacatttctgtgtttatttttatcgcttctatttattactgtaacttctgattttctttatgtattgctttcctaattttgtttagttgtctatacttgttcccatatagttcactgagcttagtatctaaaataattacttccaatttttaaaagcacattgtcaattcctatttctttggggtctgctattgaagcttttttgctttacttaaattgtgtgatattttcctgattcttcatgattattgtggccttgtgctggtatacatatttttgagaaggtggtcactttttctagtctttacaggttggcttcagcaggaaaagttcttcaccattaagtgtggcctggtgttcttgttcggtcaggtggttgagcctgttgatggatttggctgactggcggtgcttcagggtcagaaatgtctgctggttttaatccctctgatttggtagctttgttgggtgaggccacttgaagcactgtggggcacattgagatttgcatgtaccagtcactgagtgtttcaccccatttctttggtgctagttatcttcatgtggtctaagtattaaaattcttccagcgtttgttttgaggcaaagcagaagtttgtccatcaggcagcactccccagatagacattgaatatccactttgatctacttttctcccactggaaaaataatgggctgagggtatacttctcagcacagtattgttctggatatggaagtggtaaagcaaacaaagtaaaatcattcctcttatcctttttaatgagtctgtctttgcttttgagctctttttgggttttgcaatctcacagtggtatttggagttctcacaaaagcattctttcctgtgggtagttgccaaatagatgtctctttgagggaaacagggctgggaacctactattccaccatcttaccagactccctctacatccaaccacttccatctctcaatctctcagtaatttgtaaaataggaaaatacaaacatgtctagaaatcattactaaaactaacagatgagttgagtgaagccacagtatataagccaaatgtgtaaaaaagtcaatgtgtatttttatagactggcagtgaaaatcaaaccttaccctgaaaaacctgaaggaaataccgaggaaaattaaagaatacctacataaatagagctatcatgttcacatgtcagaatattcaatataattaatatgtaaattttccccaaattaatacgcagcatcaacacaattcagtaaaatttcaacaaagggctttgtaaaatttgataaaccaattcttaaagtactttgaaaatataaataatctaaattagtgaaaacaataatgaaaaacagtcacatttagagacatatctgaaataaatactataaagctacagtattcacaacagtgtgttgttacttgaggaaataattataaataattgtaatgatataggaagctcagattatatatatatacacacacatataaacacacacatatatgtgtgtatatagatgtatatatttacacacatatataattttttattaaggaatgcatgaaggcaattcaaagggaagaatagaaatttacataaatattctcggagaagttgaatacccatatgtaaatatgtgaacattgattaatcaaagtacatctgaaaaattaacttcaaatgaatttgagatgtaagtgtaatagataaaagtatatattttgtatgaataaagcataggagaaatttattgtgaccctgggataggaaatggtttcttagatagcctacacatgcagaaaacataaaataaaatgtataaattgagtcttcatgagacactgttaaaaataaattgacaaccatagcctgagagaaatattgaaatacatatatttaataaatgttggtgttcagatttgtatatacataaatcatacagctccgttaaaagaaggcaaatgacctgacaaacattaatgggcaaggtccattagctgctgatgggtaaacacattgcggcgtgcccatatgatggactatttctcagcaataacaagtaagaaattaatgatatgtacaacttggatgatttcaaaggaattattatgaattaacagaagacactaaagactacataaatgttaaaatcgcaattatgtgaaatttttcaaaaggcaaatacagtagctaaaatataatagttttgtcatgggcatcatgtataaggagagaatttaatgaaaaggaccagattgagcttttcatggtcatgggaatgttctacaacatgtttgtggtagtgattatacagtcacatgcattttgaaatgaaaatgtataaaattttacaaattattcatttataattgatgaattttaaagaatgtaaattgaacctcaataaaattatttcaaattatgctatggaagaatgtgtgggacaattggagcatgctcaaaacatagtgaatgtctgcaatcatttagaaaaactgtattttagtatttatttaagccaaacagatgctctccctgtgactaagcaatgttcctgtaaatatatataccacagaaatgtatccttataatcatggcacctttctttataatggctaaaacagggaatgtatccaaatgtttgtcaacagtagaatgaataaattctaaaatatttggaaagaaagctctcaggacagggcagagtgggataacatattcaaagtattgaaagaaaaaattctaattaagaacacttatatttgctaaaactctccttcaaaataaaggaaagacaaaaacattcctttatctctcctttgacttcaatttatactgcaaggatacagtaacaaaaacagcattttgctggtataaaaataaacacatagttcaatggtacagaatggggaatctagatatatagccaaacaataacaacctttgacaaatcagacaaaaacaaacacatacataataaatggtgctggaaaattgggtggccacatgtagaagaatgaaactcaccatatccaaagattaactcctggtagattagagactaaatctaagacctgagacagtaaaattctagaagagaaacctaataaaaaactcacaataaatcacagaggaaacagacattatatagaatgtgaaataaattccaaactatacttacgattaagcagtaatatgcagactctgcagggaactcaaaaaaatcggcaagaaaaaagaatcattaaaaaatggggaaactgccctttaactttggcttttattaaaaggaaggcctgaaaagacctcaaatttttatcagtatttagataagggagatatattttaatgaaaataaatgcaaaataatatatttgaagaatggtatgtctacatatgcttgtatacatacatgtatgtacatacataaacacatacaatggaatgatacttagtcatacaacagaataaaatgctgtcgttactgtcaacatggatgatcctggaggatatattaagtgaaataagccaggcacagaaagaaaaatgctgcattatttcatgcatatgagggatctaaacaagttggtctcatagaagtagagagcagaatggtggttaccagaggctggagtggttagagaggggaacaggatggggagatgttggtcagaggtcacgtaattaaaattagatagataaagtaaatttcaagaaatctatcgtatagcaaagtggctacagttactggtgatatattgcattctagaaaattgcaacgatagtggatgtgttctcacaatgaaaatgataactatgttaaataatgcctctgttattagctagatttagatttaaccattcaacaatctatatgtggaatgttcaaaacatcatgctgtatgtaataaaaatcatccaatgtcatcttaaattttaagaagtcaaatagcatgcttagaaaaaatattattcaagctagcattgaatatatagctaactatctttcttggtaaggagtattaaaataacttcaaaagtaataacacagagatttcattaccaagagtagctacataagagtacacttcaagaagaaaaagtgtcttcctgtgtaaaggtaaaatgagaacaaaggagtgagagacataccttgggaatatcaaatcctggtggacactgaactgaaggaaccacataattcttgcaccagagcagaagtgtgacatgatctgacctagtattgagttgcaattagacgtcaggagtcaaggatggaagcagagaccaagtatggggagagaggggatggggactcagaccaggtgatgagcagccatggggtgggggggtgagaagcaactgaattcttgtttctcaaatgtggggcccacaggatgtgggtgtgagagggtgaggggggtggtctggatagctaactggaaggatggaggtgctgtggggggagcaagtccagggagaaggatgcagtgtgaacagcctgtgcgcagcacttagagcttcccctccagccgtgtgtcaggggaagcttgcctctatgcctttgcacgtgccagtctgggtgcccagaagacttctcctgccctggcagaaaaactccaactgccttctcaagggtcccaactgtgattctgtccctgtactcccacacctatctatccctctttgcttcgtgcacatgctggacctcacacatgttgcacagcctttactgtattgtgtcccagaaagcgccccagaattcaggatggagcgccatgagttcctcatgctggtggttatcagaatgcctgcacctcagtgatccccacacaacaggggctcaccctttgactggctgggggcctgttggactccttgctctactgttcacaggtctggccgccctaggccgctcacccctccccgacggacctcagtctctgcacctgttaaatgggtgtgctctttctcctccccacgtctgagggtcctatgcggagggcaccaggcccaggatcctgaaaaccgcgggcagtgcgccctctgctgggaggtgacggggtcttcgcccacaccctttccgtgccccagttggtgctgggggaaggcaaagccagagggaggcggaggggcttccggtgactgtccacttcctggaaagtggattcattttcctgttaatgctcaccttgactgtggaagaggccagtgtagaccattttactgagcacctgctagtttcttgttactgaagtgttacccgctataactcctatttgtttaaaagaaataagcgactcagagcgcggggtgtgaatactggagaggaagggaaaggtgggctgggcatgtaccggcgaggcaaggggggagtctcaggagtggctgaagtcctgatctgcctacactgcatacagtgcggctggggttgagttggtctccgtccccgctcagtttgggagaatcttgaccagaccctgccacccgagggctttgattcctggtctatgaatgggggtggcacccccagccctccccttgctggtctgaagcaccccctcccacaggctgtgacagattctgaccgcggccagaagggggcgcgcgaggctgccgctggccgcaacacagagctgcattctggcagcccaggctctagcaccagactggctgaggtctctgcggctcttcgtctccttttcggggggcggagtgagcggaaccttgtacttcaggctcagcagccccaggagctggagcctgaggagctgctggggtcctgcccagcgctgaccggcctggcagcgggtcccagtgcgaccggtgaggggagggtgcttgggctcctggtggccagcggcacctgcttcctgggccactggttctggcgagttctgggggcgcctgggggaggcttcgcgggactgtaggggccccaggcggggagggctgtgctgggcgctgagggatccgggctccctagtggacctcctgcaagcttcggctctgccacctgccacttgcactcccggttttcctctccagaactggaggaattaatcccagctctgttaaactccgggacggttcttcttcgtgatacagaaaagtcaggaaaaggggaattggatgtgcaacagactccaagtgaattcggatcctttcactccggattctgttggggtcatgggggtgattcttgtgatgaagacatggaagccagtgctcaggagctgggagatgaaacgtggcctgctgagagaactgcagtgactgagagcaaagcgaggttaaggcgcacagcagtttcaggagctgcagataattgctctggaggttttggttctgtgtttactgtgtgaagaggcaggatggatgcatgcaccgcattaggtgatcagaaaagccttaggccaattctacagtgagcaaagcgctctgagaggagcacaggctctactgcagtgcctggacgtcttcctcatgcagttccgtgtttctctgcctgggcagaagatggtgctatgcttactcaggatgaatactgtcatagtggaagtttagctatgctgcagtgaaaactgcagaatcatgagttacttcaaagaagcagagttgaagggtctccttttgcaaggtagctggggtttgacctatattcattcaatgtctttggttcacagggatataaaatctagtactgtttttacttctcgagtctcaataccagatgctgcctctgaagaagaggaagatgactggggatccaaccaaattatgttaaacacaggtgatcttggacttgtaacaagcatctctagtccacagtttgaagagggtgataggtgttttcctgcaaatgaagttttacaggagaattatacccatctacccaaagagatgtgttcctgctgctgaacctcttcccagaaatagagaccagtgcatgaattcacacaggccaggttaccctgataccacaagggctttcccaaaagtttacagagttgataaaagttatgattcctccagatccagagagaagaccttcaagcaatggccctggtaagcattcggtactgctgtctgcttctagaaagagagaagaacagtaacaaatagaatcgaagcctggaaagttcaaaaatttgcttttagaaggataactcaaggaagcacagatggcagaggctgcagctgaagcagagcgctctgctggcgggacagccatcgtgtccagcacccagagtaatgggccattcagcctagtggaaggcacatgagctgctccatcaaccttcctgcatactcacctactcatgtcccacctcttctagaaactgtgacaaaagggagctaggttgaaatcactgctggaatcccgtttgtaatgactttcactcttggtgtcagtagttttactgcttgggacttttatttgtgaattacagttgaaagctgcatttttacctatgtcaggctttcatctggccttaccagtctttcctctgtaggatggcagtcactgttggatattacaccatcctgtccagggctagccactgtggtggtgtgctgcttatagcttgctcttgtattgtaataaaagatatctttccctgtcgtgatttgtaagaagaactcaagggcattgttacaaaaatattctcccttcaaaaagagaaaagctaaaagactcattactactcagacttcaatacacctgtgtgtcaatcttatatttctttttttatacaaaactgtaaaatatacttttaggtccaaaagtatacttttagtgctttgtaagcattgcgtgaagcctgatatgataattccatggaagcattgccttgggaatttgctgtctttgctgtaagcttgtagcattaaacaaacattgtagttaataggctttctctttgaaacaattatgtgaaatgtacagctgttcttgaggaactttgaagctagttcattgaaaaatgctcctttcccttcccttgtaatgctatattaatgaagtataataattactggttttgtaattttttttctggt

SEQ ID NO: 58 - DNA, 297187 bp, Homo sapiens
ccagttctaacctcatcaagcaaatactttctttttgtcagttgaacttttcattgtgtgttcaacattcttgattcagaaagagtgagagagaaaggctggtgtgggcccttcctgggaggcctggccctatccacagctccagtgtggctcacgtgccctggagcccctgcccacaggacagtcctgactgctcatccacaagctttgtggtatcctctaccattcctaggcaggctctgtacagtgcagaactttctcccagtccttgcaccaaaataacaaatgtcagagatagtacatttggagccagtggctgtgcctcacctctagatgcctgtaatactgagctgctaagcaagaggtccctcccttcttgcccttttcttggggcctcatcccttgtgctctgctcttcctcacacaggatatatcttctgattgctcctctcccacctcctgcagtccctggacccccatggcaatacaaacagactcttctatatcctcagtccattgcaggaccacagctctgacctggctgtcctctgttttccaagccctgcacctgtggagttgggaattagcacccacttgaccccattgtggcatcaggcccaccctccccaatgcaggaagagttccagatgttggggagctatggcattatcctgcacacatatcatgtcctggcctgggaaagtgatgatgatgatattttcccacaaaatagacaataacatcatgaaagtgccttgttcattttctagcataaaatatatatcaaagcagtggggtttagtaggcatacgtagatttaaaagctcctcagaaggcagggaatgatttcttcaacagaaaaaaaaactaccccaaaaggagaatctcaatactttggttgatagtaaattaagaatccctcaagaaattcagtaggagagggaaaagataagtcaccaatgggaaatatatttgtcacaatataacaggcaaaggactcatgtccagagtgcatgaaggatttctacaaataaaataaagaatccaacagaaaaatgaagaagagaaaggaataggaacttcatttttaaaaaagagaaaagaaaaaggaagtaaggaaaaacaaatgaacatccaaatggccagaaagcatataaaaatgcccaacctcataaaccatcagacaaatgtgatccacaatgagaagccaatacacaccgaccagcacggctaaaattaagaagactgttaataccaagtgttggtgagaatgtgaagtaactgaaacatttatacactgctggtggaaatgtgaaatagcacaactactttggaaaattatttgggaatactgctaaaggtgagcacccctatgatcctgaaatcccactccaatatgaaaacccaaaagaaatgcatcctgatagaggcactcttcatagtagcccaatgttaatcatggaagaatggacaagtatatatcatatcatggaatttttatggtaatgaaaatagattaataactgccatgcacagttggtgaatcccaccaacataatgttgagtgaaagaaacctgatacaaatgaatgtatactacactatttcatttctgtgaagctccaaaataagcaaaacgaacctatagtgttataagtcagtagagtgattatcttagtatttgcatgggagctctggtaatgttttatttcttgatctaagggctggtgtcccagatgtgttcactttgtgataattcatcaatctgttttcttgggagctgtggcttatctgtgcagatatactccaattaaaaaaatcattcaactcaatgacaacaacaacaaaaaaaactcgattttttaacattttgtggagtgtttattatgatccagtcagcgtactaaatacactattttatttgatccttaaaataacttaaacaacttgatttaaatatgggcaaaggacttgagaagacatttctccaaagaagatatacaaaaagcacatggaaaacccttgacataattagtaatctgggaatgcaaatgtaaaccacggtgggataccacttcacacatgttagaatgactattatccaaaaataaaacaaacagaaaataacaagcattggcaaggatgtggagaaattgaaacccccatgcattgttggtgggaatgtaaaatggtgcagccgctgtggaaaacagtttgatggctcctcagaaaaccatacacagaattaacatatgatccagcattgccactttcaggtatatacccaaaacaatagcatgaaacacataaagagacatgttcatagcagtattattcagaataactaaaaggtggaagccatgttaagtgttcattgacagatgaatggataagcaaaatgtggtatatccatacaatgaaatattattcagcttttaaaaggaaggaaatttgatacatgcaacaacatggatgaatcttcaggacattgcgttcagtgaaataaaccagtcacaaaaagacaaatactacaagattgcaattacatggatacctagaacagtcaaattcatacagacagaaagtagaatggtggttgccatgtcccaaagccaacataaagcagcagttgtggacagcttcagtttcagctgaacttgactgtatgttgtgctgaaaccagggtaatctgatgtccaacactcagagccagttaagacttttgtttctggtgacctggggagctgacagtgcttttcaggcacacctggggtaactcttatttcccaaatgggttggcagattgttgtgggtgccaggtctttgatggactggatctagacacgaataaatagcctgctgggattttgattcggattgtagtcaatctatattgaatctgtgttttaagagtataacctcttaacaatattgagtcttctcactcatgaacaacatatatctccccatttatttatggcttctttaatttatcatagcaatgttttacagttttctgtgtacaggccttttacattttttgtcagatttgttcctaagtactttacattttgcatgctattgtaaatgttgttaatttttttattttaatttcttcattttttacttgacaaatacaaattttatctattcatagtgtacaatatgatattttgcaatatgtatacattttgggatggttaatccaaccaataatatatgcattacattttaattttcaattaagttacaaagctctcattaaacaatttttgtacactaatttgtcctgaaaccttgataaacacacttattaacttcttgtacattccactgaattttctacacagacagtcatgtcgtctgtgaataatgaccatttatgtctttctttccaaactgaatgtcctttatttctgtttcttggctgattgcacagtctacagcctccaatacagtgctggatagaggtggtgagggcaggcatccctagtgtgttcctgatgtgaaggggaaagtattcagtcttccacaatcaagtgtgatgctagctgaaggacttttggaattgccctttatcagcttgaggaagttccctctgttcctaatttgcctcagtttttatcaataatggatgttggattttgcaaaatgttttttctgtattgattatggtgatcatataattttttagtttgtttatgtggtaaattacattgatttatttttttactcttaaatcaaccttgcatttctaggataaataccacttaattatgatgtattacatttctattatatttaggattccatttgctaaacttttgcatagaattcttgccctatgttcatgaggattattggtctgtagttttgttttcttctaatatccttgtctggccagggtatcagggtaatgctgatttcatagattgagttgggaagtatttcctcctcttcagtttttggaagagtttgtgaagtcttgttattacttctcccttaaatgtttggtaaaattcactactatcaccatctgggcctgaatttctttatagggaggtttttatgttattctttttttttttttttgagacagtctccctctgtcacccaggctggagtgcagtggtgtgatctcagctcactgcagcctccacctcctgggttcaagtgattctcttgcctcagcctcccaagtagctggtattccaggctcatgccaccacgcctggctactttttgtatatttggtagacaagaggtttcactgtgttagccaggatggtctccatctcctgacctcatcctgacctcatgatccgcccacctcagcctcccaaattgctgggattacagggatgagccacggagccaggatttttttttttttttgagggagagtctcgctctgttgcccaggctggagtgcagaggtgtgacctcagctcactgcaacctcgggggaacccacccctgataattcaatgtgggtacttttctattttccctaagtgtcagccagtctgagaaataaagggaaagagtacaaaagagagaaattttaaagctgggtttccaagggagacatcacatgtcggcaggttccatgaggccccacaagccgcaaaagcagccagtttttattagtggttttcaaatggggagggagtgtatgaacagggtgtgggtcacagagatcacatgcttcacaaggtaataaaatatcacaaggcaaatggaggcagagtgagatcacaggactggggtgaaattaaaattgttaatgaagtttcgggcacgcattgtcattgataacatcttatcaggagacagggtttgagagcagataaccaggtctgaccaaaatttattaggcgggaatttcctcatcctaataagcctgggagtgctacaggagaccggggcttatttcatcccttatcgacgatcataaaaggcagatgttcacagagcggccatctcagagacctccccctaggaacacactctctttctcagggctgttcttcgctgagaaaaagaattcagtgatatttctcctctttgcttttgaaagaagagaaacatggctctgttccgcctggctctcaggcagccagacctaatggatatctcccttgttccctgaacatcgctgttatcctgttcttttttcaaggtgcccagatttcatattgtttaaacaatttgtgcagttaatgcaatcatcacagggtcatgaggcgacatacatcctcagtttatgaagatgacaggattaggagattaaagtaaagacgggcataggaaatcacaagagtattgattggggaagtgataaatgtccatgaaatcacaatttatgttcagagattgcagtaaagacagacataagaaattataaaagtattaatttggggaactaatacatgtccatgaaatcttcacaatttatgttcttctgccatggcttcagccagtccctccattcagggtccctgacttcctgcaacaccccccatcccaggttcaagcaattttcctgcctcaacctcccaagtctttggggttacaggtgcctgccaccatacctagctaatttttgtatttttagtagagatgaggtttcactatgttggccaagctggtctcgaactcctgacctcaggtgatctgtctgcatcaacctcccaaggtgctggtgctgggattaaaggcataagccactgtgcctagcctatagggaggttttaaaacaacacttttcatcatttctaggccttttacctaagatcaagtgtaaaaaatgaatttgagtttctttaatagatacaggggttttcaagttatccatttcttcttgggtgaactttggtaatttgtctttgaactaatttgtcaattttatccatggtgttgaatttaattggcataaaagtattcctagtattattttactatccctttatatctgtagaatctttagtgatgtcacctctctcataccttctactggtaattctctcttttttccctgatcaatctggctgaaaatgtatcaatgtcattgattttcccaaagaacaagacttgggattcattgattttcctctaacctattttctttcactgattcccactttgatctttattattccatttttctgcttactttggatttaatttgcttttttttcccatctttaagtgaaaactgaagtcactgatttgagtcctctcttcttttctaatataatatttaatgacataaattttcctctaggtactgttttagtgacagcccatatattctatgttgttttctattttcattcactttgaattgctttctaatttccctttagatttctcctttgacctatgggttatttagaagtgtattagatgtcagatatttggggattttcaaggatctttctgtcactgatttctaatttaattctaattcgtcatatgcagtatgttccacagagaacacactgtgtatgatgaatgcttttgaatttattgagacttttaaaaatcagccacaatgtggtctagattcataaatgttccatgtgcacttgggaaaaatctgtattctgctattgtagagcgaagtgttctgcaaatatcaatcaagtcaagttagctgatagtgttgttcaaatctactatattcttttttgtttgtttgtttgtttgtttgtttttgagatggagtctcattctgtagcccagtttagagtgcagcagcacaatctcggctcactgcaacctctgcctcctgggttcaagtaattctccctgcctcagcctcccaagtagctgggattacaagcgcttgccacatgtccagctaatttttgtatttttagtagagatggggttttgccatgttggccagactggtctcgaactcctgacctcaggtaatctgcccacttcggcctcccaaagtactgggattacaggcatgagccactgcacccagcaaaatctactgcattcttactgattttctgcccacttgttctattaattattgagagagagctattaaaatatctgatagttatgcatttttctatttctctttgatgttttattagtttttcttttattcattttgaaggcttattaggtacaaaaacatgaaggattgttatatcttcttcgctgaccacatcgtcagtatgaaataacctttaattcctagaaataattctttgctctgaaatctattttgatattaatatagccactctaaatttcttttgactagttttagcatggtatatctttttccatctttatacttttaacctatttgtgtctttatatttatagtgcctttcttataggcagaatatagttgggtctttgtttttcaatgtaatttgacactctctgccttttagttggggtatttagactatttacctttaatatgattactgatatgattaggttgagccactcaccttgcatatgttctctattcatctcatctgttttttatttcctttttccattttcctttgaattaatcaagtatttttatcataccattttatctcattttatctctcttgttaaacagccacatttctttttttttttttgagatggattctcactctgtcacctaggccagagtgcagtggcatgatctcggctcactgcaagctctgcttcctgggttcacaccattctcctgccttagcctcccaagtagctgagactacaggtgcccgccaccacacctggctaattttttgtatttttagtagagacggagtttcaccgtattagccaggatggtctcgatctcctgacctcatgatccatcctcctcggcctcccaaagtgctgggattacaggcgtgagccactgcacccagcctacaattcttttttgttttaattgtaaaccttaagataatacattttatttgaagtaaggtgctgaagaggtgttatttgtgtagggtgttaaaataatggtaagctatgagaaggggaaaagggcactgaggctaaggagttagtttaaaaaaaaacagaccagtacacatgggaatgtttgtgtagttttgtactggggtggttagatttggcagtcgctgaagctatgtatgtaggcaaagactgaatgagagatgaatctggaatggcaatttcaaattagtcactagaagacctcaaaccatcccctctacaaccccagttctgtagatattgaaagaatggtggacccggggcccactctctctgaacttgactcctcacttccctatgaaagctggctttgctatgtgccctgtgatatacatctgtttgtccccactttccaaaagtatgaatcttgtctctggtttacctccaatgcctagaaaaatatgtggcagaacgcatgcttcagtaaataatcttttaatcactgaatatttcaagaattccacataattctataagacattattaactattgtaaatttttaagtggagaaaaagtactatgttgcctttatttcatgaaagcaaccttaagagttggcatgaacacatctatccatctacttgtgtttgtgctcatatactcatatcccacttactatggatgaatggaatgatctatcatctaaagtcaatatttctttttcctaacttccaatccaaggacattattccagaaatacttccttgtatgtcctacattatcaattttgccctctctgtggatgatttccattggcatgcaaacatgctgttattttttctcttcttatagaacattaaacacaacgatcttgactctacttcctctacaattacttgccttttctccattcctttttttgagtgaagcttcttgaaattgttgcctgtgcttactgcattcaacccctctactttgttctctcagaaatcccttttggtcaagctttctccttatcacttcacccaaaggactcttgtgaggtcatcagggctagccactttactaaatccaatggctgtttatcaggtcccattttatgtcaactttcagcagcatttgataaagttggccaccattttcttgaaataatgttttcctttggctttgtgaacatcatactctcctttactggttgcttttcagtttctttttctggttcctctttacccttctttatttttatttcaataggtttttgtggggaacaggcagtgttttgtatataagttttttagtggcaatatctgagatttttatgcatccatcaccagagcagtgtacactgtacccaatgtgtagtcttttatccctcgaccccctcccaccctttcccccaagtccccaaagtccattgtatcattcttatgcctttgcatcctcatagcttagctcccacttacaagtaacaatatacaatgtttggttttccatttccaagttacttcatttggaataatggtctccaattccatccaggttgctgtaaatgccattatttcgttcctttttagggttaagtagtattccatggcatgtatgttgtgtatatatatatacatatatacatgtatatatatatacatgtatatatgtatatatatatacacgcacatatatacacacatacatacatatacacatatatatcacattttctttattcactcgttgatcgatgagcatttgggctggttccttatttttgcaattgtgaatggtgctgctataaacatgcatgtgcaagtatctttttcatgtaatgatttcttttcctctgggtagataaccagaagtgggattgctggatcaagtggtagatctacttttagttctttaaggaaccccccaccctgttttccatagtggttgtatttgtttacattcccaccaacagtgtaaaagtgttcccttttcaccacatccacaccaacatctattttaattttttgatctttttattatggtcattcttgcaagattaaggttgtatcatgttgtggttttgatgtgcatttccctgataattagcgaggttgagtattttttatatgtttgttggccattagtatatcttcttttgagaattgtctattcatgtccttagcccactttttgatgagattgtttgttttttcctgagcagctacaattctttggcttgttattttagtggttgcttatggatttatagtgcatgtcttccactgatcacagtctaccttcaagtgataatatatcactttagtataagaaacctacatcgtatacttcttccctcctagtctttaagctatgactgtcatccattttattttacatgtcataaattccatagtaatttattatttttgtttaaacaataatattttaaagaggtttaagtaataataacaaatcatatatttgtccatgttgttactatttctggtgctcttcattcctttgtgcagatctagatttcaatatggtatccttcttacttttactgcctaaaagacatcctttaatttttcttgtagtgcaggtctccaggtaagaaagtcttaagtctttacaagtctaaaaatgtatttatttcttcatatccgttattctctttttggtagtatctagttggctgtgacactaatccattaaactttccatttcaattatggtatttttcaaatctagatttctatttggtaatttttcccaatctacttgattattttcatactcatgctctttaatccccttgtttctttacgtgtaagacacactttatgtgatgtttggtgactctaatatcttaagtctctgtaggttttttcctctgtacattgttcctgctggctcttgcacattatacatgtttgtaatttttgaataaaaacttacattccatgaagctgtcttccattttgcttttgccaggcacctggaaggcattaaaaacctgatgtcactttaaatttgcagcttgagactttttaggattatacagcttgtgtgtgaagccaccagtgaaagggctgcccatggttatgtattaatgtatcctcactctcgggcgagatgttttccctcaggatggacaattttgtctactgttccaggggctgcaggggatagaggtggcaggagacaggggaggcagacaggttgattcatagttccctcctacactaaacctatctttttggtgtcctttttttttttttttttttttttgagacggagtcttgctctgtcgcccaggctggagtgcagtggtgcgatctcggctcactgcaagctccgcctcccgggttcacacgccattctcctgcctcagcctcctgagtagctgggactacagacgcccactaccacacttggctaattttttgtatttttagtagagacggggtttcactatgttggccaagatagtctcaatctcttgaggtgtcctactttttgatgtcttctcctaatcctcctaccttggacaggatctaaactttgtctgctattctgctgccctatcatcatcccagactatgaaaagcaagtttcagtatgacacttggcaactatcttaagggtgaaaaatggcatctaattacttctttgggtttctactttcactttttaattttaattttttttgcctttgtgaactcttaattattttgcacctcattgatacatttttttaaaatggttcttgatatgtattccagaaatttttgttgttttctggtccttgtcagcccatgttgccggaaataaaattatttcaacttgttctttaacaatttacagtatccatatattccttcctgttccagaggcaatagagtgagaacacacacttaggagccaagctggcctgagattaagatccaccagcaatgtgacctcaatagcctatttacattctgagcctcagtttttcatagggttggtgtgataattatatgaggtaatatatgaatattacttaaaacagagactggtaaggatggactttcttgttattattatctgaaaaatttgaaaaattatgagcctgagtaacagttatacatcttacccattggttcactaacctctggcccctggctaccccagacccctctaccatgcagtcacccacacccatgcttacactgatggagaggagtcatctatgagctattcactggatgacaggcccagctactgtcacagatgcactccaagtccaggacagaatgctagcagatagctgctggtctgagaaatgtcatcatcatataagcctgagtgaaaacacaacccctttactactaagaaatctaaaaacaaacaaacataaaccaacataattttaaattttgtattttttatgatgtcatttgtcccaacagccatctgacatcaatagtcctgattactaaaaatctcaacacattatagaaatgttcttctcctttttgaaaaccatgtttatttttcccccacaatacagtgctatctgcaaagccttgaactgataacatagctcaggggctaactctatcttagcagagtagcagctgaaaaaagaaagcaattcttaacaaacagggagatcaggaatgctcacttcaaaaacattatttattcagggcaagtgggcaagtggtatttctgatgtgcaaatgaagcttaaacttcagctttaatttataagaattaggaaatgcagattaaatctctgatgccacattgtgaattcagtaaaggttaactaatctacgatgcaaagacaaactttagctatcctacacttattattctggaaatttaatgaaaattaaacaagaagactaacagagtataagaattgtccccccgtcttaacactgctgtttccagcctctgttgcctgaaacactgcagaatacttcagatttttttaaccccaactttttattgagtaaaaccaaagtactaaactaataaatgtgaaaaaggatgttgggcttaaaaagaaaaagcctcaagacatcgagcctcttagatattttaaaagtgaagaccgagaaggaatgcactgttgctaaatagaattataggattatggtcaatttataatcttttcaacatgggatttgaatgttctgatattagatacgatgtacgtactttatttatatagtacctcctgagaagaaaaaaaatcaatattggtttatacagtattttgcatgctattcacgtatgcagtgatgtatacgatatcagagctagaaaatggcttagatacgatttgtattcagcgctgggcgggtccggccccgccaagccccgccccgacaccacccccccccctgccccgcctcatcccgccccctccgacccgccccagccgcaccccttccccctccgccccgccccgtcccctccaccccgccccgctcggcttcgtcacctctgccccgcctcgacccctcccctcctccctgcctcgtcccctccgccccgtcccgccccctgaggcatgcgcggtgctcccggcaggcggggctggctgttggaggaatgtgcgaggatctccgtggccggtgtctgaagtcgtcagtttactgcttgtaatgaacatagtgatcactgggaacctggaagtagagactcctttgcgccgtcccgccgtccctctggctgctgcgaatccccccgccagcctccaggaccccgggctggctcaacgcccccaccggccccgccgccccagggcccgctacgcgcccggcataatgggagaaaaatcaggacggaaaggcccagcccctcgccatgcagacgggaagctcggcctgcacatgtgaggacccttacgccccttggggcttcaccccctttgctggctccaatagtctgggtcggggcctccttgtcctgtgggggcctctgggccacaagaacacaggcccgagccccggcgagctcgcgggcctcccaccagccgtgctcaggctgcacttctgcaccccagccctgcacctgcgggaccacctgggtcacttttccattctgataaagtccccgtacttcgtggctgcaggctcctcaagccccaggtctgtgcagggatgagcaaaacagcagaatatccgcgctacatctttctggagcacccattttactaccagatttggaaggaacaaagttaagtaatttccaggataagtaattaaaattttatgatgaaaaggctggaaactcttctcctggtaataactgtcagacatatctgtgcctgaaatgtcagactttctctgagaaaaaaactgagaacctgtttcccattattttaaataggaaacattatagggcacagcaagtcaatagaaaaaaacctaccaatttcctaattcacagtgtggcagtaggtttaagttgcacgtaagttagcaggtaaaatgcttaaatgttaccacgtggtcacccacatttgatatggttgttaacatgcagttgccttggatgcagtagctttggcttgagaccagcaacatcacacgtgaacctctcctttgtcaacacaccaaagctttttgaagtgaccgtcatgatcctgatggtctaccagttgtttctggaagcaacatgtggcttttccagcaaagtatttagtttaaaatgttgtaatttttgaaagctcaaacattatctctacaaccatcagccgaaaaatttgagacaggttcttgctcttttgcctgaactgcaccatgataggggctccagcgatccacctgcttcagcctccccagaagctgagaccacaggtgtgtgccaccatgcctgttaatttctaaattttttgtagaaattacatctccccacattgccgaggctggtcttgaacttctagactcaagcaattttcctgacttggcctcctaaagtgctggaattacagacgtgagtcaccgaccgcacctagcctgaaaaatgttttgtgagataaatagctgctatacagtttagatattaaaaactaagatgtgttctcccaggaaagtaataattttggatatattctgtgtcacatcctgtatgatgaaatagatggcaaaagaatcccatttaatttaaagatggaagctgtaacttcaagtaaatttggagctgaggagtcctttcgggctatgaccccagaattctggggttctctgtactgatattttgctagtgtccacacacaagcattccttaatgctgtgcgttaaacaaatagaccttctttgaccccagatttctctccatttaccattctgtttctctgctccatgcaactacctcacctcatgtcctctcttgaacccactcctttctagcttttctccagggtactttgctgaaacgacttttatctcagtcatttagctgcatttgacacagatgatacaattaaggagttcctccttgaaactctttcttctggattttaaagaccttccgtcctggattccctctcacctttttcttcatcctcctgctcctcctctaccagatctctagtgatcctctcagaatgatcccacatagtctcatagctttaaataccatccatctgttgataaccactaggcttggggcctcttccctgaggggagcaccaagagtcttccctgactcttttcccttcgcccccaacccccatgcaaccatacagcaagtcctgtggctcttgagtgcaaccagcaacctgattcaccatctccatttccacaaccagtttcagtcatcttcctctcctactggtctactgccaaaaatcctcctactgccaaaaatcctccaacctccctgcatcctatcttgccctcctgcagtccagcctccactcaagcatccagagtgatctcttgaaaatgttaaaacatgatataagcatacccccacccctgtgtaaaccctgccactgtctactcattgcagtagaataaaagttcagacaacctggtgcctgcctcttaagcctcatctcctacccttgcttgttcttgctatgtgggtcagattttccggtctccagagctgaaaacaatcttaactgacaggcattagatcatagactctatctacagcataaggcatggaaggaaaagtctgagagaatgaagggccagaaaagttcatttaaaaaaaataaaaagcacaggaaactggaaacataactaacctgtatgtatatactcaaaagaacatggcagcaaaatgaactctttagaaactgagccaacagacttgcaaatgaatagaaatacctttggtcctactctgaaaacaaaaagaatccttagtgaatatacaagaacaaaaattgtacacatttctgggtcataatgcaataaaactagaaataatcgaaagagaatttaaagatgttcagcttcctgaaaatgtcagattatccttttaaacaaattaatgcctatgtcagggtgcaaatccaaaacacaaataccttgcctataaaaatatattttttcaagcaacagtgtatcaggatgtaaggagagagctcactaactcagaagctcccagagtgaccagatgtgttcatgggaaccggagcactgccctggagtcatttgacatcaccttattacaaacaggaacagccatgatggggaatgctcagatgccagtaataagtcagaggattccctcctgaacgggacctcccagtcctttttggcacagggttccaggtgtgaccacaaatccatgggtgagggctttcaagatcaacctgccctcaggcagtggagtggaaactggaactagcagctacagtggaaaaaaggaatgtcctctcagaatatgtcatctgccccatgcaaagactctggatctcagaagtcctcctggtaaggactcggagccagacaacttcatttcctgtcacctgggctgctctccctctgacagctatggaaattggtgaagcacaggaacgtattggaaatggcaatgatgtgcaatgccaatgtgtggaagtgtacaagttaagtaatattttaaaaacagaacacacagcagtttgcacaatctgatcaaagctctgtcatgtatgtttctaaacaagtttggaagagaatttggaaatggctgaatttttttaataaagctcatgtttttagtttgtttaaatgtaaaagcatacacttagaaacaagttagtacataagaatttttaatcttagctatctggaagcttcaaatacctagaatgaggcatttcccaaaggtctctgtaacttgaattttaccgtagtttgaaaactcttgccaggcatactggctcacacaggtaatcccagcactttgggagattgaggtgggcagattgcttgagctaggagttagagaccagcctgggcaacatggtgaaaccccatctctacaaaaaatttaaaaattagctgggagtggtggcactgccgtttgacacagctactcaggaggctggggtgggaggatccttgagcccgggaggtccaggctgcagtgagccatgattgcatccctgtacttcaacctgggcaacagtgccagaccctgccccctcccccaaaagaaaactattagttcatagtgcagttgatgaaataatgtacatccacaaagaaaggagcaaccataatatgtatataattactcagtattaaaatattgtatatagtattacatatataatattgaatacctataatgaatggggcactgctttaagcactgtatactcattatcccacaagaattccttctcgggtaggtcttagtatattcaatttaaaggctaattagtaagcaatacatagaattgaacaagaagctaaaacatagaaggctctcgaaaatacaatgtggaatgagtaatgcaagttacagagatacatagcacatttatagaaagtgtaaaaacttacaaagttaaacactatattatttagataaacaatatattatttagagatgttattatgtaataaaagtataaaagtcagggaaataatatgttttgtaaagcttcagatgaatgattgtcctagatggggaggcaaatggttacatttccaaagggccaaccatgaagacggcttcaaatgtagtggtgtaggtgatggatacaatgtatttattttacttttatgtgagtctgtgtgtatgtatgtgtgtgagtgtgtgtgcaattttgtatgtataaatatgtagtaatttttttttgagtttgggtgtttctctgtctcccaggctgaagtgcagtggcatgatcacggctcactgcagcctccacctctcaggctcaagtgatgcttccacctcagcctcctgagtacctgggactacaactggtaaatattttgctattatagattcggctatcatgttctgttcagtgcctatttcaatagcctctctgccttaattcaccttcatctgcagtgggacacagtacttcttctctaggctacccatggggtaccccaacagcgttgccaccacatacaatcttcatagagctcttaactgcatccagctttctccaggagctcaggatgccccagaccctcatcgcagacagcattgccctggagcttatggctggagatgatatcaccacagacatccccaacccagccctgtcctgggagcaggattctggcctccctattaggcctcagaaactggctgaccacctggcttcacaaacctgtgtgttttcagggaaaattttgatctctacaaaccatgacatgtagagagggacacacatctgattcagcagtccctgatccgctgatccatggacacatttgcccacaaggaataacctagaatttctctctggtggaggtcaggggcattacatgagctgagtagagcttagtttttaatcactagacataggcaaggtgtttaagttattacgcttccaagcagcatggtcctcactcactcaaggtgagataaatattgctgcaaaggaacaacagctgcattgttggagttttgcttttgaggcgtgtgtgtgtgtgtgtgtgtgtgtgtgcatttgtgtgtgtgtgcgtgagttgatttctttcacaaaatacattttcacatacttccttactccaatctacattgccccttccttttaaataaatttttttgaaaactaataagcctattttatttatttacattttttatttacgtttctttacaaactgtttgctattagtctacagtgaaaagtcaacactttataaaataagattagcatttaaaagcttctcaattctaatactttgaaaggctacacccattttcagaaagtctgggctattcaaaatattttacaaaattctgaaacttcgaaaagctgcaagatttggagacagcaagatgaagtgttttttctaacagccagttttgttcactttattattaaatatgcactttttaaattaacagcttgaattctagaatatatttttgaaaatcactaatgatttttgtaaaaatagaaaatctgttgtacctttatcttaaaattcacttcttatctattttctagatttgatgttttgtcattttaaaggatactagacaagaggatctcaatttggatcactatattgggctcctaatatcctaatataattttaaatcatctcaaacaatgcattattaccatatacatcagcatttcccaaactgtgctataagctatgtatacttttgctatttttgagctaaaatatgcttacaaatatataaaaatataaaaatatatttaggtgttgttatgcaataatgcacttttcaaaaagaaacgatataccagtctcaagaatacccggaagctgcatgaaaattcttgattccttttatatatagtgacagaaaaagatgtaaatctaacaattggttatttttattgtttaaagttttttctataagcacatgtgaattaagtattcattattccatattcctcatgtcaccgacgctgggtgcccacagcactgtttttctaacactgcagctgtgggactgagggtggcagaccagacacctgcactgagccacattcgtcacacagttggaccagccctgagccgggggcagaaacatcctgatgtgaaaagctgtttgctaagtacaatgaccacacgtttcgtctattttgaatacaccatcacaacaaactctacactcttgacagatgagacaggcagatatgatctttgaacacaagtgagaaagacgttcacacagactcccatcctccctcacatgactggaggattaaaatggtggtggggggtggatattcagctcaggggcagattagtgacactctcacagctattttaagatacgaaatatttatatgatcctattccaaaccctaatacataaataatgaactcagaactgtacacaaagggaaacaaaaaaccactctgacagtgtccaggtccctcataaacttcccagaagtcaaggaggtcaaggctggtctcaaactcctaggctcaagcgatctgcccacctgggcctcccaaagctctgggattacaggcataagccaccaaacacagcctagtacgttctttcgatatgtttggaatgaatgtgtttccaaggataaaagcttacaatgacatctttcttacctgtaagatacccgaagagcagagagagggtccccaggctggctaagcatccagaacactgggggagctttaaaaacatagatataaattattgtatttcaccccttacttactgaatcacaatcccagggatggaagcacccagagatctgtctttttagaacttctccagctctccaagtggtgctgacaatcaggcagattgagagccagtgcttcaggcagctcatcccagacctcgggagcaggggagtcacccagagctatgtcagactgaaggttctggtgcatcaggggtggggagggtcttgagagttggcctttccaacaagcttcccagaggggctgctttgctgatcctcaccaggctttgagggtgcacagcactcttcctctaggtgtgtgtccacatacctggcacatttgttgttgcattgccccaggtataaagtgcagggtgccccctctacaccttcagccctgctgtctcccctgctgacccccaaatctctggggcttggacttacctttataaagggagctctcagctcaggggtgggccctccccactggccctcttttcccaaggcccggcatcagcaggagctgctcgagcaattcatcccgaggggtctatgtggtgtgaaaggcttagggagactgttctgtttattgttaagagccaggaaacaaagcctggaaacaaagtctggtattgctcaattcagtggtgataagagacaagggtagggcagggtgcagagaagactcccacacatagcaggaccgagtgagtgccaattcttccttctaacactggcaccaaggagagaccgctgtcccttcccataaaggcagtggacaaatggaagcatcgcttggtgtgccagcttctttggggcaggagaacaataggtgacttgaagcagggttgggagccccatcccaagcacagtggatgctgaagggggtcccaggctccccaggtcctgggcttctcttgattctcagttaagcttgttgattgcatatagttgaatatatataggcgaggaaaagacacaagccaagaactgggggcttcagtcagctctgaaaagtcaggaagagcatttcttttttttttttttttttttttttgtgacagagtgtcgctgtgtcacccaggctggagtgcagtggtgcgatctcagctcactgcaagctctgcctcctgggttctcgccattctcctgcctcagcctcccaagtagctgggactacaggtgcccgccaccacacctggctaattttttgtatttttagtagagacgggatttcaacgtgttagccaggatggtctccatctcctgacttcgtgatctgtccacctcggcctcccaaagtgctgggattacaggtgtgagccaccgtgcccagccaggaagagcatttctaacatccaaatgcaaatgtctgccaccccgggctgctttcctctggaaactgcactgcagggcacagcaggtcccaggtttgcctttcctaattccctgcaccacccagctcccgcctccctcactgtgcgggatgagaggtccacacagacagttccttctcacctttgaaatggcagtggtggctgcagcctgggagctgaggccatcccaagcgggtgagacccccaccaggggccctgggtacctgccggccacaggctgtgccatccaggctgtgcacagccacgcctcagctaccaggatttccttcctgtggaactggaccttccatccagagagtcttgcagcagagagcagaaatgggctttctctctgctggtgtaggaaagccatggcaggaaggcggtaccaacaacacacagctgcctgtcccacgtggggtcctgcacctcctgcctcccagctttcctgcccctttactttgtaagtgtgctctttgattaagtgtcctgtttttaattgtgtccaaatgttcacactgtcttaagtgatgctggagccacagcctggggccactgcaggtccttcctctggagcaaagggtctttgtcacagtgtttctctaaaagcatatccatcctgagtgacacttattttagaaacagatagaattggtgaaaaaagggttgagcattataaaatgtctctggatttcaaagaagttggccaccatctatggggaattggggatgagtaacttctctttaagtaaatgaggacaggacaggcatggtggctcacgcctgtaatcccaacacttcgggaggccgaggagggtggatcacttgaggtcaagagtttgagaacagcccggccaacatggcgaaaccccatctctacaaaaaatacaaaaattagctgggcatggtggtgtgcacctgtaatcccagctactcaggaggctgaggcaggagaattgcttgtacccaggagatggaggttgcagtgagccaaggttatgccactgcactccagcctgggtgacagggcaaaattccatctcaaaaaaaaagtaaatgaagacaaaatcccaaaggctagagccaccacccagagcaggttcaggatcgaagtgcccctgtggttcccctcccacctgaatgctctgttttaaaatgaaggtccaggacaaggggagagcatgtcattactaaggttcagtgttaaatagagacattcttccactgatggcagccattatgggccacctgagctttctttggttttccctgccatctgcatggtcctccactgcacttgaatgaggagtcctgagggtctgagtaagttgcagggattgctgtgctgccaggagtgagtgaaagaagaggccagagcagccacctcagctaaaaagaaagccagaggagagggtgggtatttagggagcggggatttttaatttcaagtgaattctgtaattaaggaaatggggtggtggtggtggggctctgggctgggtgctctggcactgtccctaacagcagtcacagtgatggctttgctcctgtgctgctgtccctcctccctctcagcaataggaagaacatgtgtgcttttgatgcacttggtgcagcaggcctgggatgccgcatttcacacaagcttcaggtgaccccagtgctgctggttcatggaccacgctgtgagtagcaaggtcacaaactcccctgagggaggggagtagctggctgcgtttctgagagaccctattacgattgaactactttgggcctcacttcttgagaactcaaaacagctgctgggtgtgctgaagccatattcaccccaccacaaagaggacagtcagcacctttctccacacaatggtaaaaaggttttgttttcatataaaacctcaacagatgaatggggccactatcaatgattttcagaaagaaaggctcaaataccaactattttttttatggagtcttgctctgtcacccaggctggaatgcagtggcatgatctccactcactgcaacttctgactcccaggttcaagcaatccactcgcttcagcctcccgagtagctgggactacaggtgtgcgccatgcctggctaatttttatacttttagtagagatgggtttcaccatgttggccaggctggtctcgaactgctgaaatgaagtgatccacctgcctctgcctcccaaagtgctgggattacaggtgtgagccaccatacccagcccccaaataccaactattctttaaaaaaaattatgattatgttggaggcacagtggctccttctgtaatttcaatactttggaaggccaaggcaggcaaattgcttgagccctggagttggagaccagcctgggcaacatggtaaaaccctgttcctgcaaaaagtttttaaaaaattagccgggcatagtcgcattcatctatagtcccagctactcaggaagctgaggtgggaggattgcttgagctctggaagtttgaggctgcagtgagctgtgatggcaccactgcactccagcctgggtgacagagtgagaccctgtctcaaaaaaagaaaaaaaaattttatatatatatatgtatgtatattatgttgggagagatgtccctcataattaaactaggttaatacagatgattttatttaatagctgaaatggttctgttacctgggagtttgttttatatttagttgatcttggaggatccatcatgaatcccccctagaagtgcccacagtgacatgttccatgagtgcttgatggaaagccatgtatttctaaggctctggtggcaggtagcagttatgcgatggcatgaggaaaatccatttagtagagttgtccaaaagtgcaatggcctggcttggtaagctgtaaattcagtccctgtgaggggtagaaagtgaggatggagaaggaaggaatatgccaaacaggggttgaacaagacgggcttcttccagctgtcagttttgtgactatgggtactgtccatgtctccaggatccacctgggatgcctctgataatgtaaccacgtacccccatttttcttgggcagtttattccaacaagtgagctatagtgcaggcattgggccatgtggtatctgtttgactttcaagggcttaggtcagcttggtggagttctctgggtccctctagggaatcatccaacccagggatggcctgcagggtcccaccccacccctaaagcacttacattcacacaaaatcctagagctgaatgttctcagcaggcttattcctcatagccaaaagccagaaacaaatccagatgttcttcaaggagcgagtggcaaaacagttggggtcattgtggaaatgaagggaagcctttggagagatgtattggaagaatgaacaggactcagtaatggattgtttatgacgtgggggggttacaggctgaagaaactctttctagagtctggaatggagtccctaggtgagctgtcacaccatttatttagacagtaagtctgggtcacagccaagtccaggaagatgacctagactatagagtgggatcagttctaatctgtaatgtctaagaggtatttcagtctggaaatcagctaggcagctgtacatataattctgagtggagataaaatctggaggttgtaagaatagagttaataattagtgccttaaaaatcaatttggtcacccagagggcttggggttctttttttctggcataccaataaaagaatagcagagttcaggggtgagttatgatgcacttcagattttaaatcccaagcaggggttgtaagcatgctggcaaaccttggggaggagcatccagaaaggcaggatgagaaggagaagcattggcttcaggagccaggagcaagatggaccccagaaacaaaaaggagccacttacctggactgttcctttgacgtggtaaatggaaagtggccattagattttccatcatggaactgtcaaaggacaaaagtacaacagatttagtttaaagatcctaattggctttatttgctattctagaatcaggcaacagttcattccataaaacagactgagcgttcctccgatcagagatggggagatgggctttatggatagaaaaggctgaagcagaaacagagaacaaaacacagattggttgcaaagttactttccttgtaaacattaaagcagaggggagggactgcctatcatgctggctaaacctggcctgttggggatttgcctgttatctctctgtgtcctgacttctcagaaagtcagatcaacaacttcgttttggtttggaaaagtggaactttagcgcaaggaactccaatccagtctggtcttgttactgaaatgaacctgggtctgcttgccccgtgtggtaaaaccaaacacccacactgaggtttgcagcaggagaaaggagggtgttaacttgcaggacaccaagcaaggagaatggggcagcttacacttcagacccaatctcctggatggcttacaagcaagggattttaaaggcaggggaacaattcaggaaagcagaagttacagggaaaccataaatcaatacagagggtatacattgttttggcccaaaaaggtggaagctcttgaagcaaggggcttacaggtcataggcggcttcaggattctttgattgcaattggttaaggaagccaggctttgttgaaaacttggggtcagcagaaaggaatgttaagatgtggcctgtgggcatgactccctccaggcccctgagaaagaaatttacaacaaagagcagccatcagagtgcagccctcagctccccgacatctgaggtctctgtgatgatggtcagtattttccatctgacgtgggtccgggtttctgaaaaaccattcatggacatatgctaagatgtaatctttagtttcaataggggaccaaacaccttgtggctctgacttacttgagtggctgttacttgaagctattattcccttcttgcttatcaggtggctcatttacttctcaaggccagctaggtacctggaatttcccttgaaggaaatcaagattttcctttgtttccatgctggaggaggcccagcaggcctctaataggggtccatgctccgtctcagtctgttgggcctagtgcagaagctcagtccaaactaatggcctcctgtaaatgtattttacagaagtcagcagtgtccacagcaagggagagtttcttgagcaacctgctgggagacctaagagtgaaataaagagtgaatgtcaggtgaaaacattgaaaagatgaggactgacaagtatttacagggggttaactctgaagtggttccaataaactgtgatcttgaaaagcaggtagtggagggaaaaatggcttccccttctaggttctttggctgggctaggaattaaattgacataagacgggctaataggagaataaaaaactttaattacgtctatatgcacaggagtcccacaaaatatggatgaggagaagggccagatgaatgaagcttagatagtgtcctgagttacagaaaggaacaggggcttggggcttgctgaggatgggcacaagttctgggagggtgaggggaggcaatgtctggtgaataaaaggtgtcttgttctgcagagaaaagtctctggggttatagaagttgtctggaaccagccctcttcctgatacagataattcactaatgtagattttttttatagttataaatttcttttacaaaagggcagcttttcagagctactcctgtgtctgcaatttcttagaataacaagatcaaaatttgcctaagaagtatattttgtgttcacatatctggttttgtattgtcatattttggggtggtgtgtcctgagccccaccagcaagggccatgttataggaatataatttttaattgactttttagagttgttttgaattcacagctgaaggggcttagagtataccatcccaaaatatgccactctgacataaagattattttgagctgaagacaactgagaccaagtagacacaggacaaactctctgccctgtccccatctaccagaagggcaggatggctcttaccagcccagaggtggcaccagaaaaatcaacatcacaagcacgccaaatcaaccttatctgtcagcttctgccatatatctaccttcccacaacttgttatccacagaagctcaaggtccccttcctttgtctttccacttctctacaaatacattgctctctcattagggtgctaataagcccaagttctaaccgcctttttgagttattatcactgagctctcccatgtgtatttgcgatgcatgaattaataaatgtgttgttttctcttgttaacctggctttcattggtctaaatttgtggggccaaggcactaaacctaagatgggtggaggaaagattttttctaaacctatacagcaaaattgagctgagcgtgcagagaactctcatatgaacccctcaccggcccacacatgtgcacacacacacacccacacacgcacagcctgccctactgtccatgtcccacatcagtggggcacatttgttactacagctaaacccacaccaacacatcattttcacccaaagtctgtggttcacattagggtcactcttggtgttgtattgtcagtgaaaagagccaaactctgtaaaatatttgaagagatttattctgagccaaatatgagtgacccaaggtatagtctcaagaggccctgagaacatgtgaccaaagcggttgttttacagtttggttttataccttttaaggagacatgagacattaatcagtacatgtgagatgtacattgattcagtccagaaaggtgggacagctcgaagggggtcaatgggaggaaggcttccaggtcataggtggattcaaagattttctgattggcaattgattgaaagagttattatctaaaaacctgcaatcaatagaaaggaatatctgggtcaagataaggggttgtggagaccaaggttcttaccatgtagatgaagtctcatgggggtcacccttagagacaatagatggccaatgtttcctattcagacttttaaaaggtgctagactttcagctaatctctagaggattgggacagcctggaagggaaaagagctagttatggtaatagagattctttacaggtgcaaattttccccacaagagacagctttgcagggccatttcaaaatatgcaaaaaaaaatcctattttggggtaaaatatttttatttccttctttatctgtcatatgatgttatacgagagtcaggtgggaaagtaagctgtgttatatataaggttaaataaagcccatctgttgagatgtcagtttctagggtatgactccccaggccccttagataggaatttgggcaagagagaaaaaatgtcagtttagtcctcagtacattctttgggtttgaacagatgtctaatgccatatccaccactgtcatatcatacagagtagtttcacagtctggcaaatcccctgtgctctgcctgttcatccctctctcccccaacccctgccaaccactgctctttttactgtctccatggttttgccttttccagaatgtgacagagttggaatcttacagtatgcagccttttcagatcagtttctttcagttagtaatatgcatttaaggttctttcatgcagctcaataatgtttggcagagactcaaaggcagggagaggaatgggaaatctgcggtggaaaaggggaagaggagtcctgatggggttgccagccaccagaggcggctgctagtgaagtggcctcattgtctggggtgacacccaatgttcattgtctcacagccacagagatcaagggcatggacacacaaagggtgaggttaagagtggaaatttaatacgtgaaagaaagagaatagctctctgctacagagaggggtcccggaaaaataggtcgctgatgcacagtgcaatgcaaagatttttatagatgagctagtggggagcagtgtctgatctacatcgggtgtgaaaaaacaggaccaggtgtgccatctgcatagggcacgaatctctggacgcccccacaccaatcttctatttattacgcaggtgagtagctactccatgttgcttatttctttcttactgtgcatgtgttaacaacaacaaaaaaaaaaaaaattagggaaggtgaaccccccatggtggacatgcctggccccaggtagtcctttttatcagtgtggctgcaggcctccccccaggcaagcttccagcttccttaactatgtttgcagctccatctttcaggctgctctttgttagaaagaaatgatttcttgggctgttttttgtcagaagttctgccaaggacttttttgccctatctgcctaaataatttatttccatctcctgtatccagtcaggggatcctacctgactggtaagagggtgcctatttggttctccctgttggtcctaggttcgaagcaagggcaaaaaggagggaagccgtcagtgcagtcctgaccattagggttgctgtatgcagtttccagctggttacttcacagactgtgggtcagagtgtcaccaggctctcgggtggattttttaaatcccacggactgaaacccttctttattatctccagtcacttgaacatctttctttgattgacagtttattcagtgttattaaaaaaaaaagctgctactattactactactactactacaattactatttataataatggtaataattatagtaatgatgaatcccagcaaggaccaaataattataattactgatttaatatttatacataaatatttattaaaatatataatctatatattacatatatttataccatgacatttatagtatctacataattacatattatttgtgtatttatgactatttatatttataaattacataataataagaagaatattattactatgactactataagcctcaggactccccccgccccccaccataacagaatatacccctttaaccatccagccacctaatcccacgttgcccccgctggtcgagcttgctatatataaaggcggctgccaactgttgcaagacaactagctaaaaagcctgccgaacagatcgggatcgcgggtgggcaggtaggacgccaggcctcgtccgggtccacctcaggtcacattcccacctcggggcaccctggcaggcatgagtggaaccgtgagatccctggtagccaaaagaagccttggaaaattttggggggagcgccctgggccagggacagctgccgggcaggggacagactccccagcgcctcccgggccagctgcccacccagagtggacttcaaaattcaccggggtcagcctgcctcagcctccccaggggcatgtagaaatttctgcggaccgaaagcccctcctgcgtcctcttcggaactataactgtttatatctaattgctatttatgtagattgattatttataaagtataatttatacttctacaaatttatattatttatattcatatagtttgtaaatgtaaataaattatttgtttataatacttgcttataagaattaccattgctgtataaacctcaggttccaccatccccctgcccctaccctccccttcgcaccttgccacgtccttctcccctcgccttggccccttctcctctcccaaattctagttgcccatctgcttggttgggctgctgatcgatctgatcaactttctgaggccacatcaaaactgcagaaatgaggctgatcgacccagcagctctaacaaagatcatccatcggacatctggtcgcctctctattttggagccagaggctgtacgctcttccccggtggggagggtggggccccaaagtccaaccacaagatcccattttgcaggccgcggctaaatccactgcgccttccccgttttttctcgaactgcccaagccagactccacctccaagacaagactcggaaaaaggtgtgaagctcaagtcggatgaccacgacccacgcgtggccacggacgggcccatgttattcttcgcagtcctcctgtaatggccgggcgggtcctcgcctccagggcggggcttggagataatgggtgtaatggaaggcctgaggacccggccccacgccagtcggagtccgggcggagtaacccatcccccgttcacactctcggaaggcccgtcgattcctgcgtgtactagtcgacccgctcaggccacagcactccgagctcaatagtgcgcctccaacgctgacccgcaggtttaatctccgacgaaaggacgaagagtacacccggcaaagccgggctcatcctgccagtgctgccagtccccttgaactctgcacggcgccctgtggccaaatcccctttcttgccggcttcgccagagcgccggagagaaaaccttaacagtgcagccaggtggcgcccaacagccggcgcaagcagccgcggatcggatcggcatagccagcgggcgaggcctctcctagtccctgaccacctgggatcgcgtttcttggcctgggccgggtggaggagctcccagttggcacggcctggaatgacgcgaccccgcagccgaaggggacttgaaaatttttcctaaccaccgttccgctccgagttactgctacctgctaggacagacctcccacgcggctccgggcctggcgatcttccgcgggaaccgggaacgtttccggagatccccgcaggccggcgccctgcctcggcttcccagtgcagcggggtcgcgggctccccgaggattccaaagttttgcggggcgcctgcggcgggagggaccctgaagttgaaactgtgaaaggcagaacgtgggtgaatcgcttttattctgtcttttcggagtgggaaagcctttctaaagcataaaataaacccagaagccatcaaggaaatgattgatcagcttgacaacataaagtttcacaagcaacgtcaaaagataacaaatgagtgtggggatcgcttatgcataagataagaatattgatttcattcacaatagccaagatacggaagcaagctaagcatctaccagtgggtgaacggaaaaagaaaatgtgatgtatgtacatcagggggtactatcccgcctttgaataaaaggaaatcctgctattggcgacaacgtggatgaacgtggaggccattgtactaagcaaagtaagccaggcacagaaacaaataccacttggtctctcctgtatgtggaatctgaaaatagttgaactcatagaaacggagagtagaactgtggctacctgaggccgggggaagggcaggagggaggagatgttgttcaaagggtacaaggattcagttagacaagaggaatatgttttagggatccacatgacacggtgactgtagttaatgcattttatatgtcaaaatccccaaaatagtaaattttaaatattctcaccacaaaaaataaatgtgttggtgatggatgtcttaattagcttaaagtaattattccaccaatgtatacatatatcaaaacatcacattgtatcccataaatgtatacaattatgatttgtcaattaaaaataaactttaaaaaatctttttaaaaagatttcagcattatttactataataacaaaaaaactggggtgggggtaatagccattgattaagaggggtcaggttaaataaactccagtacatccacaccatacactgtgtgaatttgttttgtttgttttagatgagataaatgttgatgatgaaatgttaaatgaataatttaaaacaagtattaagttacctctatttcaacacattaaatagctagtaaagactgtgtggtgtggacagagggatatgatctacagaaccgaaaagagaccaaaacaaatgcacccagctggtttttgacaagcatgcaaaagcaccttgtggcaggaaaggtagcctttccatcaaatgggagtagggcaattgcacatcacaggcagcaaacaagcaggcaaaccaaaacccttgacctagacactgtcaactttagaatcccaggcccccaccaaatgaatggaccccctcttggccaaggggacctcaggaaaatcttaaaagtttagttctagtctgcctggggtgggaggtcaaacatgcctcattataccccctgccttttggggtttagaccagcattaatgttaacatagagatcagaagactgacagaacagactctgtggcaataaaataccaagttataaacaggacctaaggccatgccaggcaagggttaagtcactaacactacgcctaaagaataaactgtgttccaaggaccacaaggcttttgtttttctctggcagctaaacaaccactggcctcaagatagacaagattaaaacaatttccagctccaccacccactgacttactaaacccctgctctaccagccataacttcctgataagaccaccaactatggattgtctttggctggtttacagaggctgcacacttgtgtgacttcatgccctgaaaagacctgttgacatataggacctaactgtaatacatttaaatgttaagtctccaccccaaagtgaacatggatcatatgctacatgcatgtctgttcaatatgcatgtgctaggaccaccttcatgaatattcatagctcctcctataacctgttgaatatgtatgtttagccaacctgcccagcataaagctcctaccctaacccctcctccttcaaagtgccgtttctggtcccttggctgagatggccaccttaaaggctgtaatccttatgagaaataaagtctcctcatgtttctaaatggataaattgtgggggttttaccctcacacctcatgcaaacattgactccaaatggatcacatatttcaatgtaaaatgtaaaactataaaattttaggaaaaaaaatcttagagaaaattgggatttaggctaaaaaatgagattttatacttgacatcaaaagcatgattcataaatagagatgggtaaattggaagtcatcaaaattaaaaccccaggctctgtgaaaggtccctttttttttttttttttgagaaggagtctggctccatagcccaagctggagtgcagtggtgcagtctcagctcagtgcaacctcctcctcttgggttcaagcaattctcctgcctcagcctcccaagtagctgggactacaggcgtgcgtcaccactcccagctaatttttgtatttttgatatagatggggtttcaccatattggtcaggctggtcttgaactccagaccttgtgttctgcctgccttggcctcctaaagtgctgggattacaggcgtgagccaccacacccagctgaaatgtccttttaagaggaggaaaacaaagtatagatcagaagaatatatttacaaaccatatattctacaggaatgtgtaaaaaaaaaaactcaaaacgcaacggtatttttcttcaaaatccaattacaaaattgatgaaagacatgttaaagtatgccccctgcagaaagacaaaatgactcccaggagactaactgagttgctcaaagttaaaatggaaccaggcggctgtagctgggtgacagagacttcatgtactctgtgttcttagaaagatgttataaaagtatcacaagacctcccttccacaaccaaaccaaaccagttcctgttgtcagtgtcaagataactgtatccggagcaccacttccctggacccctgacagccatttataagaaatttctgacagtcttctgcttaaggcttaaagaacaacaagtcagaactcccctgccctgactaatcaggactcaactgcatcaatcagggttcacctggatcgactaatcaggattcagctacatccaccgatcaggacagcatgagtttcagtccttcatttacataaatgaaagtagttggaaacctggacagaaacttttaccatagagcccaaaccctttcttagttttctagaacttactttccttttacactgaaggctgcaacttccccatttacaaactgttcactgaaataaagtcactttccacattccttttcagaaaacttagctcacagacacgaactagcatttcactgagcaggacgtacagatggcaggtcggcacatgagaagacgttagccttttgtgggagtgtaaattaaaatgacagtgagacgtcatgacacatccatcaaatgccttcaacaagatacaggaacagcatcaaatgcaggtgaggctgtggaggaacgggctttctcacacattgctggtggtaaggtaatattgtactgccactctggaaaacagtgtggcagtttcaaaaaagaaaacagcaacaacaaaaacatgcaagtgaagcgtggcagaatatgccaccccaaaatatgccactttagcataagggttattttgagctaaaggcacttgaaaaacagcagacacaaggaagatgccctgacctcccctttttcttcctgaaagtaggaggtgaatctcccatgggaaaggtgccctccctgtaccaggaggaaggaagcaattcttaccaccagaggcagggagttggggccgaggggaatctgtacaaacaaatctcgttaaactaaccctcatctgcctcattacttctccacgatgaactgccctatcccagactccattgtcttcaggttttcacaacttactctttgtccaacctagtatataagtgttcaggcctaactgcttcttcggatctctttttcctacagggttccattcacatgtgcaaatctgtgtgcttttctcctgttaatgtgttttatgtccacttacctcttaggcccagccagaaacactaacagtagaggtaaagttttgcttcccctgcataaggaccatgtaacccagcaaccaaacccctgggcattcaccccagagacaggggaacttgctgtgcttgaagggttgattcagtgcctctggggccgaggactccccctgacctctgaccctgggctacagcaggaattagaatatttcccagcctgaaactcctctttcctcaacttcagtcaaccagacaccctttgtggatggaaaaatctcattcagtgtttttataacaataacaaataataatggtaatcattacaataatgatgaacaacagcaacaataactattattattattaaccttgggggatgaaagggtagggtacagacctccacaatgctcctggagaatgaccacctactcctgctgggtcccagggtgggctggggtcagagtcccaggtttgcacgtgcaacatgctctgtgaaggcaaggggtgagcagcaggaggaaagggaaattaccctaacagggtgtggcagaccagtgaggaccctgggaggagaaacaggggagggatgtgcagggagagggacccaggtcgggcacccgctgcctggtcagtgagctgccaaagcttcctccacaagtgctggactccttgtccatgcctgcctacccggcccccggccagcaaaccgcgggcaccagctcatggtgcacagaaatatgcactccagatgaatcgcacacctcgatgttaaacgtaaaagagaaaacctcagtagagaatgctaagcgtttgtgtcccctggagaaatgttcttcagtgtggcacagcagaaacccaggtggtcagcagccccatctggtgtggtgccagggaagagcgctgacttgttagagcagcctggagttctgcctgctgcgatccatcacggcggcctctgcatctgcagggtaaggccttcaggtttagcactgcaaacccaggcatttggagtctgttgggccagtatcgctgctcaggtgcagatgggccagctgacttcacctgaattgtagctgccagccttcgtgagaagtgggggcgcttctgggaccggccggctggggcatcgggtgcaccatttctacttgaacacacgtcccccaggcacttggggcccccaacacggaaagcggccatgaggtgctgggcctccctctggctagggggagcaaggagacagcgagtgtggcagccaggactgggcctcagtgctcccagcgggtgggggtgtgacgggtgtagtcaggccaggtctgtggggaaggtttgtaggactggggctgggggctagccttgagtcctgagccacccaccagtggcaaactgcagttttgcagaggttaagcctccggcacctctctaaggcagctaggctgggacaggactggcaacagcagcaccaacacctgtgtgtcctgagcagggggtactgcactcaccggctccaaccagcaacgtcattaacgtttttctccactgtgaggatcatgcaaaccctaccagtttgattccaatgttttttgaaaaacatacttgaacacagagctgggagttttgacaggtaggctttaggagctttgtcaccaccaccaggacacagggatctcccggcaaggtgctcagggacctgtggggcccagaggccagggggctgggagggcctggagtggccagcagggaggctgcagagccatgcctcctcctcccctaatcaccccagcagaccttcctctgagaagcagcagaccagggagggggcatgtgtcattctctgccagtcactttcttctccactccaccacctatgcatttaacacagaaagtgcatgaggccacgctgtctgcagtcagccaccgccactgctccatccaaggactctgcactggaggccagcaggatgccctgggcttcctgcaggggctaagccatgcatgggtcccagtgcagtcaaggccccaaggcagtgagaaaggttcagcctggaggtgggtggttaggcataggtcctcgagagtccctttaaggtctcaatcctagtatcgcgtggggtcccattgctgtggttcaaatttctcagtctttcccttgattttgctggttttgcctctttacagattatttccttttgggttttctctacttctaaagaattttttgttgtaattatttcagacactgcctgagaattgagattttatggttttcaagagttacggttttcaatacatcttcatgttccctcatcctattctcctagaagttggctctgtgctgttagctgcctccacacatgtgcccttcatttgttaggactcaagtgtcacatctgaaatgggggctagcaaggtagatctgcaagacctatcccttggttgaagtagcaagccctggagtggcccagcaggtgctgataagctgacctgtgagagactgaatatacaatgacagtggctagactacataaaaaatcaaactctgagccataatctgcagcaaccagccccaaagccagcccgagatctgcagccacagcccaggaagccagcccgttagaagtcagatgtgcaggaagccagccctctagaagtcagacgtgcaggaagccagcccgctatctccagtcaatccagggagcttaacaccgccctgtaacaatcagcccaagacagtcagaacttgactaataacagcttccctaatttttgtcccggcttccaacttagaaccaaccagaaaaagtgaaatctactgccctaaccgaccacacaggaggccccatttctggtcggccaccccagtttccccaagccaacagcctccactcggagtgcacctggagcctcccctttttccactgtgaacctttcccatcctctgcctgcctggaaatttctaccaaaatgcaactggcgatggctgactcccttgctggggcctttgtgtctctcatttgagtggtctttgcttatctccatgctgcttgctatgctactacggatgggcatttcctgcccatccacgaagatttcacgtgcgtgcctggggtggcagcatacccaggtgcatttctcctgcctcctccttctctctttatcccgcagtcttcctcctcacccagctagccacaggtgtccacatggagcacagtctgaggagagagcagggtcaaacacagccaggttctaggtggagctgaatggggtttgacaggtgccaggtgctcccccagatggatctttacatcataaaaacgattttgtgcttgaagatgtggcttcagatccaccaagcataaagtcaccacctgaaattagaaagaaaacatccaataaataggccttcttcactccagcaaccctctccccatgtgccttctgaagctcctgcagcaagcctgcagatgggttcagaaagtgtttccaagaggagcaccacacagctctaacagacagacagacagacacacacacacacacacacacacacacacaccgagtcaacatgagggtaagaatgaggagagtgatggctgcagtgtctgagagaatttagtctcaaggattaagggaaggctccccaggcgagtgggaaaggtgagcagtgttcggtctctcagaggcgtggatggaagtgtcgtccaggcagaagacaaatgcacaaggcttgaagccggagcaaacagcttccatatgcaggagtgaaaatggcaggcacttctatggcaaatccaagagtgaggcaggagggttcagggcctagcatgccaggccagtgactttgtggaaccagcaaaccaagctaggcaaagtgtggcatgttacttccttataatatttttaattagaatcataatattttctctttaatgcaaagaataaataaattcttaaataatacctagcccaagggccactatccagagacactcaagctgccagaatttttaatgtatctttcaagaaatattttctatataaacagaagcctgagatgtatatgccattttttgtggtctcttccaccaaaacttcctcaaatgtattaagagcacaactcttgaaaacatgttcccactgaaacgtgcacacaaacgttcttagcagcatcattcattatagccaagaagaggaaacaacccaaatgttcactgactgatgaataaacaaaacctgctccatccacacaatgcgacattcacacgtgaggaatgccgcaccgtggtgaacaccagaaacagcaagttcagtgaaagaagcccgtcataaataactccattcatggaagtgtccagaataggcaaattcgtagaaatagaaagtagatgagcggttgcttaggtctggaagggatggggagcatcctgtcaggatgccgaaaatgttctgcaattgactggataatggcttcacggctctgtgaatatgctaccaaccgctgaattgtacacttcagtggtgaattgtttgaaatgcaaatgacgtctcactaaagctcttattaagaaatacatgagttgatggcagatggctatcaggattatgagggtgacatctcaggggaggagctgtgtgtgtggaggtgctagaactgcacaggacatcagccattaaagggtcctctgatctaaaaataggaattgtgatctgagtaattaatgagacactggctgtcctgaatttgcagctagtaaaaaagttgtgagtcaggaacaagcttggtttttccataacaggattttggctgctgtataagagaattggctggaagaagcaccattcacaagcacttactgtcaagaagcaagaagcacaaagcacttatcatcaagtaagaaggacaggactcccagtaagggggtagcagagagatgttggcaactggacagatgcacaatacacttgggaggcgacactgacagaacatgtctctggggacatgcaagaagaattaggtaaaagcataggttatatcagggtatgtcaaaaacagtgacaggagcaaataaataatctaaattgaggaatgctgatttgagaattctcagacatggattactgatggaaaagccaaactctgtaaaatatttgaaagaggtttactgtgagtgaatgagtgaccgtggcctagggaaacagtctcagagggcctgaggaagcgttcccgaagcggtcaggttacagtttggttgtatacattttaaggaggaaagagttctaggcaaagacataagtcaacccacgcatggacggtatacattggtgtgacctgaataggtgggacatcttgaagcaggggtttaaaggtcatagatggattcagagattctctgatttgcagttggttaaaggagtgagctctgtctaaaatttgatgtcaggagaaaggcatgttttaagttaaggatgctatgtagcaaggttgatggcctgcaggcctgaataaacccttgcctggcatggccttaggtcttgtttataatttggtcttttattgacacagaatctgccttgtcagtcttaagatctctaatgttaatgttggagagttgcacctaaactccaaaagggaaggagtgtaacaaggcttgggatccccttggtcaagagggggtctgttcagtcaatgggtgcggcttaggattttatttttagttcataggatggatcagattgtttttcttttgtgattacaaataaggctgaggccaagcatagtggctcatgcctgtaatctcaacactttgagggttgaggtgggaggatcgtgtgagcccaggaattcaagaccagcctgggcaatatagggggacctcgtcgctacaaaaaataaaaaaaataaaaattagctgggcataggagcccactcacgtggtcccagctgctcagaaggctgaagcaggagaatcactggagcccaggatttcaaggctgcagtgagccatcgttgtgccactgcactccagcctaggcaacagagtgagactgtctcaaaaaataataaataaataagcaaataaataaggctgaaatgaacagcctcatccatatcttttcatgaacacccaccaacttttccctccgaatagctttctaaagctttcgaatagcttatttttaagtcatgcaatgacttgacaaattgcgtgttaggaagcctgttacgaatttagactcctgtgctattttgaaatagatatttggtcttcatccccatccccacttcctggcaaaaagctcctaaaacccttggaatctgcagagtactaagagtgtcatttgtgtgctaatgaaatgactggtggctggggaccctagacagcttcaggatgggggctggccaccagaaagacagaggtgggattagggggttgggactttcacctcacttgccaacatctggggagaggagagggactgaaggttgagctgatcaccaattgccaatgatatggtcgatcgatcatgcctctgtaatgccgcctcagtgaaaacccgcaaggacagggtttgaagagctcccagatacctgaatacatggagcctggagggcggtgtgtctggagcaggtgtgggagctctaagccccttcccagatgcctcaccctgtgcacctcttccatctgcctcttcattttcatcctttgaaatatcccttgtaataaatgaataagtgtaagtaaagtgtttccctgagctctgtgagccactgtagcaaattaatcaaacctgaggaggggatactgggaatcctgatttgcagccagttgggcagaagagcaggtcacaacctactacttgtgactgacatctgaagcggggacagtctggtgggactgagcccttaacctgtgaggtctgacactgtccaggtagagagtttcagaatggaattgaattaggagacactcagctgttatctgctgaaggagtggttgatgtggagaagtctctacacattttagtgaccggtgatcagagaaacacaattatcctttggtatcttcaaatggattggtcccaaaactcctcccctggaagggttttggtgatttggacaccaaaattactggctgctcaagtcccttatataggaaagtatagtatttgcatataacctacacacatcctccacatgctttaaatcagatgtgtccaatcttttggttttcctgggccacattggaaggagaattgtcttgggccatacataaaatatactaacactaacaatagctgatgagctttaaaaaatcacacacacaaaaaaatcatatgttttaagaaagtttacgaatttgtgttggagggtaggccacagattggacaagttgctttaaatcacctctagattacttatatctaatacaatgtaaatactatgtaaatagttgttatattgtattgttcagagaataatggcaagaaaaaagtctgtatgtttagtacagacacaatcattctttttttcaaatgtttttgaatcgaggttggctgaatccatggatgcagaacccatggatatgaaggagtgactgtattctgtgtggaatttatgctgaatgggttggcagaacatacatattcaataagctataggaggagcaatgaatatttatgaaaggagaaacgtgaatgtgtcattgagtttcatgactcttcatgggtcatgtgttcatgggagggtgtagtttttagcctctgacatcaaaaggcgaaggaggggccaaaaaccactcactgtgcatcctctgtgagccagccaaaactggtccagaggcagtggtccattttaggaaggatgcactgtgaagctggtgactgtcactccaaaactacaaagaggtagggcgagtccagccacggcctcagatgattggctaaagatgataaaggaaggagtcctgtgtttcttgtttaccagagctggtttctgcttactccttaggaaagagttctggctaaaggttaatatggaagggacatgctgaagtctgtctgaccttgcatcccgtcctggccaggagctcagtttttaagatttctctggggtccctttggccaagagagtgttctatcagtcagttggggaaacttatgatttaaactttattccttgggtcagtttaatagaccttgcaactttaaaataagcattatcaggtctaagaactcagtgtgtgagcaccactcaagcatcacaacctgctgccaagatgctaaatgttgtaagaaaattaataacttaaaggcaaaaactgacctccatgaagatgaaaagtctgatggcactgtaactctagagaaaggagcatgtgtccccattgaggggaaggcagcgtccatttcagggcacactgcaggcatgtcagggtgtttcaggagtctgccaggtgtcctgtcttgtcactcgagactccagcccagggacagacagaaaaccagaagacagcacctcctggccaggatcccagcatccatttgagggagacaagatgagaagggacaatattgttgtagcaaaaataataggttctccacttccttacataggaggaaattcccacaccttgataggaggcagttccccttcctgcccaccttggcacaggcggtcacactccccacctgtatgttgagggactgtgcaagagggcagcactgtctgagttgggacatccacaaccccctgctcctgcccacccttggcttgagtgctggcgacggcaacgtcccctctcagccctggcctgaggtcctccacccttcttcagttctctctctcaggcctccatcatcccacagcttttcttccaatctctcctcttttttctttttgatgacgtttcaaaagagtcagcattttggaagacaactgtagacttgctttcaaatgcagagcatcagagagccatggtctgcccacaggtggcctgcagcagggcagagctgtgcctctgatggccaagggggaggtcacacttgctgcctctgtcctccttaatgctcctgtgacacaattagaacaaagcctgactgccgtgatgaagaagaggtgaactcatgctggtgggtgtcttgtccagagcacgtcagccaccccgtgagttggcagagccaatgggcagacacacaggatgaggttacaggaagatgctctcctgcagcagatccaaggagacagagaccccagcagatggcccgagaagctcccacctgcacctccagcatcaacaggcagacagagaactcctgttagaggggatgaggcaagtctgggacccttagaagactgcaggaagagctgcagatggtgcgaagcaggttcactaatgaccagtccaagggaggcctcccattgcatggagagcagcagagaccatcgctgcccctcccacaaggagtagttggtctggaatatttgctacttacaccttatgaatctcccagttactcgttggtgtgcttttaactaacatgagaagcagggactgggctgtttgttgagtattatgtcttgatattttttagttcagttgtacatgttagtaacaagggtaggggtgcagggtgtcctcatgcatggctgctataaaggtcatgagcaatcaaaaatagaaataactatttccattaattaggatattattgtaggatgaaggtggagaatgtatgctctgaacatgaaaaagagggcttggatcacagctctgccttctgatattttgtttgtttgtttggagcaggtgcttgatcctttaggtagaaagcaagcttagtgaagttaagtgattgtccaaaatcatgctgcttcttaccagttggctagaattcaaacccgagctgacttaaataagagcccaaatttacactggttatgtgggagaggggttgcttttgtttatttctcattactgtgaaaagacatcttatactcagtagaggatatagagtctatttttatactctaaaaattataatgacatgcacatgcatgtaccatcacccactggagacatgcaccggtccacctgcctttgcagctctcatttcacattccagccgcctgctacactcacgtcagcggtgcatagaagaacttcggttatttctcgtgtgagagttcaccttttgcaaaggctgacaggaagtggatgatgaagaactgagttttatgtaaaggagagggagaggtaattgatggatcatggctgagtgcaccgcagggaggaaggatggagggcacgggtggaggggaaggtcatcatggcagagacggggacatctcagatgagatgcccagaggtgtaacaactctgataggaagctgtgctgtgtgccacatgcctctgcaggctgcagaccagtttggatcttactggtctatgtatcaagatatggagtgagcttaccctctccagactgcaattcctgtgagtttctctcttctccttggaatctgagtttgttggttccagagtagctttccagctggggatctggggtgagatttcaccagccaaaggctgttggaaggcaaatcaggatgttgggtatgggctgggctaactgcagggctggactgagcactggaccctcagggtgtcacccctggggcagggtgggctttgggaagaacacagccctggcaggtgcccacctctgcctagtttgtgctggttgctatgggagtgaaggggccgccaagtggtagctccaggtggggctggccctccaaattccaggcctataatttatctggcacatataacccctcatttgaggcttaatttgtttccaaagccttgagtttgagagatcttacaaaacttttattttattgtcatcatattgtgacaagtgaagacatactccaacaaaaaattgaggataaactccagtttgatgagtttttcctccttttggtgtgttgatatcaaggacgctgttagacataaggattaatatcaggtctgcttttcagacactgacgcagccaggagaagggggacatggcctccacagagttgcaggtggagcttgccttgcagcaaggaatcccaggccaaactaagcagggcaagcagcaccattgagtgtcccactgcgtgattggtttcatgtgttgaagaatctacagcctggaaaacaagtggcagaaatctgaatggcagcatggtcacagacactggctggctgaggacttcgagactgttgtggtactttctcaaggcttctgttcccttactcatcaattagagttgacaatggacactgatccctgtctctcctgtggattcactgctacctggagtcaggagaagggagcgggaagcagtcaaatcctttagggccttagttcttgtggaccaacatgttaacaagtgcagctgtcccaagctctttgttactgtggtaggcagagcaatgcccctcaaaagctgttcccatcccaggccatgaaaccagcgaccatgttacatatgtggcaatgaggatatgcccctgcattgaggtgcggctctggagatgtcctgtatttcacaggtgggcccaagatgatcacaaagttcctaaccagggaggcaggagggccaggtcatagaaagagaggtgggcgtggaagcagaggttggagtgatgtggctgtgagctggagaatgtggacagcttctagaagctgagatggtgaggaacagtctccccaggagcccccagaaaggagcacagccctgcagacaatgtgactttagccagacagacccatttgggatttctcgcctccagaaatgtagcacaaacatgtgtggttttaagccagtttgtggtattcagccacagcagcaatgagaaacagacataacttccgtgtgattccttgacaggccacgtggctcaggactcctgactccttcctggctttgcttgcttgactgcaagacacagtagggctagacacctgctgcggtctgagtgtggcccccaaaagcatgtgttggaaacttggtccccagtgcaacagcattaagaggtgggaccttttattttttaaaataaaaaggttccatgaggaagagctgaagtaggtggaatctttaagaagacgtgattaggccattaaaactctaccctcgtgaatggatcaatgcccttatctcgggagtgggttagttatcatggtagtgagtacctctctctctctcgctctctctctctctctctcttctctccctccccctctctttgaccttccaccacgggatgatgcagcaagaaagccttcccttaccagatgtcagcatcttaatactggacctacaggtctcaagaactgtgagacataaatttctttataaattaccccatcagtgtggtactctgttgtagtaatacaaaatggactagacaacacataatgttttataaataaattgtatttgtgggatgcttttgtctttctaatctctccaacaaaagacaacttttgcaggcccacttctgtttgcaggccctctgaaaagccatctcaaaatatgccaaagtatcctttttctttttttccagagtccttttttccaatgcaccaaagtatattttgagataaaatatctttggttttctccgctccccactttgaaacttcaaatgtttcacatataaaaaggcaagttgatccctttggagagatttaggttagagtttgttaaataagagacaggcaaagaagagaaatgacaaatttgaatgagcagaaaagaacaaatttaaatattttgtctcagatcttgggacatttctatggaaacagaagaaaaacaaaggttaatgtctggaatagtgtatggactagtttttccagagtcgctgaagcatcttcaaattgtagtggtaatctgacagatttttctgggtattagttggaatcaggtgttccagcaaactttctgagtagtctatacatcaacaggtacaaaggctgtttacatgtaaagttgctacagtgatttctcctaaagtttatatcaagttttctagcatcaatttgcagggctttaagaaaagcacagtttttttatttctagtgattccaagtcagaaaaatgtgagaaaatgtgagaacattagcttggagacttgtagccagaaaagaattcagaattcagtcccagttgtagacaaataataaaaactgaaaaacaatggacagggctagagtagaatagtgggtatactatagttttcttctgaaacataacttttctctccccagttccccatttctaacaaagacaaatcacaataggaccaatttatttgcaaaataagttttcattttgttataattggcctgattgtttgaataaagtacagaaaaggtggtgattggccattcttttaagttggccttgctggaactttttcataaggaatttcagattagacttttaaaatcctctaaagtctaggaaaccaagccaagtgtttgccatcagactgtgcctgtaatgcctgtagaaattcggtgaattcctctcctcttgaggtcccaatatatcttgaggttcttgggcccttcagaaagtgacattctatacttactccaaggtacagaaccttgtaagggaactgtgtagacaagatacctggccagtctttctgcaaggatttttattagatctataaaatcaactttagttctgctgaataggctcatcatatctgaaaatatgccattcttgtcaaaaccttggtaaaataaccagtgtctcaattttgtcctgttatttaaaaaaaaaaaccaattctcactgagcttatgcaaagaactatattgacataaattaaaaatacttacaaataatttccaaattctagagaaatctgatagagagataaatgtttcaattttgttcaattgttaaaagctatagatggcttaagagaaaaaagttttcttgattctggaaatcaaagcatagaaagaatccacaatgattcaaaccaaagagtcaaaaaaaagttttcagtcctctatcagttcagtcccatgtaattaactcttgttctgcttgatattgggttagcaatcttcaggaacccatcaccttttcttatcagagttctggaagtttttgcctattccaacggtatgatatccaaacttaccataaatctgtatccaagagtacttgtcaaggactttttggtaaatttccttaaagaagaagcaagctttcgactatagtaaatcataaactgctttctgagaagagtcaaagtagaacaaaaattatctgtggatgacaaaagacttaaaataaccagggttagagaaacaattgacaaggaaatttggttatttatgtgacattcagcaatttaatataataatcataattattactgataacacatatgaagacatatcagaattttagtaaccccattccatttaggaacacatattaataacacatttttataactacaactcaaagacatttaaatacaatttttttatgtggccagtctttccatatgatttttgcataccaaataagactaatatgtccctcttggacttccaggagttcttcatgaaaatacttacttttataatttgaaattagatttttggaagttttccaaatatcaacagtttaaaacacttgataaaaaaaacaggatgaatcacaagcaactataaagtaatggtcattcattagtgatgattaccccaagtgataaagattttaaaaaccaaaaacttttactccttgatagaaaggagactctgtttcccaaataatcaaaagacctaatgaagacagcatgaagcaaacaaaatccatctctcccctcttttttgtgcagtttacttacaaggaaaacaaaaatcatttgctatctcttattaatactacatgaaaatagtgtttaaaagagaaaaccaaattctacctttgcaacagtgtattaatgctaaagctaattttaataaaatcttataaacagatcccttcaatctcagttttgatcacataaaataagattttcataaaccttttataacttcttgcattttttctatttttttccccagctgtccattcagttgtatgactttaaaacacctaacagagagaataaaaatctacctaattagacccaggcaaaaaatgtctaaattaaattctgaagatgtttctgttttatttacttttctttttatttatttatttatttttagagacagggcctcattttgttacccaggcttgagtacagtggtgcaatcatagctcactgcagcctccaactcctgggttgtagctgagatgacaggcatgcaccaccacaaccagttaatttttttttttttttgaggcggagtttcactctgtcacccaggctggagtgcaatggcatgatctcagctcaccgcaacctccacctcccaggttaaaatgattctcctgcctcagcctccctagtagctgggattacatgcatgtgccaccatgcccggctaattttgtatttttagtagagatggggtttctccatgttggtcaggctggtctcgaactcctgacctcaggtgatctgcccacctcggcctcccaaagtgctgggattacaggcatgagccaccgtgccaggcctacaaccagctaatttttaaaatttgtttttagagattgaggtcttgctattttgcccaggctggtctcaaactcctgggctcatgtgatcctcctgcctcagccacctaaagtgctgggattacagatgtaagccaccatgtcttgcccttctattttactgtagcaataacttaaaaactatctttatgactccgcatgtagtgcatgcctttaatctcagcactttgggaggctgaggcaggtggatcgcttgaggccggagttcaacacaggcctggccaacatggagaaaccctgtatctactaaaaataaaataaaataaaataaaatgccaggagtggtggcacatacctgtaatcccagctacttgggaggatgaggtatgagaactgcttgatcctcgaaggtgaagattgcagtgagctgagattgcaccactgcattccagcataagtgacagagtgagacagtctcaaaaaagaaaaaaagaagggaaatttctgttttttttggagacagagtctcactctgttgcccaggctggagtgcagtggcacgatcacagctcactgcagcctcgactacccaggctcaagaaatcctcctagctcagcctcctgagtggctgggactacaggcccatgccacaacacctggctaatttttgtagttttgtagagacaggatctcactttgttttgcagtgctggtctcgaactcctggggtcaagtgatcttcctgcctcagccgcccaaaatgctgggattacaggagattgtaccattggatcttttttttttttttaaaaaaggtaccccctcaagtggctcaccaaaaccagtaaggcttaatcaagattatgacttaaccaaggacacatgaggcatctccagagaggtgcacagcagtcctcaccagatccagaaccacctcaaagagagctcaaagaagggaaagttttgctagccacaaatggggtatgacccacatctgccagccatatcttccagggtctcagcctctcagctgaccatctacacacaaaagcctaagagccccgtgtaatccctcaaacagaagatgccagaaaaccaacagctgtctatggaagaggaaaggatcaatgacaagtgggtaagccacaaagtcaaaagtcacacaaatatcaaaccaaaagcgactggcttcccaactgggacctgcacccaggccatggcagtgaatgtgtggaattttaacaacaagactgcaaggtggggccaggtgcagtggctcacgtctgtaatcacagcactttgggaggctaaagcaggcagatcgtgaggtcaagtgattgagaccatcctggccaatatggtgaaaccccgtctctagtaaaaatacaaaaattagctgggcgtggtggcacgtgcctataatcccagctactctggaggcagaggcaggagaatcatttgaacttgggagttggaggttgcagtgagccgagattgtgccattgcactgcagcctgggtgacaagagcgaaactgtgtctcaaaaaaaaaaaaattgactgcaaggtggagtggctggcactgcagattccacaagggacccagggcaggcatttggagcatatgaaggattttagctttgtttcaggtcagacttttgctctttaatctcatcaagaggatttctaaggcaagccatgacactatgatgtgtcttttaatttaatcttccaatgaatataaataaggcagttgtttagaataagaaatctttaaactattttttgtaatttagaggtcttttcaacttaaagaatccatcttttggccgctaatgactagaatttccaataatgttcttattctaacatcaattccatcccacagcctcttcatggaaagccccggatgtggttttctaggcttagagtaggttattaccatttaagaaagacttgtttcctgaagagggcatagaataggcagttccaaagattcctccagtaaaattcactcctggaaacaggctcagatagcaagagacttcttttttattttaactcacagtttttattgattgaagtaataaaataaaaattagcaccttagttcctatttcttgtctattgtttttctttctttttaaaatttaattttatttaatttagttgtaagttccaggatacatgtgcaggcatgcaggtttgttacataggtaaacatgtgccatggcggtttgctgcacctatcaacccaccacctaggtatcaagccccacatgcattagctatttatcctaatactctccctccccaccaccaacaggccccagtgtgtgttgttcccctccctgtgtccatgtgctctcattgttcagctctcacttataaatgagaacatgtggtgttttgctttctgttcctctgttagtttgctgaggataatggcttccagctccatccatgtccctgcaaagcaacagactcttgttgccacacatggttaggatggtgtttgtgtgcacagtgcctctggtgacccacacatttctggggacacccatcacagaccccttaattcatgacactggacagctctcctaggatggaactttcccaggactaaccaggcaacaagggccagaccacaaaaattccttatggatgggacttcttattaagacaaacattcccaacagctggacacattcagaacaaaaagtttgctgcctaaaaccttgtatctcaggttcccaggcatcttcaggctaaacacctgatgggacccaaaaatcacaccccagatggcggaaacaagagacagtgctcccacttgtcacaagtcaaacactccagggcataaaacaagatgagaggggtcctcatctggcttctattttgtttttgttgttttgagactcagtctctcactctgtcacccacgctggagtgcagtggtgtgatcttggctcactgcaacctctgcctcctgggttcaggtggttctcctgcctcagcctcctgagtagcagagattacaggtgcctgccaccatgcctgcctaatttttgtatttttagtggggggggggggtttcaccatgtcagccaggctggtcttgaacccttgacctcaagtgatctgcccacctcagcctcccaaaggactgggagccaccgcacccggcttggcttctattttgaggacccacagcaaagtttgaatgcccatctgatcacagccacagactggctgctcttcaggtctggcctgaacaatgggctggcaggatcttcagcccccattctaccctacaaggccccttttcaggacagaacaacacaggaagaccaagacagacgagaataatcctcccggaaggaagggctctaaacaatatgagtattcacaccaaaaagtacaccagagtcgctgcacccaacactgttcacacagatcctttctcacactaatcaacatcttgcagaggaaaaacgactgatttttaccatctgctcacccagattccacagagagaccggccaggagcccggctggtaagaatttcttacccttctgccagctcgtcaggtcctgggtcccctgactgaagcttccagaaaagcaaaacagctttggtattctgttcaggacaccaaaactgtaggggccaacagaaaacctcccctttgcccttgaaagtttcactgaaaaatcaactcacaactcagattaattagagaaatggcatgcacatttattaatgtgcacatggagaaggaccagagcaatgatcccaaccccgcagtggtgtgcagaagcttatttaccgccttgagactacagaaggaacaggggctgggatgatggcaagacaggttagaggagagggaggaggaggcctggctcgcaaaggtggtctcagaatgcagacagaaccacacagacagcagtcctcagagagaatagatggtaaacatttctttctgatggctaaacatgtcagactctgagggactccttcctagatccagacaagggaaggcttcagaggaaacttgcctgtgtcagtgtggattctctacagatgcaaacgttcccctcaaaaggcagctttgcagggtggcctctgtttgaaggcccctctaaagagccatctcaaaatatgtccaagtatatagtggggtgaaatattttggtttccttcaactacatccttactacttaattcaatgcaatttcccttagccatgaactcttcaagtctttttttgcctgaaaaggttttgattgaattcataatcttgagtgatcaccatgtaagcagataaatattggttgacagttatatttcctcagtatattaaagaaacctggctcggtgcagtgactcatgcctgaaatcccagcgctttgggaggccaaagtggtgggtggatagcttgagctcaggagtttgagaccagcctgggcaacatggcgaagccccatctctccaaaattacaaaaattagccgggtgtggtggtgcatgcctgtagtcccagctactcgggaggctgagatgggaggatcccttgaacccaggaggcagaggttgcagtaagctgagattatgcctctgaactccagcctgagtgacagagtgaaactctgcctcaaaataaataaataaatctttccatggttgtgtgcatgttgagatatctgtcttgcctaaatttatttctctattttttcctatcttttattttgatgtaatttcagacattttaaaagtcacagcctggtgtggtggctcatgcctgtaatcccagcacttagggaggctgaggcaggtggattgcctgaggtcagtagtttgagaccagcctggccaacgtggtgaaactccacctctactaaaaatgcaaaaattagctaggcatggtgggcggcgcctacaatcccagctactcaggaggctgaggtaggagaattgcttgaactcaggagacggaggttgcagtgagctatgattgcaccactgcactccagcctgggtgacagagaataaaaaatgaagagttcatgtcctttgtagggacatggatgaaactggaaaccatcattctcagcaaactattgcaaggacaaaaaaccaaacaccgcatgttctcactcacagatatgaattgaacaatgagaacacatggacacaggaaggggaacatcacactccagggactgttgtggggtgggggaagggggcagggatagcattaggagatatacctaatgctaaatgatgagttaatgggtgcagcacaccaacatggcacatgtatacatatgtaacaaacctgcacattgtgcacatgtatcctaaaacttaaagtataaaaataataaaatgaaactaaaaaaaagagttgcaatagtagtgcgaaaaattccatttatgattccttcagattcctctcatattaacattcaattacatttgctaaatgctcttctcttggtgcagatgtagaatattatagctattttcctagaccctgtgagagtcagttgcagacatgatgctcctttacctacaagtattgagcgtgtgtttctgaaaccaagggcagctcttacattatcagagttcagtgatcaaaaacaggaaatcttcattgacacaatacaattctcagaccttcagatctccttcagattttgccaacggttccaatattgtttttataggggaagaagatcctgaaccatgccttcattcagttgtctcatctggaactgttctgcaacctctttgatttcttgatattgatgtatttccagatacaggctagtcacttaatagaacatccctccatttggttgcctgatacgtcctcacgttgagaatcaggttttgcactttcagcaggaacactacagaggggatgctgggctttttcagtgcaaccactaacaagaaacatgaagccagtttctcccctgctgtgagggtgaggtgggctttctccctggactgcaaccacctgggtgagtgtgttttataaaattatgctttctccactgtaaccttctcccatttccatttctgagtgcaaactatcttgtgggtggttacttttgagattctgggtctcttaaacactagttttggttgatttacttcagtatcacaatacttcagcatattatctactttcatttattcttggcactcattgtggttctggaatctaaagatcaatagttttcatcagttccagaaattccttagccattatccctttgaataggaccgttctctcattatctgcattttctcctcttgtaattattgtcaagtgtgttttgcatattctcatttcaattctccagtctcctgatgatctttcacagtttgcaaatctttattgctatatattctagacaattccacatatggatattcttataatttctatcatcatctgaggctaatctgttgtgttttaatttttaacttcactgatttcactattcacttccagaagtttcccttggtgtttcaaacaagcctgtcttctgtggtggcaatgtggtattttctagtgactgcagccattcttacctatctttaatccttttaaacctagttaaaagattgccttcttccttgttccctctgaatgttatcagcttcacattgctaaggtttttgaggtataattgacaaagtgaggtgtaattgctttattgaagtatagttgcctaagattgtatacatttaaggtgatgtgatgatcacagtgtgatgttttgatctatgtatatattgtgaactcattaccacaaccaagctaattaacacatctgtcacctcacacagtaaccttgtgtgtgcctgatgagaaccttaagatatgctctcagcaaatgtcaagtattattaactatagtccccatgctgtatattagattctagaacttattcgtcttgtaactgggagtttgtgcttatttatttatttatttatttatttatttttgagatggagtctggctctgtcaccaggctggagtacagtagcatgatcttggctcactgcaacctccacctcccaggttcaaatgattctcccacctcagcctcccgagcagctgggattacaggtgcacaccatcatgcccggctactttttatatttttagtagagacgaggtttcaccatgttggccaggatggtcttgaactcctcaccttagattatctgccctttttggcctcccaaagtgctgggattatgggtgtgagccaccgcacccagccagaagtttgtactttttggtcaacatttccccatcccctccactcccagcccctggcaacccctgttcccctctctgtttctgtgagttcaatttttttagatttcacatctaaaaacaggagttaggggagattgtgcaatacagtcaacccttgaacaatgtgagagttgggggtgctgacacccccatacagttggaaacgtgtgtataacttttgactccccaaaaacttaactattagtagcttactgttgcctggaagtcttatgtgttaatgtaaaccacagattaatacattttttatgttatacatattatacactgtgttctcatggtaaagtaagctagaggaaagaaaatgttattaagaaaaccataaggaagagaaaatctgtttactattcattaagtggatcatcataaaggtcttcatcctcatcatctttaggttgaggaggctggggaggagggagaagaggggttcatcttgctgtctcaggggagacacaggcggaagaggtagaggaggtggaagagaagaggcaggagaagcaggcccccttgctgtaactttttttgaggaaaattcacgtataaatggacccacacagttcaaacctctgttgttcaaaggtcaactatatctgcctttcggtgtctggcttatttcactcaacataacttcctctgggttcatccacagtgtcacaaaaggcaggatttccttcttttttagggtgaatgatattctattatctcattatatgtacatcacattttctttttccactcatccatgtgcgtacactgaggaagttcaggaaattccttccccgcaaccagaatatgccagtttgatgtgttgattgcttcaaactgagggcagtggtggaggagcaaatgcagggagggttttctgtggacctccctcatctgttgaaagacagatcttccaaagggaactcagctggcatgaatccccttcctgggaacctcatcaacaagggaagatttgttcatgtcacagcagcacagacagactttgtcactgctgtccctttttcattcttcattcttccggggatacatttatctttcccccaaataatttactctccctttggttgcctttgtcccctctctttctcccctttgcagaaaagtacataagcttccagcctcactgggtgttgggtttcacttttctttcacgtgatgcctcccgtgcccacatgtaaatttgtaagccttattctcctgttaatctgcctgctgtccattcatctcacagactcaattatcgaaccctctgagggtagagggaaagcgtttcctccccacaacacctgggttgattcagtatttcagctattgtgaatatgctgcaatgagcacggggatgcagacaactcttcaacaccctgaatgcatttcctttggatatatacccagtaatggagttgctggatcacatggtggctctatttttagtttcttgaggaacatccatgctgattttccacagtggctgtactaacttacattcccaccaacagtgtacaagtgacactgtactgtggtctgttataccctccttttctggctttcacattttgtctgtggtgcactcctcaaatgagttccgtggcatgccttgttcctgttttcactggaacatactgcacgctatgaggattatttcttcgtggaggcctggtcatacttggttgatgagcagaaggaccatttgccttttagaagcagatgtttgacttcaagtttaaaatcttctgtaattactgatcaaattaacatctccacaatactagttaacacttttcttaaaacgtcttttgtttcctaatactttttctacatttttgcacaaagttatttcattttaattactcttaatttactttaattttggaagtgagctttcttttcaacaatccataaatggttttttattttctcttttttcttgttcatattttcccaacattgtcccttatatatttccgtatagttaaccagatttatttcttatcaatctaatttgttttatattttaatcaatttatcgtttaccattatgaatttcttttttttcttactttttcttttgaaacagagtcttgttctgtcacccgtgctggagtacattggtgccatcttagctcacttcaatctctgcttcccaggttcaaatgattctcctccctcagcctcctgagtagcttgcattataggtgcgcaccaccacaaccagctaatgtttgtatttttagtagagatggggtttcttcatgttggccaggctggtcttgactcctggcctcacatgatctgcccacattggcctcccaaactgctaggattacaggcatgagtcaccacacctggccattttatcattatgaatttttgttctactttttccttttactttttttttttttttacagattttagtcttgttccagtttttgtttacctaacttcttcagttaaagttggcttattaaaatgttaaatttcttaggaaatggtaatctttggaggttaaaaagatttaaatttcttattattctcacaatgcacctaaaactatacagctacacattttttctcttagaacagcttctgttgtattctgaatatcttcttatgttgtactttcaatcctagataccttcttctctaaacttggtggatcttctgaaagttggagcagaatgggctttatagtttaaaaggtccactgctgtccagggatgtgaattctttgaggagggagttactgcacaaggaggtcgggagctgacggagtctgatgacaaggccctgggatgtaggagagggcacaaggcacagcaaagccagcctcactgcatgtccctggagcctgtgccaggtctacttcctggctgccagcttttccacaaatgctgtgtgcacctcacactttcagatcaggccgaaagatttctgtaggtcatgccaggaaagggaggttaagcaggcagctgtctaaggggtttgggggaagcttgggggagtcacaggattttgttgaagagagagaggtggaggagatggggctgtgtgttggggaggaaggttcagactggagatctagaaatccattagatcctctggtgggtcagggacaagagttgggggtgttgggggtataagtgggtggagaaggaggatttatggtgggagtggatttcaacgtctgctctaggtcagcttttggctccttaattttgttaagggatgttttaagactaaccatagtacattctgtgttcctctatcagtgtgatcttcccatagatgccagcagaccagttgtttagaacgagtactctctaacatgttttaaacatggatccgtctctggccatagctgatttggatctgcactggtgcatatgttccagtagtgccttaatctgcctttccagggaaaggccaggaggtggctttccatcattaccagcatgcaaggggtgttcctgcagtaggtgcagaagaggcagcccgtgatccaaaaattcactctcagagatggatgaagaaagcaaagacttacattgccatgtgcaggtagggagagtgtttgtgcagaccacgcctccagtctcccatggaagctgagacaccttcagcctcaggtccactcactgtgacactgggcaggtgatgctggaataggagtctcccagcactaatcagggcaacaaggataagatgaagaaagcccttatgaattggcatcttacaacaaaactccgtgagcgcttgacacatacagacagagagagtgccacctgggtctcatgtgtcttgagtccccagtctggtcagactgctgcctggcacagagccacactctgtgcccctccgatggcagagaccagagaggcatcctccttggtcacacagccaagctctcaggacataaaacgaggtgagaggggtaccccatcccttttgtttttttgtttcagggacccacagcacagtttgcttaggcagacatgggtctgacaagcacaacaaacccaagtgctggggacccagcagactttgaaggacctgtgcctgtgttctctacccgacacttcctctccttatgacaaacggcagaaaaagacagagacaaaggaaaacaaagaccatctttgagatcaaaaggatcaaatagaaatctaaacactaaaagtccctttttacccaaagaactatttcacaatgttttatcctgtcaatcccaatttagagagagaaaaagacacaaatctcaccattctcacctagatcagccccacagcagagacctggaaggctagcagtaagaaccctgcctttgctggcttaggtcagaggtcccgggtcttagctgcagtatctccagaataagcaatttcccagtcagtgagggagggccccggactctgtgccacgttctgcagggacccagagatcacctccaaccccacttagctcttacatgggctcctcagctggatctagaaaccaaattgaaatcaagcatattaacaagagaaaagcatacaaattgtattagtattaaaggtacatggggatcttcccaagttagtgaagtctgaagtagccaaagcaagatgcttttgtactttttagacagaatgataaatttgagaagaaatgacaaggccaagcagaatctggctaggggcagtaaatttccaggggagcctctaggtgatatgcgggaatataaaatcaatggcaacaaggcttacttcatgaagtacatttacttgggtcagttgctgcccccaatccccagtctccagtgctaagggctctcttcttgcccttgtgtgggggtgccacccccagaggagtctttatggcttgctacatgcaggaagaggcaggtcagctcaccctttctaaaactacgatttctccaatatttttgacataaaattatcaatataccaatttggcatattttgggatggcattcactccttcaagggaaaggtgggatggggaggtgtggggtcaggtgaggatgtggtgaaagacaaggtggggtatggatggaaatgggctctaggggaagagggaacaggcatggaaggggtgaggagagagagggccatgagccatgggtctggaggcagagagggaggcactggtgcaggtgataaaacctcacatgaggggtggcacaggtcagggggaaggtggaggccactggtgaggagactgggggttggcattgacaaatccacagatcccaaaggtgatggggaacagcagcgtcttccccggctccccacacagcagcatgttggcctccagatatactccatcacccccctgggcagggctcacacttctgacacccagactctacaatactcctctgtccccacccagggcagatccctaccctagaagttctccctctcatgtctggtaaatgctgcacagagccctggaattccacagggcaagttaggaagagggacagctgaaatcaggaagtaatcaccttctccaaagagaagttcagtccagtaccatcttgtgcccctgggcaagctctccaggctgagggaacaggagcagtggttatgctgggcaaagttggaagcaagggacctctcaggaagtgctgtagaatgttccactggggacacctcgtaccctaccaggattagaccttgaaacctggagatcccaggcaattagtattcaaggtcaaagggccagtgacaggaataggaaggcccactgtgtcattcacaaagcacttccaaacccatcaccccaggtgaccctcacaacaaccccgtgagatctgcagggcaggggctcccacaaagaaggagtcaggaatgtcgggattttaacaccttctccaagtcaggaccaggaaatgctgtcccagcaccaacttatattccctaggcttcctcccacaccacagcttagggtgactgccacctcatgggcagagaccctagctttccaatccttacaaggggctgtgcaggggagaggatgaagccccctcctctgactgtctcctctaagagcctgttttctgatgaaagtcactctgggaactgtcagcctctgcaaatgggggcctggacctcgtggaaagaagatgtgaaggtcacacctggcagggaccagctctggagggcaaacctcaccttttaaaattcccaacttgcatgtcctcctgccactgcattggtgctgacttctaaaggagcagcggacgtgaaaaagttgactttcttctaggttaacttcatgaagattattaaagtgatgaaaatatttatcctattctctataaagctccagcgaatatggttttctgcacatgcttatcaaagaatcttttagccaggagccctctgctgaagaacagtgtacaatctcagctgggacgcacatgttgcttctggaaacagatgaacacagtctgatcagagtctttcatgggtcagcgttgctccaggccagcccagcacagtcaggagcctcggcccaggcacgcccaagaagggagggtggctagtgcccagatgctgggggactgctcttttcgggtgctcttaattctgttaagaagccaatccatggccccgatgtcgtggtgtttggggctttaccctggcatcctgaacacacccagatagctgggtgtgagcactggagagaagccccggtctccactccacctcctgccctgcccaagctgctcccctggactgatagtgttctagtctctcctgagcattctcattcctggggcccctggggtccaatagtcaatttaggagcccatctaaagagactatctcttttagggggctggctttagggttcccttaccgatgaattggtaaatatggatggcagtggatgtagttgcatgacagaaagcacatcccaaccccacacaaaataatgagaaatggaaccaaagtcccagggctctccaagcacagaagaagccaccaaatattctccatctccatcatctgaagtgagctgatgcctcggcagctgggtgcagataacatgcagctcagtgcagagctccaggcccgcatcacaggctgtggaagggttacagattactcttgtgctcagaaggagacaaaacaatcagctctcccactgatcccaccccagcaggcccagcacccctcccagcttccaggccccaccaccctgctgccactacctattttctgtctccaaatttactttactgtaagttccttttcactctgtccatgacccagacataagcagggattccctcagagaaacagacttggatcccagctttggaggtctgaagatctccaggaattttttctaattctcaggcattaaaacaaatttttttggaagtataacatacagatggaaagcacaaatatcttaagcctacaatgcaatggattctcacaaacagtacactatgagagttgaactcacaccagaaaatgggatcaccccaggacctggaagcctctctagggcccctttcaagacatcacctatgccccgccccccccaccaaactttcctgacttatgattttccaggaacaattttatagttttcctgtgttttcactcaactaacatttacagtaatcctctgagataaacactgcactatcccccgttgcagatgggaagctggaagcacagacactggttattgatcaggtgcccactgctaagggtggagccagggtcccacgtggaagctccctgcagagccacattcttgaaacattgaactgcgctgcgaaaagccctttggctgcctgggcacagtggctcacacctgtaatcccagcgctttgagaggccaaggtgggatggttgcttgagtccaagagcccaagaccatcctgagcaacataacaagaccctgtctgttaaaataataataataataataaaattaaattagtgggtgtggtggtgcatgcctgcagtcccagctactcaaaagctgagatgaaaggaaaaaaaaaaaagaaaaaatcccttggcaagcaggaacaatagctcagttcaatgcaattgggtgtgtagaagaatcaccaccaagctctgggaaggctaggcagagggttttgcacacactcagggagtcctgtcctctctactgtggttggaacctgagaggggctgtgaggctctgagcaggagagagacttgcccaaaggccaaagacagggaggagtagagtctaacatgagtacaagattgactaggaccatcgtttatctctttacacaggaacaggaggaacttgaggcaaggaagggctatataagatgcagtcccctccctgcaggggccagcttggtgctggatgcatggttggttttatagtgacttgaactctgggactgcggcaggtggggccagatccttgactgtgcaggaatagacctcttccctgaaccgacagatgctgtatgaggaggggaggagggctgggaagccagccaggctggggtgggtgggcagagagtgttggggtttctcacctgtcctaacaaccacaaccacctttctggccttagaaagaggcaacagggagtgtgcgttttgtagagttcttcagggctgggcagagcccctgaggagatttgttgggggtggaaggacagaattcagatgaaggagacttggaaaaatgagttttaagaagttttattgtgggttatgatttcgataatgattagaattgcgtttcagggtgggcatggtggctgatgcctgtaatcccaaaatttgaagaggcaaatgcaggaggatcacttgaggccaggagttcaagaccagcctggacaacatagcaagaccccttctttgcaaaaaaaaaaaaaaaaaaaaaaaaaattgaaaattagccgggcatggtgtgacacacacctatagtcccaactagttgagaggctgaggcaggaggatcacttaagctcaagagttcaaggctgcagtgagctatgatcaaccactgcactccaacctgtttccaaaaaaagacaagaattacatttcagtataatgaaatcataatttttaaaggtaaatactataacctttaattgagagagaaaaagagtttgacagcttcaaacttgatactggcataaaaataaacaaaatagcccaaaagtccttgtaaatattcatgtatatataggaactgataacagaacaaaggttgttttccaaagaaatgagggatggctcacaggttcattgagtattgttgaggaaataggctatccatctttgcaaatgctcagattattcctaccacacaatatacagaatctagttgctgtataaggaagaagagggtggctctgggcagacacctgtgtttcaatcccagttttgctctatgcacctctatggcctagagaaagttaccctacctctctaggtatatgctatccagatcttaagcgggtttaagaaaatagctaggctggtcatggtggctcacacctgtaatcccagcactttgagaggcagaggtgggagaattgcttgaggctaggaattcaagaccagtctgggcaacacagtgagtccctgtctctacaaaaataaaaaataaaaattagatggcatggtggtgcataactgtagtccaagcaactcgggagtctgagacaggaggattgcttgagcccgggagttcaaggccacagtgagctatgattgcaccactgcactccagcctgggcaacagagcaagaccctgtctcaaaggaaaaagagagaaagaaagaaaggtagctaaatcatagaatggttctgataaactgggctctagatgtgaagaccttagaacaatgcctggcatgttcagtaaatactatttccccatatccgtctattaatagcacgctaaacataggaggagaaggccacacaagcaagtgggttacaaacttctggttctgggtaggactcaggagcagagagagatagatgagggatgatggaggatagcagtggactcactaagattgacttcctggctcaaatcttggagaggaaaagggaaaatcccaaaggactttggccatgggagttttgctgctagtattccagggcatgtcctgtgattcatgctcgttaagacaaagaattttatagcagttgccatcccagaaaattcctattccagcttccctgggccacaggtgagacagaggctctctaaagtcaacccgcaggtttggcttcttccatttacctgtgccctttctttcaacaagaggcctccaaggctgccacgatggagaaaagaaatggggattacacaggagacagttctgtgagccaagccccaaagcggcagcctgagcttctgcccacatcataccgacaaggactcagtcctgtggctcctgctactggcagggaggtgaagtttccctgatctgcaagaggaacatgagtgggttaggtgagcaatagcactgactgcaccagcatgccttcaggtcagcagattatcatatttctgttgccactacacaccaataaaacagaaactcactctgtctccaaggtggccatgcaaaggactctctagtaattccatcctgctcaaagctcaggaccattggctcacacagagtcctctccaaagcagcaagatgtggccctgtgcagccaggagacagaataataacctaattcccattcagaacatgcagaacatggaccaaggagaaacacagaataatttgtgtagcctacggggctggcaatgggaagatagtaagaatgttttccttgattggacatcaagtctgctctctggaattaagtccattttcattttgttttctcctcttgtgcctggctctcctctccaaggaattcatcattgtctgttaccatcttggtcacttctgaagtgggtttgggggaaaaagtctctgtgggagctgcaagtttagcagcctacttccttgcaaagatggtaccaagacttgcctatgggtccaatggttttagatcctgctctgcatttagacaatgctcatagctgctttgcaagccaccccaaaccttggttaactcacatccctgtgtttccagtcagttccatgagccaattaccacaccccaaaggcctttctttcttggacataattctcaagactgagccttggtagattggacttctaaaatactctcttactacttggggtccagaagcagcaaggtttttccaccttacaaagtctgatgtttctggattctcttgatttctttttagttatacttacatactgggaaaattattgaactcatcttcctccaattacttgccaaatgcatttatcaatatagaacacacactactaacattgtttatcaaactcttcccttatagtcacaagttcagcagcaggtgcataatctgccatctaagtaactgcaagtgatgactttaccaaaggctttgttatcacttaagatggattcagctttcattagaattattcatcaaaataatataatacaaaaaccaaataaaatgtggctacaccataaattttggtaaatgattagcaaatataaaaattaaaaaattttggaacgcttctcttaatgagacagatggacttctgtcccagctttgccatgaatctgtgaatgaacagttacctgctagaatgtgacagagttcaacatcagtcatacacctattttttcacttgttcagtttgaagtcctgagaaaccttgcttacataaataagcagataggaatggaaagggtctttatgcaattatttgaactctttcaaagttatagaccaaaaagcacagttatatataataaaagttattgtaaatgacccatctgctgacaactggatttgttccaccttcagtttgttcaaatgaagaattgaaacttatgtgactcgtagtgggatttgatatccaggaattaaagacagtctcacctgaaatacctacttcagtattttaaattatccccttgttaatccctggagatatggatctatggtctatagtaagatgcaagattgttgaaagggaacctcttgtgaagtgggagaagggctattctaaatagggactctttgatctcatgctagatcttaggaagatcatattttggaaacagcccaggtagaagttaaagatctgaaaattaatttctttaaaaccatccatgggaaagttctgagttaggaattccaaaggcctgccttctaccaaaacagtgaaaccactggcaaaaaactgtcaaaatcactctttatagaactctggaaaagcttgcagcaagcagtagagcacatattcaagaaaaactgctgacaccaataagaaaagcttgctccagggtgctttagcttatcctggttccatctcctgcttcccttgaaaactcacagctgttgttcccagtgtggtactgaacagatcagaaatgaagatattctcagagagttggaactgctcattttgatctgtcagattgctccccagaagactagctccaaaggattgccattctcttgtccaccttggaactcaccccaaactgaagcaccacctcagagcaattgttgacaacatatatggcaaatgttccaggcccaactgccaaagggaatggacagttgctggggaaaacaacaggttaaccaaaacttactgggagaaaagtctggaaataagatgttttaggcaacaagggctttggaaaattgttacaaattcctgggaatcttgaaggccgcacacatgcccagggctctgtgcaccctcagagaagagctcagacagctctaagctcacccttggctgatcatgaggttcaacacaggcaggaagtgaaggttaagaccaggttggaaaccacctggctgagcattgaaggaatgacctcaaaatgcaaacacttcctctgcaaagattagatttttattttattttattttatttctttagacagagtcttgctctgtcacccaggctggagtacagtaacatgattatagctcactgcagcctcaaactcttgggctcaagtgattctcccacctcagcagctgggaatacaggtgtgtgccaccacactcagctaattttgaattttttgtagagacggggtttcacgatattgcccaggctggtcgtgaactcctggcctcaagtgattcacccatctcagcctcccaaagtgctggcattacagacaacagccaccgcacctggccaagattagattttttttttttttgagacggagtctcgctctgtcgcccaggctggagtgctgtggcacgctctcggctcactgcaacctctgcctcccaagttcaagcaactctcgggcctcagcctcccaagtagctggaactacaggcacccaccaccatacccagctaattttttgtattttagtaaagacggggtttcaccatgttgcccagggtggtcgtgaattcctaagctcagccattccacccaccttggcctcccaaagtgctaggattacaagcatgagccaccattcctggcctaaaatcagctcttttaagtatgtccaaagagctacaagaaaccatgttctaaagaactatggtgaggacgaaaacagtatctcaccaaatagagaatattaacaaagagatgggaattataaaaagaaattcagaagttaaaaagcacaataactgcaatcaaaattcaatggaaggctcaccagtgcatttgatcaggcagaagaaaagaactgacaccatggtttaggtcacagcatcccagatgctgcaactagatttttcctttcttaggaaccttggggtccaagggttgtagtcccactggtgttcaacaacacacggatcaatgtgtgtccatgcagtacatttaattccgaacccccatttgggggtactgtcaggcttatagatgccttcatatacatacattatgagatgctaggatattcctgctgctcattactaggacagagctccagctgccatttcaacaaaaaatcccaaaaagtcaactaaattcaacgccttcatctgcactcaatgagcctgtctgcccagtggggattgtggacagagcagaagcattatgacacgttacgtgttggggtttttagtgctaagtttgtgtgatgagaattgctgaaccctctgatgtggggtgagtcattaaattgtctcccctgccactgaatagattccaacatagcctggccacacgtccaagggtgtgggggacagagggggagccgaagcactgatgctccctgatcctttgatcagtcaagatgactaaggtgggtgcacacagaaggcgggggcaggaaagtgctggggtggatgttggagaaccgacactagtggagctaacccaaaatcactaaatcagggatttcagatggcgtctactgttagggagatgagaatcctcatgtgagatgagtcaggttctcctgggaattgccatggggcagggggttgggggggagttaaatggcactcctgaacactagggctaattaataataaagccctatatttccattttactgccaatcacatggagacataaacatcttcctgatgggagccatagccaaagcctttccacttgcaagagctccgacttcccttcagtgcatgcgggttgaccagggagactacaagagggggcaggggtgagattcgtggcaggtgagcctgggagcagagcagagagaagcactgttgtaccatggcttctttttccaattttgctttttttttaaattatactttaagttctagggtatatgtgcacaacgtgcaggtttcttacatatgtatacatatgccatggtggtgtgctgcacccattaactcgtcatttacattaggtatatctcctaatgctatccctctcccttccccccaccccacgacaggccccagtgtgtgatgttcctcttcctgtgtccaagtgttctcattgttcaattccaacctatgagtgagaacatgtggtgtttggttttttgtccttctgacagtttgctgagaatgatggtttccagcttcatccatgtccctacaaaggacatgaactcatccttttttatggctgcatagtattccgtggtgtatatgtgccacattttcttaatccagtctatcgttgttggacatttgggttggttccaagtctttgctgttgtgaatagtgccgcaatggacataagtgtgcatgtgtctttatagcagcgtgatttataatcctttgggtatatatccagtaatgggatggctgggttaaatggtatttctagttctagatccttgaggaattgccacacagtcttccacaatggttgaactagtttacagtcccaccaacagtgtaaaagtgttcctatttctccacatcctctccagcacctgttgtttcctgagtttttaatgatcgccattctaactggtgtgaggtggtatctcattgtggttttgatttgcatttctctgatggccagtgatgatgagcatttattcatgtgtctgttggctgcataaatgtcttcttttgagaagtgtctgttcatatccttcacccactttttgatggggttgtttttttcttgtaaacttgttggagttcattgtagattctagatattagccctttgtcagatgagtagattgcagaaatgttctcccattctgtaggttgcctattcactctgatgatagtttcttttgctgtgcagaagctcttcagtttaattagctcccatttgtcaattttggcttttgttgcctttgcttttggtgttttagacatgaagtcctttcccatgcctatgtcctcaatggggggcattgcctaggttttcctctaggatttttatcgttttaggtctaacatttaagtctttaatccatcctgaattaatttttgtctaaggtgtaaggaagggctccagtttcagctttctacatatgactagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggctactgtagccttgtagtatggtttgaagtcaggtagcgtgctgcctccagcttttttcttttggcttaggattgtcttggcaatgcaggctcttttttggttccatatgaactttaaagtagttttttccaattctgtgaagaaagtcattggtagcttgatggggatggcatcgaatctataaattaccttgggctgtatggccattttcacgacattgattcttcctatccttgagcatggaatgttcctccatttgtttgtgtcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgcgcattgattttgtatcctgagactttgctgaagttgcttatcagcttaaggagattttgtgctgagacaatggggttttctaaatatacaatcatctcatctgcaaacgggacaatttgacttcctcttttcctaactgaataccctttatttctttctcctgcctgattaccctggccagaaattccaacactatgttgaataggagtggtgagagagggcatccctgtcttgtgccagttttcaaagggaatgcttccagtttttgcccattcagtatgatattggctgtgggtttgtcataaacagctcttatgattttgagatatgtcccatcaatacctaatttattgagagtttttagcatgaatggttgttgaattttgtccaaggtcttttctgcatctgttgagataatcatgtggtttttgtctttggttctgtttatatgctagattacatttattgatttgcctgtgttgaaccagccttgcatcccagggatgaagcccacttgatcatgatggataagctttttgatgtgctgctggattcggtttgcagtattttattgaggatttttgcatcaatgttcatcagggatattggtctaaaattctcttttgtggttgtctctctgccaggctttgttatcaggatgatgccggcctcataaaatgagttagggaagattccctctttttctattgattggaatagtttcagaagaaatggtaccagctcctccttgtacctatggtagaattcggctgtgaatctgtctgttcccagatgtttttttggttagtaggctattaattattgcctcaatttcagagcctcttattggtgtattcagggattcaacttcttcctggttaatcttgggagagtatatgtgtccaggatttcatccatttcttccagattttctagtttatttgcatagaggtgtttatagtattctctgatggtagtttgtatttctgtgggattggtggtgatatcacctttatcattttttattgcatctatttgatacttctgtcttttcttctttatcagtcttgctagtggtctattaattttgttgatcttttcaaaaagccagctcctggattcattgattttttgaagggttttttgtgtctctagctccttcagttctgctctgctcttagttatttcttgccttctgctagcttttgaatgtgtttgctcttgcttctctagttacttcaactttgatgttagggtgtcaattttagatcttttctcctttctcttgtgggcatttagtgctacaaatttccctctacacactgctttgaatgtgtcccagagattctggtatgttgtgtctttgttctcattggtttcaaagaacatctttattcctgccttcactttgttatgtacccagtagtcaatcagcagcaggttgttcaatttccatgtagttgagcggttttgagtgagtttcttaatcctgagttctagtttgattgcactgtggtctgagagacagtttttataatttctgttcttttacatttgctgaggagtgctttacttccaactatgtggtcaattttggagtaagtgcgatgtggtgctgagaagaatgtacattctgttgatttggggtggagagttctgtagatgtctgttaggtctgcttggtgcagagctgagttcaattcctggacatgcttgttaaccttctgtctcattgatctgtctagtgttgagagtggggtgttaaagtctcccattgttactgtgtgggagtctaagtctctttgtaggtctctaaggacttgctttatgaatctgggtgctcctgtattgggtgcatatatatttagggtggttagctctttttgttgaattaattcctttaccgttatgtaatggccttgtctcttttgatatttgttggtttaaagtatgttttatcagagactaggattgcaacccccgcctttttctgttttccatttgcttggtagatcttcctccatccctttattttgagcctatgtgtgtctctgcacgtgagatgggtctcctgaatacagcacactgatgggtcttgactctttatccaatttgtcagtttgcatcttttaattggagcatttagcccatttacatttaaggttaatattgttatgtgtgaatttcatcctgtcattatgatgttagctggttattttgctcattagttgatgcagtttctttctagcatcgaaggcctttacaattcagcatgtttttgcagtggctggtactggttgttcctttccatgtttagtgcttcctttaggagctcttgtaaggcaggcctggtgtcacaaaatctctcagcatttgcttgtctttaaaggattttatttctccttcacttgtgaagcttagtttggctggatatgaaattctgggttgaaaattcttttctttaagaatgttgaatattggcccccactctcttcaggcttgtagagtttctgctgagagatccactgttagtctgatgggcttccctttgtggataacccaacctttctctctggctgcccttaacattttttcctttaattcaactttggtgaatgtgacaactatgtgtcttggagttactcttcttgaggagtttctttgtggcattctctgtatttcctgaattggaatgttggcctgccttgctagattagggcagttctcctggataatatcctgcagagtgtttttcaacttggttccattctccccatcactttcaggtacaccaatccaatgtagatttggtcttttcatgtagtcccatatttcttggaggttttgttcatttctttttattcttttttctctaaacttctcttctcacttcattttattcatttgatcttcaatcactgatagatttcttccagttgatctgaagcttgtgcattcatcacgtagttcttgtgccatggttttcagttccatcaggtcatttaagaccttctttacactggttattttagttagccattcatctaatcttttttcaaggtttttagcttctttgcgatgggttcgaacttcctcctttagctcggagaagtttgatcgtctgaagccttcttctctcaactcatcaaagtcattctccatccagctttgttccactgctggcgaggagctgcattcctttgtagggggagaggcactctgatttttagaattttcagcttttctgctctgtttttttccccatctttgtggttttatctacctttggtctttgatgacggtgatgtacagatggagttttggtgtggatgtcctttctctttgttagttttccttctaacagtcaggatcctcagctgcaggtctgttggagtttgctggaggtccactccagatggtatttgcctgggtatcagcagcagaggctgcaaaagagcgaatattgctgaacagcaaatgttgctgcctgatttttcctccggaagcttcttctcagaggggtacatggctgggagaggcgtcagtctgccgctactgtgggatacctcccagttaggctactctggggtcagggacccacttgaggaggctgtctgtccattctcagatctcaaactctgtgctgggagaaccactagtctcttcaaagctgtcaggcagggacatttaagtctgcagaggtttctgctgccttttgtttggctatgccctgcccccagaggtggagtctacagaggcaggcaggcctacttgagctgcggtgggctccactcagtttgagcttcctggtcactttaccaactcaagcctcagcaacggtgggtgcccctcccccagccttgctgccacctcgcagttcaatctcagactgttgtgctagcaatgagtgaggctctgtgggcatgggaccctccgagccaggggcaggatataatcttctggtgtaccgtttgctaagaccattggaaaagcgcagtattagagtgagagtgacctgattttccagtgtcatctgtcatggcttcccttggctaggaaagggaattcctgaccctttgcacttcctgggtgaggcgatgcctcaccctgcttcagctcatgctcggtgggctacaccaactatcctgcatccactgtccaacaagccctagtaccagtacctcagttggaaatgcagaaatcacccatcttctgcatcactcatgctgggagctgtagactggagctgttcccattcagccatcttggaatcgccattccctttggcgtctttgtctctgctctgctttgcctgtatcattatggactatccctaggggagaatctggatgaacacaggtggtggctgagttctccacagcccacctgcagtgagtgaggacctgcctcttctcctgaatggtacctctttaaccatcagttgggcacatttgtctctcagcctggatcttctaaatgtgtccaagaagtcttagtgccagttgtttctccaggactgtgggaggctgtggcagctcaggggctgattgggagatcatctcttttccaacctttccctctatgagttccaacttccatgaagcctgtgtcttctcagaagagatgggagaggtttctttttctcatccagcccacagcctcagcaagggatcgcccatatcagtggctatcatgggcccaggcatgaggtgaccacaggagttggggctgcatgagacactcaccttgcagttggtggcaggtgtgtcctcaggggagtcctgtcagccagcactccaggtgcgggatgcagggcagggcagccttcaaggatagcagaagagtgggttgggttggagagggcaaggaggaatcacttatgtatgctccctagttttaaacctactaaaatgtttataggatagacctgaacagtctgatcatttcaaaaggtaaataaaactctccttacaatccttgtcctcaaagtccttagccccgcacacacaggattgtgcgcaatgagggaagctgcacctgccagcccaggcctgtggagttctgggcgttgcttcatcactttgtgtcactccataagggactgttcacgtgtatttgttcagcttcgctctccagaaggcccttcaactattagtccattgtatctctcaactctcccaacagattgttgaagcatttcacagaggaggaacccgaggctcctatgaaggaatagttcacccagagtcatggttgataggccacaggtcatggggatggcttgccttgggatgagtgtgtagattgactttaaatttctaaggaggggagtttagatatgtattcccaaaacttaccatcgccatctggaagtttgaattaccatcttactgggaactgtccaggtgacctcacactagagctcatgtgatatccgtttatgatgaggtggttgtgtgctcagggtgcacacatatctctgagtgggtgtgaggcacatgccaggtgggcacagagacatccacctggaatcccagaatggtttgaacccctctacatatagacctttccttggtgctgggaagtcaattgtcctctccgacccttgagagggaaggtcctgggtggcccataatgtttcagatgttttaggtatcagtaacctttaaggacattactgtggatgccacccaggaacagtgggccctgtgaggcccagcccagaggtgccatgctggagaacaatggtcccctgggcctagtgggtgagtctgtcagcactgattgatttattcatttatctttaataatttcaacttttcttttcgattcagggggtccttgtgcaggtttgttacatgggcatatcatgtgatgctgaggtttggggtacgattgatattgtcactaaagcaacgagtgcacatggtacacaacggttagtttttcaacccttccccccttcttctcttccttccccctcttgaattccccagtgtctattgttcctatctttatgcccatgtgtactcaacatttacctcccacttgtaagtgagaacatgcagtatttggttttctgttcctgagttaattcacttaggataatggcctccagctgcatccatgttgctgcaaagcacgtgatctcgttctttttatgactgtatggtattccatggtgtatatgtacacattttccgtagccagttcaccattgaagggcagctaggttggttccctgtctttgttatcgtgaataacgatgatttattttttgaacatgtgtccacgacagcttggccacacccctcctctcagccctcagtcacactggttctttcacagcacaaaggactacctgaaggaagcttgttaatgtctctacatctggcttgtcacccaccagagcatcatcttcccattgcaatgtcatgcctttctggctgctagatctccaatacccagaacactgtggctatctttaaaaaataaatcactagattaaatttttaccaagcaacaactctgttctgagcacgaagctagcgtttgagagcatagcaggaaaaataactggcccttgcctttttcttgcaaaactgagattgtgctggtggagctttcattgattggattattatgaaaataaaggtcagccagctgtggaatcttccttcactctgctctgagcctggccatgcaaaccagcaacatgagctcccactgcctggagatccgaggcaggactccctcctgtcctgtgagggacactggtgtcctcagggtcagggtgctcttccctggctgcccttggaagcccacctcattcttcctcaggagcctgccctgaacctgaggcccatgcttggttctggcataggattcaaatccctgcagcttcactgcagagcaggagctctgccagagagaatttcccaggtggagcaaggacagggctgtggagggcagggaaggtcctccctggggcctgagtccaggtgagccgcagacaggtgtgctcctgggaggacctagccagggagggagcagggtcttagtgagcgcggtgcggagttccaggaatggtgttttcaggtagtatgggggctgctggttgaccggttcctttgaggtcatattcctcatgcgtatcagtctcccttcctatatgttcctgtcctcctgggcgtcggagtttcccgttgcagcctctgccctgacccttgcccttggaccgtttccctcccctttcatccctgaaatcccagatctattctatttttcctcttatatcaaccctgaaaatgttgtctgtccgtttcctaagtcgtgtttccactcgctggtgtacggattgtcaggttctaccccatgcagctgggtgggcctctccggctccttcctgctcctgtaggtttcatcccccacctcccccaacagcggcttttagctgcctggggccgcccgcctgaccctaggacgagtgcggaatgaccccctctccacgcggagccctgagcgggaggcggcaggggcccaggcagcaggaactgggaacaagccgcccggcaggaagtttcgggtggctggaatttaggaagaagctagcctgagctcaaaacctcctgctaaacaaaccttaaggcgcgcatccggctctgtttcccacctgcaggttccgcattccttagcccagcaggcggggaggcgggagcggggtcagaattggtggaaggctggggttgcggggtgcagagagtgctgagccatgaagacttggggcagcgaggccgagtgatggcagagcctggggaggcgtccaggctgcgggggagcagggactttggagcaatgaccctggggggacactgagcacagggccagggtggcgtccaggggtctcgggtaggcctggactaaagaggcctgggaagagagacgtggggaggtcaaagggccctggtgagtctggatgaggagcagaggattgagtccccccagaactgagtccaatgtttttggggggagggacaaggaaacagtgagggggtgggggccatgtgccactgttcgagggacaaacccagctcagaggaaataaggcacgggggtgaggtgacaagggacatgggggtgacagggccatgagatgaggggtgtcgaggtcgggccaggaaaagatcaactaaacagccgggggaagtggggacccagggaagcaagacatggaggcatgagggagaaaaagggaggagggggagctcagcaaatcagtcactgccaggcgcctctaggagtctgattttgtggcaccttagtcatgttttcagagaagaggttcatagtctagaggatcccatggccacatggccaacacagggaggaagtggggtgaagagctggggtgcccatctgtggccccgcttccttgtgaggttcccacaggccctgtgggcacacagcccagctctgccctgaactcagggcctgcctgggtcctgtctcttccctcctgtactttctgtctcagctgagctgttcttgcctgcaccttagcacctcaggctgagtgggagggagaatcctaaactggccctcaagattctgccccctggggaacagccctgtgtatagaatccctttcaccagggtggcctggatctctgaatactttgggatctcactccccaagttacatgactttacattgcagttagggggttttgaagatgtaattacaacccctaatcagtctactgtaagttcatcaaaaaggagattttcctggagaggcctggtctaatcaggtgatccctttcaaagaagggctggaggctgggcatggtggctcacgcctgtaatcctagcactttgagaggccaaagcaggaggttcacttgagcccaggatcacttgaccccatctctacaaaaaatacaaaaattagacgggagtggtggttgtatgcctatagtcccagctacatgggaggctgacgtgggagaatcacctgagctcagggaggttgaggctgcagtgagctgtgattgcaccactgcactccagcgtgggcaacagagcaagaccctgtctcaaaaaaaataacaggaagaagaataaaaaagtgggctggaggtcagaagcagaagggatcagcgtgatgcaaggcagacagtctcctgcaggccctgaagaggccacctcctgtgctgtgctgctgtgccaccgctatgctgctctgccaccttgtggagggcctccaggaaggtttctgaagctgctgcgtgtgtggcaattggttacgtagcagcagaaaacaaatgcagctttctactcctccctctcctaccccacccctggatctaaccagttcctgatattctctaaccaaggatcaccctgcacactcctggacagccctggtgtgaaccctcactcaccctgggtggctgaagatggtttgggataataatgataatagtggctcctgatatctgttgggcactaactactgtgcaagtattttatgcccatgaagccatcccattttcacaacaactgcataaggaggcatatctagaagaggatctagcagccttccagttcaacttcatttagacatcaggatcccaggcccagaggcacaggtcatggtttccaagccccatagggcgctgttttcaactgttaggataatccagaacacctggagggcgctcctatgtgctatgagcaaagcaaaaacatccttcattcaacagactctccccaggctgagcctgcagaccccctcttgtgatagggtcagaattcagtttttaaagagcttagtgtgtagatactattgatgatctttgggagctgaagtgttcttgaactccaggcatagtaacatgttttaggttcatttatttgaagcattatgaaaggaaaatatatgttacacctcaaaaggagtttagattctctgtagttataactactgtatagtcacatgactattttctaaattttaagctaaatattcagtgtgataagatactcatttttgtacatgttatatccacttaactattaaagctggtcatttattacctcacatgcagtgttaagataatgagtaaattgttcataaattttcactactattattgggaagcatcatggcatgtaataaatcatcttttttatacatagaatgaaatcaaggctagggaaggtacatactactccattcgtgctgtgtggctaagaatggatctcatcgattgtgtataatggcaagatgagtactaaaaatatttgtaggatcaatacttgaatgttcataagcaagatgtcacaaatatcccaccattcctacaaattaaaataattttagtataatttttagacagcacatttataaacatgtgccaaatagaacatagccacctagcacagtgactggattggatgtagtacgtctctggattcctcctatgtgtttactggagatgtttgggaagtcacctagtcctttgattgttcatattctttatccatgtattagaatttcatagtaactgcttagctgatgtgtttcatgtaagttacagaattgtctattaaacatgctgtgctcattacctattataggatattgatttttgtctgtatatttgcccttctttaaaacattctagtacttttactttttagaacatgcaggagaatacgtagcaggaggagagcaaagatgacaccaacttttttcatttcttagcccttttgatctatgttatggatgaagatatagatgaaaattaaggctgagatatctgatatcctgatatctgttgggcacttttaatctgttgagaattttaattgttagatattttacttctgattatgtgaacatatacaatttaatgattaaaatattataaatttcatgcttaataataaatgtctttcatatatgactccatcaaatctttaaactttgcatatttatactgtgaaaaaaaatgaattaactaagcctccggctttctaaaatggaagcaggagaagcactcaaatctgctaaaggtcaagccacagaatgttccagtagacttggataaacaactgaagccaatgtccaccagccttcagcatctttcagctgggagtggcctcgttaactgaccaatcaaaacgagtttacaacttcggatttctgcccaacaaatcaactgcctttaaaaataacttttgtggaaatccttgattcaaaaatgtttcctgcacttgccttacaagacactcttcagggccgccctgactcactgtacctgagttgcaattctttgtttctcaaataaatgctatttcctttgacctccatgcccatcttttttagtgaacagcacagtatcgtaactgttattggtatccattattaagactgttggacctttcattgcttcatagaattatctttatcttgggcaagaaagtgaaaattatccatagtttctttaaaatagtaatattttaagccactcaaaataagaaaaagttaaagttcacaataaaaagatcctgatttacctgaataagacttgaaaagtgaagaacaattccttctacctgaaaagggtgttgacccagaatccaccttggacgaccctctagagctggcaagtcagcgtcatccccagtgcacctgtgactgacaacacatctcacccagctgccatagggatgtcaaagacacaggatacagtgctggaaagggaaaaagcatcagtgcaaaagtagatttcaggatttggagcacggaggcaagtgccctctcctggcatccctgcatggggccatagtgaggaggctctgcagtcttccaggaggactggaccatggataggaaatacccaagacatggattctctagggacatgggcgattccaaaagcaccgaggagcgtgcccctagagaagcagtccactgggtccgtagtaaaatctcatggcataaccaatgtggagaccagagactaaaaatctgtaacgtccttggtgtccatggacctcaaagccaaacacaacagccccacgagtatctgtcatccaggcacggagagctaggggcgagcttctaagggtaaaggaggcttcttccctgtccagatgtgtggacgcttgggtttacagataatggaggtgtctatgtatgttgtcatgaaaatataaggcaagtggcaccaaatatgatttagtggtcccagaaattcggtgctgtgtgctttctgcacgacattaattttaattatatggacacagaaggagaaaatttaaaacttaaatgtcttatcattgctagaaaaataaaagttttttccctacgagttagaagtcttgatctctgcgtttttctatggatcgattctcaaagtttgtgcaaatacagttggtgtttctttctaagtgtctttggttatgaactaaggatgtaaccaactcctgcttattaggtaaagggatgaggcaagagagatccagcaacagggtgtgtttttttttcaatctttggcaacatttttctgtgatgtccaaagtagtgaactccctgactagggtttcagacatggagtgttctaatccaccaaacaccaaagggctgggaagaagtgatttggacatggataaccagtgtcacctacaacatggaacagagggtcatcaaagtggtctgagtcactttaatatgtggctggagagatgcaagaacaacagaaagagccctcaggaggcatccccacccaagggcagtgaagctcagtgcagctgcggggtgtggggtcatagggtgaccaggtgacagggctgatggggaggagaaatgctctgttaagggtgttgtctctgtcacttcttcaaaaagcagcacagtctcaggcacatgctccctcctgccccaccccacccacaattgatccactgcagctcttccaagatgcttccctccattctagtacctccccttactcctgagcccctgtggcctctatcttactccctctctccagttctttgtaccttcctcctctccctcactcacctcccctcccatgcaaagcccctactggttcccccctccccacttcacctccactcacactccatcttcaccctccattccagtccttcccttcctctcctcactctgactccaccggtgaactcacttcccatcccttctgtccatgtccctgcctcagtttacctcccttcccctctcctcaccttccttggatgcacctgacctctcctgcctccctccccttcattcatgcccttcctttcttctctctccagttccatctcctccaacatgctcccctccccctttccttcagcctctgttgacctctccaccctcccacagtcccctgcactctcctgccaaggacatccctcccagccatccccgccctcctcacctcacctcgtttggctccatgtccctcagctccccttccctccctcttccctgtcccaagagccatctgggtttcctttccagtctccctctgcttgtgtgctttcttccccttccctgacttcccctgctctatcttctcctcagttccccgccctccctctctgcacctgcccagtttcccccatctcccctccatgctccctttctcagtttccctccccagctcctgagttggaccacctcagctcagcgccctacttcctgtgcctgcccctgcctgctgcccaccctccctgcacacagctcacttctccctctggccctcctgctgagcaagtggctccccgactgccctgggcctgcccactttccccagcccccgcagtcaaggctctccacatcaccggggtgagggccgagatgcaccctctccagggctctgcttcctccagcaggtcccagatcctccctccaagctaagctccatggcccatccctcccctgggggcaacaccacagggaccttttgcccaccttgccaggcttttcagaggcctcgaagctgtggtcaggcaggcaagtggggagcaagccaggagttacagatccagagcttggggcagtccaggcagcgggggctgtggtcccctgtgaccacttctgtgaccttgccacttgaaccctccagggcctatgtcctcacctccaacgtgaagatcaggctgggccattattgcaaagctgtgctgagtgttgacaaaggtgcatgtcacgctttattacaggtagctggtgtttcctgagcatttggaaacaacgccctgtaaaatactgtgaactaatcgcagagctgggcacagcatgcttcatgatcttattttatactgacgtgttttgtcatcgtgctgtcaagtattctccagccacatcatttgttagtagtttgacctgcataggagggcagtgtcaccctccttcctgctgtgctgatttcagcgagggcctccgggccagactgccccgtgcgccccctgttgactaacctgggaatcgcccgccgcctgccttgagccttgtgatgtgggcaggacggggccggggcagggccaggagcctgcggggaggcgcggggccaggcgcctgcaggagtggaacctgcccaagatctaggagtagctcggtgcaggaccaggacagagttcacacccctggcttcacgtacacgtattttttttttttatactttaagttctagggtacatgtgcacaacgcgcaggtttgttacataggtatacatgtgccatgttggcttgttgcacccatcaacccgttatttacattaggtatttctcctaatgctatccctcccccagccccccatctccctgacaggccctggtgtgtgatgttccctaccctgtgtccaagtgttctcattgttcaattcccacttatgagtgagaacatgcagtgtttggttttctgtccttgtgatagtttccagcttcatccatgtccctgcaaaggacatgaattcatccttttttatggctgcatagtattccatggagtatatgtgccacattttcttaatccagtctatcattgatggacatttgggttggttccaagtcttttctattgtgaatagtgctgcaataaacatacagacctacacataaattaaccggtgtgtgtcaggtgtagataccagccaagaagaaaagacaaagtcagcgggggcagctctaggacagcgatgacctgggtcgcttcattctgtgcctggggaagaaccaaagccacttggagattaacgccatgacaaaaacaagggatgacgtgtgtgcagttgtgggtttcatgtttactttccacgactctagaggacttgcccacctgttcatacataaaccagtgcccagggccccactgcccggtgagggctccatctcccctatcaccccaccccctgcttagctcctggcccgccccaaccatcccttagttgatgagttggtgaagctgccccctttttcctccctataccttctcttctctcccccaggtcctgctgggccacagtcttcggtctctctgccccacctgccgaaggacccccctggtctcttgggtcctcacctgcatgctcccgagctcacctctaagttgtgtctgcccttcacaaggctggccccctgcagcccaccccctcacctggggcaccagggccatccacttcctccactctcctcacactcccgaagtgactcagggctcccctgagcagctgggctggagtcctcccaccaactccctcagttatacctgctcccgtcccctcagacccagccccccaggtctccagacccattcatggacgtggcctcctaggcctctcaacactcacctcccagcaacccctcagccctgccctccccaggcaccaacttgggacccccacagaggcagagacacctattcccacttgggctcatgtcaccctggctcactggggatgctgagcctgtgagcccaatcttgctccatccctccagttcctttctccaatccaagttctctcagacctgtggtgtcactcccagaagccatctggacacccaaggcactgcctgacggagatggccatgctcttccctgtagggatggacaagggacacctgcagtgcacaggtcacagtctcaacctttggaatggtgtggcaggctgtgccctagtagggcccccaccagggcccctgaatggctgctccccatcagtaacaaggaagacccttgatgatcatccccactgcctctgagatgggcccggaaaggcgtgagcttctcaagcacctgggtcaccatctgggaaatggcagtcatgatcaagtcaatcccttgtgccccagagacactgtaactccccagtagaatcccacagggattgaggccaccctaggcaacatagcaaggttccatctctacaaaaaataaaaacatagccaggagtggtggcacacacctgtagtcccagctattcgggaggctgaggcgggtggatcacttgaggccaggagttcgaggctgcagtgagtagtcattttgctactgcactccagcctgagtgacagaaggggaggagagggagaggggaagggagggaggagtgaggggagggagggagaggaggggagaggaggggagggagagagagaaggagaggagggaaggggagggcaggggagggagagagagaaggagaggaggggaggaagaagaggagaaagaaggaagaaggaagaagaagaattccagagagtgaagagccaccaagggtatccccacactctgtgcaagcgtctatctgcctgaaacatacatgtgtgaaactcactgttggcagcacaatcaagacggaaaattagacctgagagcagcctctgtggtctttgagagggacccaggggatgaccagaggcagggaggctccatgggagggagaaacacaagtagatggccttctctgtggcttccagcctggggcaaagggtggtcagtctcgagatgcccagtaggggaaaggctcgtgtgggaaaagggaaatcaaaaatcctgccacctgcacagcacaggggaatcacccaaggctccaaagggtcattactgtgatgtctgtagcataacatccacatcgctgtaacatccacaggggcctccttaacaccatcaggctctggaatcggagagcagaagcttcacagctgtagctgaagtgggtctgagtacagactaatctctatcgtgcagcttactattatccctcctttagggacatggtcattttaaaatattttattttgaaataattatagaacttatagaaaactgcaatagcagcataatgggtgcctgctcccttcacccagctcccccagggcttctagttttgccatgtgtccccacctcgctgaccagccccagtagacggcaccaaaggcaggcaggatcacacactcctctttgctcaaaacactcagggatccttcctgccccacacaccctctccatgcacccacattctctgcccaagggtggcctggcccccaggcccagctcatccccagcatgtgactcctttcactcaggctgtggatctcatgtattgcaaatgtggtttaaactttgagaacagcaattctggtttgtagaaaaaaagtgaggatctaggcgtttgcagtcatgcacatgttcgtattttaaatacaggccaatgagctgctgcctagtgtgcctaccagagacacacctgttgttaaactacaactggatttactgttccattctgcaaaaatacgccatggtgctgtggagggtgcagtgagaggcttggaagagccttgccacaggctgtgtgtgtgtgccagctggccatgggtggactaactggagaggggctggctctgagttgagcactgttaggaagcaggaggaggtaggtatacactggaatcttcataaacctcatccccggggaggcctgacacgggcaggacaggctatcaccaaggccaaagcggcagtcatcatgtgggctgggagaggacacggctggcactcctggcctgagagatgctcccatctgtctgtattcagacaggattctggagtggcttgtctttgtcttgatcagaccatctggggtcttgcctgctgctggtgtcctgagggacagtttgtgttctccaggagagccccacaacctcactgagggtgccagcccagctcctgggacacagccaccctcctccttctcaagctttaatgagaaacgggcaggaggttgccggagaaccactgcccatcttccggggtgctaggggtgtctgctggcagttgtggtctagggcaaaaagagaagggaagggaaaatctttcagaaaataacggaatcacaatggggctgcaggcgagatgagcaaactgggctggtggcatccagggcgttagcaaagaaaaaagcaccagtgttcaggcagccagggagcccagccgctctcttagggtcaccccctcccagccctccggaggccacccttgtcccgccctgccccaagggcacagcccgcgcccctcccccagtcctctccctgctgggctgccccctcccgcggccgcatccctagtcagtccctgagaccgtccagagttcagtccccgggatcaggcttgcagtgttgggccgccctccttgccagatgccgccctggagagggcaagggcgcagaaagggctgagcgtcccgggtccctgcgtggccgaacggcatgtgagcacattccaggaataaggaaacgagaggagtaggcatttctaccgtctaaggcactttgcatgaaatcccgtggcactggaaaagtagttcaaacaaagtaacgctggcttttacgatgcagataaacggataagcggcgtaggactcaagtaggagggctccgtgcacaccaggcgcagcccagcggggatttgcctgcgcgtcccagcgcacagggaggtcgctgagtcccagggaagccccctgggctcgcgctgcaaactcaggcagcctctgctcctgccctacggctttgagggcacgtgctcctccggggaggcacagcttcctctaatttcccacttcctcatccggcccttaattcactaaagactaacagggaatgatgttcattaccaaagtaggtgctccccctagtgtagcacagaacgcggcgctgttctcactattgaattggaataatatttttagtatcaaaattaattctagaaatctattacagttcattttccagaaaacaagggtagcaaaaatagtataggtttgtttcttaatttctttatgacacacatcactggttcatgtgataacgtgtggattctcacctggaagacacaagaggaataaaatcaccatattttaaactctatctcaagtctctcaacatttcaggctgtgctcatttacacactacagaatgatgagtattcagtggaaacttttgcagaacaattaaaattgcaaaatcggagccgggcgcggtggctcacgcctgtattcccagcagcactttgggaggccgaggtgggagtatcgcttgagcccgggaattcaagaccagcctgggcaatatagtgagccatcatctctaaaaaaaaaaaaaagaaaaagaaaaaattgcaaaattacctaaaatgaaatgcatacattgaaacgcccacaattattatgaaaattaaagttaatattaacaacatatgacatgagccacaagatttacattaaaatagtctagttgacaataacttgaatatttaaataaagtcctctttatctctaaataatatatttacagtctgccattatatgaatcacttaaaattcagatgaggatattaatcaatattgacaatttcttcaggaatatcaagtgaataataatgatttcacttttttgtttcattttgtttttgacataagatcttgttctgctgcccaggctggagtacagcagcaggatcgtgactcactacagcctctgccttctgggctaaagcagtcctcctacttcagcctcctgtgtaactgggaccacagatgcacaccaccaggcccaggtaattttttattttttggtagagacagagtcttattatgtttcccaagctagtcttgaacttctgggctcaagcaagcctctcacttcagccacccaaaatgctgggatgacaggcatgagtcaccatgcccagcataaagattttattatgtggaaataaaaggacattaaaatataacttgaaataacccatttctcgcaagtatttatttttccaccagttaatcaaatagtgccaacactagacaccaaccccacttccattgctaatcccactaatacactcaccaagacttcaattcctgacccccatgtctcaggatactcctcaatagccattgccatagtatatccaaaaacaaccatcgtaccccctagataaattaaaaaaaaccattaaacccatataacctcccccataattcagaataataacacacccaactacaccactaataatcaatactatacccccataaataggagaaggtttagaagaaaaccctacaaaccctattactaaagccacacttaatgataataaagcatatgtgattaatcccacatggattacaaccacgaccaatgatatgagaaaccatcattttatttcgactataagaacaccaatgaccccaacatgtaaaactaatccactagtaaaaataatcaaccactcacttatcgatctccccgccccatccaacatctccatatgatggaacttcagcttgcttcttggtgcctgcttaacccttcaaattattacaggactattcctagctatacgctactcaccagacgcctcaaccgccttctcctcagtcgtccacatcactcgagatgtaaactatggctgaatcatccgctacctccatgccaatggcgcctcaatatttttcatctgcctcttcctacatattggccgaggcctgtactatggcttatttctctacctagaaacctgaaacattggcatcattctcctactcacaaccatagcaacagccttcataggctaggtactcccatgaggccagatatccttgaggggccacggtaatcacaaatctactgtccgccattccttatgtcggaacagacctggtgcagtgggtttgaggtggttattcagtagacacacccactctcacacgattcttcaccttccactttatcctacctttcattattacagccctagtagtcttacacctactatttctccatgagacagcatcaaataacccctcaggaatctcctcccactccaacaaaattaccttccacccctactacatgaccaaagatatcctaggcctatttctcctccttctcaccctaataacactagtactgttttcacccgacctcctaactgatccagataactacaccctagccaaccgcctgaatactccaccccatattaaacccgaatggtattttctatctgcctacgcaatcttatgatccatccccaacaaactaggaggcgtactggccctcctactatcaatcctcatcctagcagcaattcccacacttcacatgtccaaacaacaaagcataatattctgtccactaaaccaattcctatattgactcctaattacagatctccttatcctcacatgggttggaggacaaccagcaagctaccccttcatcaccttcggacaaacagcattcgtagtttactttgctacaattctagccctgataccgcttgcctccctactcgaaaacaaaatactcaaatggacctgcccttgtagtataaaccaatatattggtcttgtaaaccagaaatggagactctctcccaaggacaactcagagaaaaagtacttgacttcaccatcagcacccaaagctaagattctaatttaaactactctctgtattctcatgagggagccattttgggtacaacccaagtatcgacccaccccaccataattttatatatatcgtgaatttctgctagccaccatgaatattatatagtactataattgcttaactgtacatagtacatatcaaacgaaactcaacaacaactcctccccacgacgcttacaagcaaggactagaataccttaactaacggtaacacattaaacccaccctccaaaagaaacttctcaaccacaagcgtaccaaaaaacactatatatccttgagtacatagtacatctaatcgctcatggtagatagcacattccagttaaacaagtcctcgtcaatacggatatccccctcagatagtggtccgttgttcaccatcctctgtgaaatcaatatcctgcagaagagtgctactcttcttgatccaggtccataatacttgggggtagctataatgaactgtatccggcatcttgttcttacctcacagccataaagtcaagaccaaccacacgttccccttaaataagacatcacgatggatcacgggtctattaccctattaatcagtcacgggagctctccatgcatttggtattttaatctggggggtgtgcacgcgatagcattgtgaaacgctggccccagagcaccctatgtcgcagtgtctgtctttgattcctgccccatcccattattgatcacacctacattcaatatcccaggcgagcatacctatcacaaggtgttaattaattaatgcttgtaggacataacaatcagtaaacacacccacggccgcttttcacatcaactctacaataaaattctgcaaatccccttcccccatctttggcctcaccaacccaggaaaagacatctttgccaaaccccaaaaacaaaaagccttaatccaactcaaccagagcccaaatttttatctttaggctgtacgcatttttaacagtcacccctcaactaacacgtctttttccctcttagcctcacttcacagactctacaaatttagttatccctttttcagccatcccattcaacgcatgcccgaccactactaaaccaacaccctaaactaacccaaccccaaaggcaaggctttcccccctacccattgcttgtatgcccatcccctagccttgcttacactgtgcaatcacagtctatgtagcttaatgacccaaagcaagacactgaaaatatctagatgggcctacactgccccatagacaaataggtttggtcctagcctttctattaactcttagtaagattacacaagcaagcatcgccaccctggtgaaataaccctctaaatcactacaatcaaaaggagtaagtatcaagcacgcattagtgcagctcaaaacactttgcctagccacacccccacgggagacagcagtgataaacctttagcaataaacgaaagtttaactgagctatactaactttagggttggttaatttcatgccagccaccacggtcatacgatgaacccaagctaatagagactggcgtaaagaatgttttacattatccctcaataaagctaaatttcacctaagttgtagaaaaccctagttgatataaaacaaactacgaaagtggctttaatatttctgaatacacaatagcgaagattcaaactgggattagataccccactatgctcagccctaaacttcaacagttaaatcaacaaaactgctcgccagaacactaggagcaacagcttaaaactcaaaggacctggcggtgcttcacatccctctagaggagcctgttctataatcgataaaccccaattcacctcaccacctcttgctcaacccatataccgccatcttcagcaaaccctgacaaaggccacaaagtaagcacaagtatctacataaaaatgttaggtcaaggtgtagcctatgaggtggcaagaaatgggctacattttctaccccagaaaattctacaataacccttatgaaacctgagggtccaaggaggatttagtagtaaattaagaacagagtgcttaattgaatagggccataaagcacgcacacaccacccatcaccctcctcaagtatatttcaaggactatctaactaaaacccctatgcatttatatagaggagataagttggataaaccaaggtgtagcttaacataaagcaccctgcttacacctgggagatttcaatttaatttgaccaccctgagctaattctagccccaaacccaactaattctactaccaaataacctcaactaaaacatttacccaaataaagtataggcgatagaaatgatatctcggcacaatagacataataccgcgatggaaagatgaaaaaacataaccaagcataaagtagcaaggacaaacccctataccttctgcataatgaattaactagaaataactttacaaagagaaccaaagccaagacccccgaaaccagacgagctacctaagaacagctgaaagagcacacccatctatgtagcaaaatagtgggaagattcataggtagaggtgacaagcctaccgagcctggtgatagctggttgtccaagatagaatcttagttcaactttaaatttatctacagaaccagctaatgcctttgtaaatttaactgttagtctaaagagggacagctctttagacactaggaaaaaaccttgtagagagagtaaaaaatataacttccaaagttggcctagaagaagcgatcaattaagaaggcgttcaagctcaacacccaaccacccaaaaaattccaaacacataactgaactcctcacatcacattggaccaatctatcatttcatagaagaaataatgttagtataagtgacatgcaaacattctcctccgcataagcctacatcagaccaaaatacttcactgacaattaacagcccaatatctataaataatcaatgaaaccattattacccacactgttaacccaacacaggcatgcttacaaggaaaggttaaaaaaagtaaaaggaactcagcgaatcttacccctcctgtttatcaaaaacatcacctctagcattaccagtactagaggcaccacctgcccagtgacatatgtttaatggctgcggtaccctaaccgtgtaaaggtagcataatcacttgttccttaaatagggacttgtctgaatggctccacgagggttcagctgtctcttactttcaaccagtgaaattgacctgcccgtgaagaggcggacataatacaacaagacgagaagaccctaaggagctttaatttatgaatgcaaacaagaccaaataggcccgcaggccctaaactaccagacctgcgttaaacatttcggttggggcgacctcggagtataacctaacctccgagcaacatatgctgagactataccagtcaaggcgaatatccacatacaattgacccaataatttgaccaacggaacaagttaccctagtgataacagtacaatcctattctagggtccacatcgacagtagcattaacgacctcgatgttggatcaggacatcccaatggtgcagccgctattaaaggttcgtttgttcaacgattagagtcctatgtgatctgagttcagaccggagtaatccaggttggtttctatctattctacatttcttccagtacgaaaggataagagaaatggggcccacttcataaagtgcccctgccccatagatgatattatctcagcattttactgtacccacacccacccaagaacagggtttgttaagatggcagaccccagcaattgcataaaatttaaaactttacaaccagaggttcaacccctcttcttaacaacatgtccataactaaccttctacttcttattgtacctatcctaatcgccatggcattcctcatgctaactgaatgaaaaatcctaggctacatgcaactacgcaaagggcccaatattgtaggcccctatggactattacaaccttttgccgatgccataaaactctttaccaaagaatccttaaaaccctcaacgtcaactgttaccctctacatcactgccccaaccttagccctctctattgcccttctactatgaactcccctccctatacctaaccccctagttaatcttaacttaggccttctattcattctggctacatccagcctagctgtctactctatcctatgatcaggatgagcatcaaactcaaactatgccctgatcggcgcattatgagcagttgcccaaacaatttcatacgaagttaccctagctatcatcctattatcgatcctactaataagtggccaattcaatctctgcaccctcattagaacacaagaacacctctgactactcctaacatcatgacccctagctataatatgatttatttccacactagcagaaaccaatcgagctgcttttgaccttactgaaggagaatcagaactagtctcaggcttcaacattgaatatgctgcaggcccattcgccctattctttatagccgaatacataaatatcattaaaataaatgccctaactgccataatcttcctaggtacaatatataatattcacctaccagaactctacacaatatgcttcaccattaaaaccctattcctaacctctctatttttatgaatccgaacagcatacccccgattccactacgatcaactcatgtatctcttatgaaaaaatttcttaccatttacactagcactacttatatgatacatctcaatatccgctacaatttccaacattcccccctaaacttaagaaatatgtctgacaaaagagtgactttgatagagtaaataatagaggtttgaatcctcttatttctaggaccataggaattgaacctatccctgagaatccaaaattctccgtgccacgtgtcacaccctatcctggagtaaggtcagctaaataagctatcaggcccatacccagaaaatgttggttatatccttcccgtactaatcaatccactggcccaacctgtcatctactccaccgttttcacaggtacactcattgcaacattaagcttgcactgattttttacctggacaggattgaaaataaacatactagcttttatcccaattttaattaaaaaaataaacccccgctctacagaaactgctatcaaatactttctcacataagcaaccacatctataatcctcataatagctatcctctccaacaatgtactctccggacaatgaaccacaaccaacaccaccaacaaatactcatcattaataatcacaacagccctagtaataaaactaggaatagcccctttccgtttctgagtcccagaagtcactcaaggaacccctctaatatccagcctacttcccctcacatgacaaaaattagcccctatttcaattatatatcaaatctccccattaataaacattctccttaccctttcaatcttatccattatagtgggtagctggggtggactgaaccaaacccaactatgtaaaatcctagcatactcctcaatcacccatataggctgaataatagcagtactagcatacaacccaagtatcaccattttcaacctaatcatctatatcattctaacaaccaccacattcctggtactcaacttgaactctagcactacaaccctactactgtgccgcacttgaaataaactaacctgactaatacccctaatcccatctaccctactatcactaggaggccttcccccactaactggctttctacccaaatgatttatcattgaagaattcacaaaaaataacaacctcattatccccactaccatagccattattactctctttaacctatatttttacatacgcttaatctactctgcttcaattacactattccccatatccaacaacgtaaaaataaaatgacaatttgaaaatacaaaatccacaccactcttccccacactcactgtccttaccaccctcctcctaccaatctctccacttacactacccacctcatataaatttatgttaaacgcagactaagagccttcaaagcccttagtaagttaataatacttaatttctgcagcacccaaggactgcaaaaccctactttgcatctactgaacgcaaatcagccactttaattaagctaagcccttgctagatcaatgggacttaaacccacaaaaatttggttaacagctaaataccttaatcaactggcttcaatctacttctcccgccgcaagggaaaaaaggcgggagaagcccaggcaggattgaagctgcttctttgaatttgcaattcaacatgaaaggcacctcagggctggtaaaaagagagtttttagatttacagtctaatgctttgctcagccatcttacccactaatgttcgccaaccgctgactattctcaacaaatcataaagatatcggaacactatatttattgtttggtgcatgagctggagtcttgggcacagccttaagcctccttattcagactgaactaggtcaacctggcaaccttctaggtaacgaccacatctacaacgtcatcgtcacagcccacacattcttcataatctttttcatagtaatgtctatcataattggaggttttggcaattgactggtccccctgataattggcgcccctgacatggcatttccctgcgtaaataacataagcttctggctccttccccacccctttctactactgctggcatctgctatgatagaagctggtgccggaacaggttgaacggtttaccctcctttggcaggaaactattcccatccagaggcctctgtagacctaaccattttctcccttcatctagcaggtgtctcctctattctaggagctattaatttcatcaccacaattattaacataaaaccccctgccatatatcaataccaaacgcccctctttgtctgatctgtcctaatcacggcagtcctactcctcctctcccttccagtcttggccgctggcattactatactgctaacagaccgtaaccttaatattacctttttgacctggccggaggaggggaccctatcctataacaacacctattttgattctttggtcaccctgaagtctatattctcatcctaccaggctttggaataatttctcacatcgtaccatattattccggaaagaaagaaccattcgggtacataggtatggtctgggctataatatcaattggcttcctagggtttattgtatgagcccatcatatattcacagtagggatagatgtagacacacgagtttactttacctctgtcactataattattgccatccccactggcgtcaaagtatttagctgacttgctacgctccatgggggtaacaccaaatggtccaccgcagtactctgagccctaggattcatcttcctttttacagtgggtggcctaacggacattgtactagcaaactcatcattagacatcgtactacatgatacatattatgttgtggcccactttcactacgttctatcaataggagctgtgttcaccatcatggggggcttcatccactgatttcccttattctcaggctacacactcggccaagcttatgccaaaattcactttgccatcatatttgtaggcgtaaatctaaccttcttcccgcagcactttctcggcctatctgagatgtcccgatgttattccgactaccccgatgcatataccacaggaaatattttatcatctgtaggctcattcatctccctaaaagcagtagtgctaataattttcataacctgagagaccttcgcttcaaagcgaaaagtcctaataaatgagcaaccttccactaacctagagtggctgtagggatgccctccaccctaccatacatttaaagaaccagtctacataaaacctagacaaaaaaggaaggaattgaacctcctaaggctggtttcaagccagcctcataacccctatgactttttcaacaagatattaggaaaactatttcataacttcgtcaaagttaagttacaggttaaaccccgtatatcttaatggcacacgcagcccagctaggtcttcaagacgccacatcccctatcatagaagagctaatcgccttccatgatcacgccctcataatcatctttcttatcagctttctagttttatacgccctcttcctaacaattacaacaaaactaacactaacatcacagacgcccaagaaatagaaactgtttgaatgattctacctgccattatcctagtcctaattgcccttccatccctacgtatcctgtacgtaacagatgaaatcaatgacccttcttttaccattaaatcaatcggacaccaatgatactgaacctatgaatacaccaattatggaggattaattttcaactcttatatacttccaccactattcttagacccaagtgaccttcgacttcttaaagttgataatcgagtagtccttccaattgaagcccctgttcatataataattacatcacaagacgtcctacactcatgaactgtccccacattaggcttaaaaacagatgtaatccccggacgcctaaaccaaaccacattcaccgccatacgaccaggagtatactacggtcaatgctcagaaatctgcggagctgaccatagcttcataaccatcattctagaactaatcccgctaaaaatctttgcaataggacctgtatccactttataggctaccgcccactctcttaataaggttcactgtagagctgacccagcattaaccttttaagttaaagactaagagaatcgctatctctttacagtgacatgcctcaactagacaccaccatatgacccactatcgtcgcatcaatactcctcacattattactcatcattcaactaaaagtactaaacacaaactaccatctgcctacctcactaaaaattattaacatgcaaaaccacaataatcctttagagtcaaaatgaacgaaaatctgtttacttcattcattgcccccacaattctaggccttccagctgcagtgccaatcgttctatttctccccatgctgattccagcttccaaacaccttatcaacaaccgattaattaccactcaacagtgactaattcaactcaccctaaaacaaataataacaataaataacattaaaggacgaacctgatccctcatgctaatatccctaattatcttcattgctacaaccaatctcctcgggctcttgccccactcattcacaccaactacccaactgtcataaacctggccatggcaatccccctatgagcaggtgcagtaattacaggcttccgctttaaaaccaaaaataccttagcccatctcttgccacaaggcacaccctcacccctcattcccatactaattattatccaaaccatcagcctatttatccaaccaatagccctagccatgcccctaactgctaatattatggcaggccatctgctcatacacttaatcagaagcgccacactagcgctatcaactatcaacctccccacaacctcaatcatcttcacaattttgattttactgacgattctcgaaatcgctgtcgccctgattctagcctatgttttcacactcctagtgagcctctacctacatgacaatacataatggctcaccaatcacatgcctatcacatagtaaaacccagcccatgacctctaacaggggccctttcagccctcctaatgacatccggcctagctatatgattccacttttactctaccaccctactaacactaggcctactgaccaatgcactaaccatataccagtgatgatgtgatgttgtacgagaaggtacataccaagaccaccacacagtacccgtccaaaaagtccttcggtatggaataattttattcatcatctcagaagtctttttcttcgctggattcttctgagcattctaccactccagcctagcccccacccctcaactaggaggacactgacccccaacaggcatcactccactcaaccccctagaagtcccactcctaaacacatctgtactactcgcatcgggagtttcaattacttgagctcaccatagcctaatagagaacaattgtaatcaagcaattcaagcactacttatcacaatcttactaggcatctacttcaccctcctacaagtttcagaatactttgaagccccctttactatcgccgatggtatgtatggttcaacatgttttgtagctacgggcttccacgggctccccgtcatcattggttcaacattccttactgtttgccttatccgccaactattatatcattttacatccaagtaccacttcggcttcgaagccgctgcttgatactgacactttgtagatgtagtttgactattcctatatgtctctatctactggtgaggatcttactcttttagtatagacagtaccactgacttccaattaactagtttcgataacactcgaaaaagagtaataaacctggcactagccctaacagtcaacaccctcctggccccattactaataaccatcacattttgattaccacaacttaatatctacataggaaagtctaacccttatgaatggggtttgacccactatcctctgctcgcattcccttctccataaaattcttcttgattgctatcacctttttattatctgacctagaaattgccctattactacccctaccgtgagccctccaaacaaccaatctaccactaacagttgtatcatcactcacattagttactatcttaatcctaagtttgacttatgaactatcccagaaaaggttagactgagtcaaattggtaagtagtttaacagacaaaaacaatgattttgacttgttagattatgatagtcatacttacaaaatgcccctcatctacataaacattacattagcatttactacctcactgttaggaatactaatctatcgctcacacctaacgtcctccctactatgcctagaggggataatattatctctattcatcgtaaacaccctcataaccctaaacacacactctcccttaattaacatcatacctatcaccatattagtctttgctgcctgtgaagcagcagtgggcctcaccctactagtctcaatttctaacagatacggtctagattatgtacataacttaaacttactccaatgttaaaattaattatccctacaatcatactacttccaacaacatgactctctaaaaaccatataatttgaattaacataaccactcacagcctaattaacagctctatcccactgttatttttcaaccaagccaacgacaatctatttagctactctctttctcctctgaccccctgatgacaccccttctaatactaacagcctgacttctacctcttatgatcatagcgagtcaatgccacttatctaacaagtgccccttacggaaaaaaactttacctgtctgtactaatcacccttcaaatctccctgatcataacattcatggccacagaactaatcatattgattattagtggtgtagttgggtgtgttattattctgaattatgggggaggttatatgggtttaatagttttttaaatttatctaggagtatgatggttgtttttggatatactacagcaatggctattgaggagtatcctgagacacgggggtcaggaattgaagtcttggtgagtgtattagcgggattatcaatggaagtggggttggtcttatgagtgaaggagtatgatggggtggtggtagtggtcacattctttgctgaacaaacggtacctcaaataacttcatacaaatactactgggaaacttagcattttattaaaatgtttaaatttcctattttatcaaatctaacatattagtaataatatattccttttattcaactttaaagttctattcaacaatagcaatttataattttatattattaaatgttattcatacagtttaataattttataatttagcattaatgaaaccagcacagacaatataatgttcatgatattttatgtatatgtttaacatacacatacataattcaacattaatggcttccttaattaccattaatattataattttatattatcatttaagtttgcccttctattttaatattagatgtcttagcatccatcagttctatcaagctcttctcactggttcttctttgaattccagacatggccacaatcttctcttctaaaattctaaaatctgagggctctcgctggctgggtgctgctggaagaactgtaacttggttgttatctcaacggtattttattttaaatgtttcaattaaaagaagtttttaaaaatgtggaaatccctgagaatattcacttttttaaatacaatgggaatgtatttaatgtatggctgaagtctgtttctcctcgtttgatccaggggtgcttctgagaactcttccaagtgccagatcctgggccgctggcagcttggccccagtggcagttcagttaccccatcacggctggggcaccaggggagccccacaggtgggcgaaaattaccgtagattaaaacctaggcagtttaacacaagcagccagcaccaacatcacggtacttgatcttccaacttcctgcactaccaattctatgtctcatcacattctcctctggcctctcggcccccagcacacaggcttcagcctctgtttctgctgaagccctttcttcatacactctagaacatagaacataggacagagagagagactttagtaggaatactgacatttaaaaacttatcagagatatgaaaaatcaactacatgaagtacggcggtatattaaggctttgtgaataaaaacacagtaaagggtgggtgtgtaaagctattttccaaccatccttccaaaccaaggcttttgagggcacaagtcctcccagcaggtggcaggatgggcccagcagtgtcttcagcccattgctgtcatgagttaggaaaggctgaattctattttacatacaaaagaaaacatttatttaattaaagattcaagctacaatacagttcttcataaaacactacaatattttgattatcaatgtttttctgttgctttttctcatgaaacatgatttgcctttgtgaaatctgaagtttcctattctatcaatgagaaggtgtatcaaatggatagtccatccagtgtatccgacatcaattacaaaatgcctccctttttcttaattttgccttttttccctttgtcattcttgagtctctgttagtgcactgaggaagtgaagacatgtacttaaagaaatgccaacatctgctgaagatcagattccgtattttgtattttagttgatgtaatgatgactttagttataatgactttagttgatgtaatgattctaatgaacaagaaagattttgtttcccattttaaaagatatcattaagtcatgcagaatatttttcaatttattatgggtgtgtatgcaaggggttgccatttcacctgcttcagtcttccctctaaaccaatcctaagacacacctaggctgaattcatatcacatgaaaattcatcacatgatgtcctactaggtcaaaaagtataaaaactgacattacggagaaagacttcattgaaaccaggacagaaagacactaaggcacacagtgctcagagcggcatgctgacaagatctctggtgggaggccattgcctggacacctgctgggttttgtcctggacaccattcattcacttgagcatgtttggtacccagggtatttttcaataataggcaaaatagaatgagttcttcaaaccttgtggattttatactgaaaacttccagagatatatcttaggtaattataagaccaagcacaacaacaacaacaaaatcctaacttgaatccatcagttgcagatttcatggttgactacatcaagaggaagttgcaagctctaaaagctggaagaccagtcaatatcaggaactcctcagaagtgaaggaaaagtggtttaaatttgtttaacaaaaccatgttttcaaacttactttaatttatgcatgagggccattaaatttgttctttttaaaaaggaaacttcttaattggaactaaatcattcattattcactgtgatacgggttatatacccttaggttccatgtgattattcacatgttcagctgacagaaaggagaaaaagctactctaatgacttagcttcgctttgactcactggtttttatctcattttaacttccaatctcggttacagagagtgttaaagctggaagaaataacattttggtagatggtaaaggataagtacgagtcatttcaagttgttgaagctttcattaaacaaagcaagctatttgaaatcttaaagctatttaaataaagggctaagacttttccgttttatttacttaaaagcttaaaagatactgttgaaaatttaacagttaatctattgtagggtgtggttagacacttattttgacagtgctcactgaaaattcaattatacccccggagtcaaacttgccagtcatcaaaatgtctaacgatctgagtgttcacggggtaataacaaaccccatactaaacagtttgctagaaatctgtcctataacatctaaacggaacaattgggtggttgtctaagacacctaagctcaatatgacatttcagctaaaaagagtgaacttataactaagcacttcatgcaagttaccaaaagagaagatattctttaataaaaaagtacatttgtagaatcaaagaatctcagtgttgtaagaaatatttgagatcatttcagttaggcttttcatttcttaaatttgaaactgaagctgagattaaacagctaataaaaagacaaagccgatccatgatattggtttgggcaatgatttcttagatatgaccaaaacgcacatacaacaaatgagattacatcaaactaaagagcttctatacagcaaagaaaacaattaacagagtgaagagtgacaactcacagactgagaaaaaatatttgcaaatcatatgtttgataaagagctaatacacaaaacatacaacgaattcaactcaataacaataaaacaaccttgttaaaaaatgggcaaaagacctggacagatatttctccaaagaagacatacaaatggccagaagagatattaaaaggtgttcaatatcaccattgattagggaaatgcaaattaaaatgagatttcaccttactcattttagaatggctattacaaaaaaaatgaaagacaagtgttggtgaggatttgaagaaaagagaacacttgtaaaatgttggtgggaatgtaaattagtgctgccactatggaaaacagaagggacgtttctcaaaaataaaaatacataattactatatgacccagaaattctacttctgggtgtatattcaaacgagttaaaatcagtatgttgactagatatcaacacttccatgttcattgcagcattattcacaatagccaagatatggaagcaatctaagcgcatatcaagggatgaatggataaagaaaattatatacacatatttatagtgtatacacacaatggaatactattcagcctttaaaaaggatacaattctgtcatttgtgaaaacaaagaaaaatctagaggatcttacataaagtgaaatcagtcaggtacagaaagacaaatacatcatgatctcacttacatgtgaaaagtaaaaaatgtcagactcatagaagtaaagagtagaatgatggttaccagaggctggaggaggcaggatagacagaaaaaagaagattaatttgttaaatggtacaaggttcagctagatagaagaaataagtcctagtgatctattgagcaatagggtaattatagttaataataatgtattatatatttcaaaattgtggagtatattttaagcactctcaccataaagtagtgataaatacgtgagttgaaagatatgttaattcacctgatgtaaatgttccacaatgtatacatgtatctaatcatcatattgtatgccataaatacatacaatacttaattatcaaataaaaagttaagatggagctgagccaagaatccaagtctctgaatttagatttttcattttctattatgccaaagtgttttctgaaaattaaaattgaatatggcatgtccaaaagaatatgtcataagaagacaggaatggggggactgctgcatataatctcatatttttagtcagttttgtaacatattattaggagaagaaaatcaaatattttaagaaaatttttataactcctgtaatactgtaattttatggcaaacctaaaaccttcaaaacacagagtttttttaaaaaagtgaatcatatatatgcaaagtttttattgagattattaaagcaaaatccctcaaagtagcaaaacataagtatatgttttagactgtactatgcagaatagcagaatggtaccaatggcaaaaaatctttcaaaagacataaaaattattgaggtctcatcccagctctactaatctatgtcttagcaacctagtgtaattcctacaagttctgaacactgcctttaatgtatctgcatggttcccatatcattttataaacttcaaatattcacactttataattgaaacaatatacaaactttattattaaataagctatgggatgatattctccatctaccctataaggatactatcttcctgtcagaaaatctgagactctccaatacatatttactccccagatcttttctttttcttttttttttttttttttgagacggagtctctctctgtcgcccaggctggagtgcagtggcacaatcttggctcactgcaagcactccccatatcttaactgtggaatctccagaccatgtccagtcagtaatccattattagttttgtctcatgtgccctaaccaccttctctttaccttctatttcagccccaaataaaagttactattcttggctcaattctccaaatcctttgaaggtaactggtgacactatagcttttctttatgtgccaccttgtgatccaggcttcctagttatctgtgaatattcacatcaggttacctggactccatagaggcagcaccaacaaaaaacataattgggatatacaccacttttagactttcgattacatgccccaccttataatgtgtgaactgatttcacttctagacattcaactttcaaacaggtatgctctgtattaaacaccaacatcctccttccctttcactcaagggacatcgggaaaacaaaaagatgcaatgcaaagttcacatataaggataattatttgtgataatggtgacaatgatccctatttcttttcctgctcttatgaatttgcaaatgtcctacaaactgtattaaatgagtctgtgaaagttcatctaagtccctagtattattattttttaactctctagaaagtcctagccacgtagctcaaagcaaaatagaaaagatccaaatcattcataggacaagtgttgaggcaactttcaattactaaatatatttttagccatttaaaactaaaagaaaagtaacgtctgtaatcccagcactttgggatgctgaggcaggcggaacacaaggtcaggcgatcgagaccatcctggctaacacggtgaaaccccgtctctactaaaaatacaaaaaattagccaggcctggtggccggcgcctgtagtcccagctacccaggaggctgaggcaggagaatggcttgaacccgagaggcggagcttgcagtgagccgagatcacgtcactgcactctagcctgggcagcagagcgaaactccgtctcaaaaaaaaaaaaaaaaaaaagtaagaaaactcttttactcctttttatgatttaaattttattttaggtttgaaaagtgagctatatatcacttaacagtcaggaagcgtgcagtaaactcaatctctgaaccgacgttacctaaatcaaagatgttcgttttctcatactcatctctaaaacagaggtagacagagaaagtgcttctttttccgagattgtaatgaattcaaacctattcattaactttatagcagttattttggtttcacagtgaaacataaaaagttctattttattggaaagaaaaccaagtagctatctaagtagttcatgagaaggaatttgttctactgttttaagtgcatgagggataaagcaagacttagaaatatttttgttagaccatttcattttaatagtattttctattataacagaaatgacctacagtaaaataattcaaaatacccttacttctgaaggttatttccacataaaattgtaacattactatgatctaaatttaaataaattttctattgatgttaaaagtttgataatatacagtttgttaaagtggtttggtcactatttgggcacgatcgacttcaaaccataggtgtttaaatgaaccaaagtcttttgtttatttctatagctttttgcctagtttgattaataactagtataccagtcattcacatatagtcataactggccaaccaaggtttacttggtaggagggtgacagtttaccctttaataccacctgattaaaatacacaagatgttctacacaaataacaacaaattgtttatttctaagaacataattttccttttataggaagctctcaactttaatttggagtcacattttaattttataatgtaataattcaataaatggtcattagatattgggttatttggaaaactgcaaaaaatcaaacttctgacaatgtcctttaaaataattaactcagctggaaatagttaaacaagacttaaaaatacaaatcataatggccaggcatggtggctcacgcctgtaatcccagcactttgggaggctgaggcgggcggatcacgaggtcaggagatcgagaccacggtgaaaccccgtctctattaaaaatacaaaaaaacttagctgggagcagtagcgggtgcctgtagtcccagctacttgggaggctgaggacagagaatggcttgaatccgggaggcggaacttacagtgagccgagatcgcgccactgcactccagcctggggcaacagagcaagactccatctcaaaaaaaaaaaaaaaaaaaagaaaatacaaatcataacgtgaatattcaaatgattgtacagtgtaacaattgtatgcaaataattaagaatagtgactataataaaaaagtttaatagatttgacatcaacatttaaagaatataacttacatatacgaaaataagccatcaaaacttgaagctgtcaaattgtgaaaaacagtagtaaacaataaaaatcactgactcattggaaacactgcaaaatgtcatgaaaacatttcagaaatgaaggtacgttaatgaaaaataatcatagttttaaattcagtctcacctcacctttaagaaacagtgtaaaacagcaataaatgggataatttatattactgcaataaaatgcaaatatatatatattgtgtactagcaccctctcttcaatgtatactttaacccaatagctttctaccactggaaatttatcataagaaaataatggtggcttacacctataataccagcactctggtaggctgaggcagtaacgtcagttgagcctaggagttccagatcagcctgggcaaaatagtgggattctgtctctaccaaaaaaaaaaaaaaatgccagtcatagtggctggcacctgaatccttgctgcttgggagactcatatggacctaggctgatttgagcaggggtatcatttgagcacaggaggtcaagtctgcagtgagctatgatcattccatcgctgcagcctgggtgacagagcaagaccctgtcacacacgcaaaagaaaataattcagaatgcgcccaaaaatatataaatatatttctgaaagctgcatttgtaatactgcaaaatcaatgccacattgagacaggggtaccaagattaaggtagagtcaccaatgacaattaaaatctggagtcagaatgctgtatctaagtaggacaacaatttctctgctgcagcctaccattaccatgcagcaaagttgctctattacttctgaattttccacattcttaaagaaaagcagaaaatccagtttctaagacaaaaatcaagttataagtattgacagaaaaatcacttttaaataattgtaaaagtaacaacacactataacagtaaatctaattcagcctgataccaggctgtaccaatagatataatgaaactgcataatattggtaaaacaattgtatggtagaaaaatactggcataaaaatgttcatagcaaattcataaatggaaaaagtagtctgttttatttaaataaaaaggagctaaatgaatggcagacaactacaaattaatagtttatacctttcaagtttagaattaaggatatatttttctttattttttgttttcattattgtgatgtattatgctgaaattagcaaaaaaaaaaaaaaaaaaaaaaaaaaagagagtatctgaccaatacagaaatttgtattgagaagtaaggtgtgtccctaacaaacccacctatgagtcagtttgaaggtagcaagaaaatttttatcactgtcatatacttcagaagtatttgtgtacctaatgatttccagtgtcatcaaacataggtaagaacactgagtattagcactggttgatatttggtctctacaatagtgagtatggtggttaattttagatgtcaacttgaatggactaagggttgcctagagagctagtaaaacctattaaagtattatttaatatagtattgtagaatatacgttaaatacattatgttacatgtattctaatgcaacacattataatatattaaagacattattccattaatacagtacttagtatagtattacttaatacattaaaatggtaactaagcttgacgaatccctgagcaaagccagttagacctcataagcagcctctcaaccttgcttgttttgcaaacattaacaaaacttcaggtattttttgtaaatgcctatatgaaagaaaaacagaactttctttttctttccaaataggagtgtttactatagttttcctgtttctgtatcacattacacactgaatgtgtgggagagcagagagatttaatttacaagttttagatcaagagagcataaccagatcccaggttaagacttaacactacagaatactcatgttagtaatactcgtcctataaaaagatacacttttcactgtaattgctgcaaacaataaaatactgtaaaataatatgcagtgtgtttgtgaaaggtcaataacatgtttatatttttgctgttgaaaaactacacaaaaacaaatgactacaacagcagatcaattagtatcagtagaattataccatcaaaaattccactgagcttgaatgtaagatctgacataaccagataattccatggcaggggaataaactgcatttacattctctttctaacaattagtgcaagcatatccagataaactatattgattctacattatcttagagtgaaatcacctaataacttcttcagtagtctttcttttaatttttatcctaattatccgtctgaaaatgatcttttaaattgggaaaactctgattacattacatccttcagttcagagtagcattgggtaaagacattttggctgcagacaaatcactctttcatagtcatcagctttcagaacattctaagactttattttccatctaaacttttcagttaatttgactctaacttttaattgatgttactgagcagcaaaggagcctgaaggacactgctttgtttggaaaaatgaagaaagaaaggaatgtaaatcctgtaaatgtaattctaacgaaatcaagataaaatatagtgtttataaaaggaaatacaattatttctaataactgtactttcatttcaaataattttcaacaaattagtgatgtagaataaatacaattccagaagaatccaggattttttttctattgcatggctttttattaaattatagctacttgaaggctttgagaaattgaacaccagtaaaactgcccttcttttgttaatatgttttgttttcttttttcatttttaattcaactagtcattcacaagaaaaaattcactcaggtaaacttttttgattattctttcatagcatttaacgcgtgttatttattgtagtcttttgtctatgaatctattaatgctaagaaactgaacattcctaggagtgtcctaataagaaagaaacattaacaatttcagctgtatttttacttaaataaatattcatatagtttacctttcaggatcataacaaacactttaattatataagaaggtttttgtatatacatcagactaccaagaagtcatatctgattttgtgcttttctactactcttcccccaaacacttgttcaaaaagtttacttttaaagggtctgaactgtgtgtcaagcactgacatcagcatgttacctgaattaactcattaaactcttgtgatactcatgtggtattagcagtgaagaaactgaagcacagaagcttcaagtaaaatgtccggttttagagcaactgaacagtagagtatggaagcccagttactgaccttgtaccattgcccagtattgtgaactgacctaaaaaggcctatgagatatcaacccattaagatccatgacataaagaaaattgtttgtcctacaatatcccaatctggatgaaggcacataaagagaatatgcttaagcatgatgacaaaaaaataagaaagaactgtgaatgaactttacaaaacagaaaagaacacaagggactttggaaccaagttgaaaattaaatatgttcatgtgcacataacaaaagagtgatcataaataaactgtgtcaacactgtactatgaaggtgaaactttctttttaggattagttaaaccttgtataagttgtaaaaaaatgcaaccacatatattgatgtactaaacccaatgtttcttttggcttatatactaaaaacaggaattccttcctgtaatgaagaaaaaacacaggcatcaaggagtaacaaaattaatgtcttagaatctaaaatatagaaacaccaattaaggctttttttacataatacatgcaaaaactgcatcagaatttacaaaaaatctacagcgtaattggttctggcaataagcagtcacattctgctggaggtaactttagtaacgtcaagcaaaggtcttaaaattatgacaggtggtattcatttaaaatactcttaagagctcttagaaatcaagaacacagtatctggacccttatccacactcaatctctttctaactgggaaattttgggcaaagttttaaactttcttgaacataaaatgcctagctagcaataactttagaaaatactaggagtttgtaaagttacaagaatcaaatgagttaataaatgtaatgtacttaatgtaataatgtgcaaaataataattcattattttaatatctaaattctctagcttgtagttattttgaacagataaatatatataattaaaatttctaacatgtgtttttgattacttatcatgtagaaaaatacagctttccagatgaaaatatagtatataatgtagaagtcacaaataatatttattaaactggaatgctatcattttaaattattttggagctcattaaagtaagtctgcactggccaactttttatttattaattaaatttttgcctagcacagttaatctccttttctaagacttaattcccaaatctatagcctttcttttcccatttggagatgagtgggagtactgttcctttcttgccaatcccttcctctattttcattataataaccaatatgcccttgcctaagcatatgcccccagttaataatacagattcactgtactgtctcaccaaatttaacctgttatttttggaaacagggtttgtttaaaaatgggtttgttatttcttaatacatgccaaatgtcatcagtatatcgtggtccagatgtattctaaataccaattgaaaaacattcttaaagctaagaacacacaacatacttcacagagtgaacaactgtgagaagcctggggattgtaggcattcttggaaaactattatttttttttccatgtgtgtcaagcatttgcataggttatatgttttatagctccagttataaaaatagggaataaattatattccctcacatctgtacaaaatagcaagaatacacatctacagaagtttaaagtatttactctttttttttagttaatacgtttcagaaccttaaagagagcaaatcataatacccattgattataatgtcacattttagttattacattattacatttacttattataacttttagaattttaggagggaaaaaataattctgagtgtgaaatttgaatatttgcaccctaaaaatttccaattccattttcaataatttagtagaatgtttcttagagaaataagaagacaattaaaaatatgaagtactactaggttttcaagtatattgcaaagccataaataatatataatctatcagtggtacaataattaatatattttttcaattatattcagttgtaagaactcaatgctcctaaaatttttaaataatactatataaaagcaactcaaatgatatcagctcaaattcatgtatacatctttgcagctaacgtcttttaaaattaaaaataatttaaaattttgtcatacatttatgaacccattttaaagaacataacatgtcatacaaatgttaatttaatacacaatgcattagtaaaaactgttctgtatacatatgtttatgttagaaaactatttttaaacagcaattcgattctattgattcatcaaattattaaatcacaacattgctaaactcaatttttactctcctaagcatattggaatctatgagaatatacagtagagataataatttgaatagaatttaacttatatgttttagcaaagaagaaataaaaactggaatattatgggtttctaacatgcctatttgtttgttagttttccttttaaaaatttctttatagaagcattttgagtgaagcccacagattatttaataacttattagttatttaaaaaagtctgccttgttgacaatgtggaaaacaccatagagtggggtcccccaccccaggagctgcagaccagttagctgctcataacctgttaggaactgggcctcacagcaggaggtgacctgcgggacaggtaatgctgggtggcattaccacctgagctccgcctcttgtcagaactcagagcggcattagattctcataggaccaggaaccctactgttaactgcgcatgtgaagaatataggttgcacactccttatgagaatctaataactaatgcctgatgacgtaaagtggaagagtttcacatactcccccatccccacaacccactcacccagccatccctggtctgtgaaaaattttcttccacaaaactggtccctggtgccaaaaagtttggggaatgctgtgttaaggtgaaaaagggtacatgtggtaattgtaaaaaaaaaaagttcaataaatataggaaaaaactctaacatcatatgtatatgtggacatatatacttacatatacatgattttctgatttgaagaatgtataaaaaatgagaaaatgacattgaaaacctttttaaggatcattcattaatatactctcgctctctctatatatgtattatatactatatagtatatataatatataatacatataatatatagtatattatatattatatgtaatacatataatatatagtatatagtatatatattatatacatataatatataatatatagtatatatattatatacatatactatataatatatagtatatatatttattatatacatatataatatatagcatatagtatatagtatatatttatatacatatattatatattttatataatttatatttatatacatatatattatatataattacatattcatatatgtatatataatatataatacatgttttatatatattatatatatacattttatatagacagggtctcactatgttgctcaggctggtcttaaactctagctcaagtgatccagtcttggcctcccaaagtgctgggattacgggcataagccactgtgcctggcccatagttaagtacttaagtcaaaactgatcattgtacctcctttctcttcctcgcttcattcttgaaaggaattcaacactgaaaaagaggtggagacttaactgagtcattcacaaataagaactttagaaaagtgaaaaaacatagttatacaaatcatttccaatgatttgttcatctttaaaacataggccaatatttctattttacccaactttactcagctgtaggatgcagtccagaaacatcttagtgtaagagtattttttcataaaatgtaagatattttattcaaattgaatggctgatcagccataagaattccactgtaaagtaaccaaagaagtacaattcttacaaaacaatcatgaaatagttttaagaattaaagaaaaagtaatcacttttcaccaggaatcaaacttttagttggcatagcataaaataatttctcacactggcaaaaggaaaacctccagaaacctccaggcaaatgtcctttccccactcccactcctaaagaaaatatgggctagaccgaggcaccatgatctctcctgcctcttggatttgctctctgtatcccagggctgtcttctagtctaatctcactcataaagctgagcaaatggcataccaagacagaggatctaacatgtgtttgaccttttggaggcatctcaagtccctggattccacctcctgttctccgtattttcaaacatgttctcgaatatgtgtttgacctttctgaagtatcactagtccctggattccacctcctgttctatatattttgtaatgttaatgtccaatttcatttttaaaatgtgagtttctacacaagttgtttcttatttgtacccgaagactttgaataggctctggcactcccagacatgggatatcaaacagatgcaggccttaagtaggtcataggactggacttacatacaagtggctgtggcttgtgagactaggttgtagtggtttttttgttgttgttttgttttttcattttgtctaaggacttgaaaaccttcaggggagacgtgagttaagatttgtcttcttctagtgatcttcttttaaaacacaaatcaatcctgttaaggaatccattaaattactattagtgcgaatggacttttttaggtagcatggatgaattcaatgtaaatgcaaatgtagtatgtggaagaagagccattctcattctatgaacataggacaaggatgagaatatatataacctatagttaatgaaaaatatatatttctgatttatgtgaaatcaatttaagagattacataaatatattctatagatataatatgattttcatcagagcacagaggatgaagagagaagagagaagataggagtggtggctactagatccttttgggggattatttttaaaaaggcagtttttggcaataaaaggggactaacaccttctaatagatatccactggcttgcagaaaacaaagtgtcagaaaatttatcattggagaaaagtcaatgtttccattagtattaatgtggctaaagatggctcaagggtaaaattattcaaaatactatgcatcacaatagtgccaccctgtggactactctctctctcaccctatggggaaaggggctatgtgaaaagaaaaagaatttctagcgcagcaaaacaaaattctttaatttttttacatagaaattgatagtgtttgctatcagtgatgtaattattttacaaagaagcccttgaactatggcagaacttctggatgctctgtcactatgtgtcaatctcaatatatcaatcataacacgtgtgatttggggttaatatgaaggaaaaacaaacttctcttcggttaagtatattttccgagatttaaattagtttcccaatttttttccccaggtttccaaattcttagtgtaacaccaaccaaatatcaaaatagattattagagtttcgatacaataaataaaattaaagagtaagcttataattcacattatttaattacatgcattattagagaggacatttcattaaagcatgcaagttgcattttttttttttaaattttgacatgtagatagtttaaactaaaagccagccaacactttgatatagcagaagacaactgggaaatgtcagttgactaaagtggttatttaaagaaaataaggaaacacaatattctttttgtctattgatatgtgatgctgtactgttattgggcaaactttttaaataatagaaaactctaatgcttacgatgacaaaaacatgttctgtaaaatagcactgtatatgaaaatagtacaaaagggggaaattagaactctgacaccacagtatcaatgaacatcacacagactgaagatcacagtagtgaatgaccaacatctttaggctggaaagagtgggaaaaattaagaatttcatggagatgttattttcaaaaatagactcaataaaatcaccaaactcaccactgggttcagaatgtgatcaaccatctctttcacttttatgttacctttgtggagttttattaatggaaatgaagaaatttactagaaaaacatgattgcaggcactgttaaatttactttctctttgtataatttcatgaaagtgacctgaactgctttgcagcattagtagggaaaaagataaatttatgaaattaaaaggtgagaatacataaaaagtttttatctttccagtgagaaagtgataatcataatgtttagttaaagctatcatctaaccaaacccatcagtacgctaattgtttttaacttgagattttaataatgctgaagtatttccgtcacctcagtattagtgcttccttgtttaaatctcaaagggccaccatccaaggctgcaaatatacaaatgataaaattttggtatttaagaatacccatcttctagtaggacagccatgacaataataatggctttgatagaagaaaacaagaaaatttcaagaagataaatactagggaaagtttttagattaacatgcaagtatgataccctccctcacaaaaataaagttcattaacactaagcctgtaaatttcatagaatacttcttgaactaggagaactggaatcacccatcctgttagaatgcaattaattggaccctcttgaacccgtatcttgtgtgtcaggagttgtaaatctgttaagcatcttcaggcactaaacaagatctgaatactaatgggttcatttatttcactgattactgtatgcagatatgaaattccaggcactgatttttcattaaaccactctcttaaggttaacttgcccctctcttttcacctgaatccatatgcttgccacgtaaattgtaatattgatttttaacatttccccacagttcaaaaatattgtttgcaaaaaatcaagggccttttctaacaattcatgtaattcctgttattagctaatgtgtaagagtagggaacaattaaacatactgtatacaaaatcttaccatcctgaattgcacccaagatattagttcagtcatccttcaaattacctcacaactaaaaaggatcagatacttaaataaaaacttcaggcaaggtaggaaagaagtcttttatcatccctgtatattgcaaaagtgttccattctctctaaattcacattatatttattaatgagcagcacatggaaagaaagaaaatgagagagagagagaaaaagagaaagaaggaaggaaggaaggaaggaaggagagaaggaagagaagaaaagataaagaaggaaagaagtcaggatggtaggaaagtgagagacagaaggagagctagagataacgatgagagaattaaaagagggaaactctaatgtctttgatatcccccaatttaaaagagaaggatgtgaccccctcccccgtttacatataatggaacaagccaagtctccattcactgcatgtggacagtaagaaaacttgcatggggaaaacttttggggggaaatgaaggtgatttccgagctgctactgcagttatatatgacactgacatttatttcccataattcttgcccacaggaaacacatcctttaagaaactgaataaaatcaagtttgacattctcataatctgcaaggtatcaacttccctgagaagctcacattcccccaaaacacacacatgtatgtaaggagcgagacattcaggagatgagctgtgaaaggtacttccacattgtgagggtgccaaggatttggttattcctgaacctgaatccgaaaagcgggggtggggtttgcgatgacaaatgagggtgagaagaatgtttccatgaaaccagacacccttttggaatctaggctgagaatcaggatcccacccccttgcctaccgccaggctccagtaagcaacctctggcgtcctcccctctgctccttccgcagcagcagacatagggatccctagcagccagggagcttaggtcccgccgagagctcctgccaagcgcttctctctcgactagttatcaattgagaaaaaaaggatcagactcacaacaaggatggtgatcaaaatccagtgtcaggcaccagggtcccagaaggttccggctcctcttctgcgcccttacccagctcttttcgcctcgcaaagggtcacccagggagccaccagcagcagatccttcccttttgctcctcctgatagcgccaatcttcgccaccactgccacactgcgcgcccgctatccactcacggcacaccgagaaggcctggcggagacagcgcagggggaggagggtggattaaaaggatagatttttggaagggtaagggagaaaaactttgatgttgtacccacacacaggactgagaagaaaccaaaagaagttgcagcttcaggagctgggaggacgctttcgccagctcggaaaaaaaataataataaatcaccccctaccaaaatcagggggaggaatcttcctgctccttgagcgatcactgagcacacctcgcaatctctgatcttcgaacccactgaaaaagcacaaggcatggggagtcctgttggttcacgcccggggtgcgaataccaaaagcacctcccgctggaaaggctgcaggaatctcgaggcaaagacagaggcaaacgcaacgctgggaagagcgaggggtgctgccatctgcaaaagcagagacgcgtctcccttcgggcaaagtgactgttacaaagtctgttccctcctgcgcaaggacagagacatttaaaggcctgaacggacgtcagcaccagtcgagctcgctgggtgagcgccaggtctccccaccccaaggatagcgcgcacagggcgatctgctgctcgcgaggtagagagtggcttacttggggagaaaacattgaatctgtaaattaccttgggcagtatggccattttcacgatattgattcttcctacccatgagcatggaatgttcttccatttgtttgtatcctcttttatttccttgagcagcggtttgtagttctccttgaagaggtccttcacatcccttgtaagttggattcctaggtattttattctctttgaagcatttgtgaatgggagttcactcatgatttggctctctgtttgtctgttgttggtgtataggaatgcttgtgattcttgcacattgattttgtatcctgagactttgctgaagttgcttatcagcttaaggagattttgggctgagacaatggggttttctagatatacaatcatgtcatctgcaaacagggacaatttgacttcctcttttcctaattcaataccctttatttccttctcctgcctaattgccctggccagaacttccaacactatgttgaataggagtggtgagagagggcatccctgtcttgtgccagttttcaaagggaatgcttccagtttttgcccgttcagtatgatattggctgtgggtctgccatagatagctcttattattttgaaatacgccccatcaatacctaatttattgagagtttttagcatgaagagttgttgaattttgtcaaaggccttttctgcatctattgagatgatcatgtggtttttatctttggctctgtttatatgctggattacatttattgatttgcgtatattgaaccagccttgcatcccagggatgaagcccacttgatcatggtggataagctttttgatgtgctgctggattcggtttgccagtatgttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctgttagaattcggctgtgagtccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcatagaggtgtttgtagtattctctgatggtagtttgtatttctgtgggatcggtggtgatatcccctttatcattttttattgcgtctatttgtttcttctctctttttttctttattagtcttgctagcggtctatcaattttgttgatcctttccaaaaaaccagctcctggattcattaagtttttgaagattcaatgccaaccccatcaagctaccaatgcctttcttcacagaattggaaaaaactactttaaagttcatatggaaccaaaaaagagcccgcatcaccaagtcaatcctaagccaaaagaacaaagctggaggcatcatgctacctgacttcaaactatactacaaggctacagtaaccaaaacagcatggtactggtaccaaaacagagatatagatcaatggaacagaatacagccctcagaaataacgccacatatctacaactatctgatctttgacaaacctgacaaaaacaagcaatggggaaaggattccctatttaataaatggtgctgggaaaactggctagccatatgtagaaagctgaaactggataccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaagaacaaacaaccccatcaaaaagtgggcgaacgacatgaacagacacttctcaaaagaagacatttatgcagccaaaaaaacacatgaaaaaatgctcaccatcactggccatcagagaaatgcaaatcaaaaccataatgagataccatctcacaccagttagaatggcaatcattaaaaagtcaggaaacaacaggtgctggagaggatgtggagaaataggaatgcttttacactgttggtgggactgtaaactagttcgaccattgtggaagtcagtgtggcgattcctcagggatctagaactagaaataccatttgacccagccatcccattactgggtatatacccaaaggactataaatcatgctgctataaagacacatgcacatgtatgtttattgcagcattattcacaatagcaaagacttggaaccaacccaaatgtccaacaatgatagactggattaagaaaatgtggcacagatacaccatggaataccgtgcagccataaaaaatgatgagttcatgtcctttgtagggacatggatgaaattggaaatcatcattctcagtaaactatcgcaagagcaaaaaaccaaacaccgcatattctcactcataggtgggaattgaacaatgagatcacatggacacaggaaggggaacaacacactctggggactgttgtggggtagggggagcggggagggatagcactgggaggtatacctaatgctaggtgacgagttagtgggtgcagcacaccagcatggcacatgtatacgtatgtaactaacctgcacaatgtgcacatgtaccctaaaacttaaaagtataataataaaaattaaattaaaaaaaaaaaagaaaacagatctggtggcgctgctgagtgtcaaaccctggagcccatcatcaagacgttatactggtggcagttctgctgtgagtgcacttgccgaattgaacagagccagagctgcgtggagagagagctggccactctgcacgcgcgcagccaatattgggttaccaaggagctcaacacctggtttttagaaaaaaacacttctctctttaactctggtttgagtcagtattctgatttgcttctgaaagttagttgaaatccatcgagatgtctttcacaagaaagggattagactttcccgtcttggaattccaatcaagataatacttaatctttccttaacccccactgtgtacttcctaactcacagtcacaatggatgaaagtattcaagcatcttcaaatgaccattaccctgcattctaagacgatttgcctacttagacgtcctttagtaactgcaaattatattttttcaagttcgtttgccagctggcttcagatcaggttcagtcaatgaaaactggtgtgtaggaaattggccggtgcccaaagagtaacagttaggttgttcctcctcctttgcctctgctatgggtgacatctacaccattacctgtcctctaagtggttctagcttccatcagggaatgctggctccttgtctttagtagcttgaccttccccctttatactttcaacctgtttctgattataatttgacttctcatataatcagagggagacaatttactgatttcaatcaattactattctctatattttatttatcatactataagactgcattttatgtgtgttttaagcatgattcagccactcaaaatttgacaagagcagcattggtatcttccaaaaggaaggtcaaatcctgctgtgtggtaaactaattaccataagatctacaaactacaggcttagggttttactttgatgactgttatttttataattctgagtatcagtgttcaacatatttgatggctatcctcatcaaatgatcctaatttatttattcactaatttatgtactctttgaaaatatgtattgacatcttctgtatccctgtcctcatacatctctcagttttgttgcaacagaggaaagaatatggtgaaacaaggagttggccccttcttgacaacttgtgcagacacaagtgctttgaatggggaagagactgggaatgcaattttcttagtgtggtgagctattctgcaatattataacagattcaatatctaaagagctgcaactcaaaatgaataagataaattgaagtgttgtgatttaagtgcaaattaaactctcaaaaacattaaaatacaggttttgcctgtaattaacaaagcaaagagagagtgtaaatcttatgcagcaattagattggtccatggtaaaacggaggtagctggtaatttatttttctatgttggggaagaaatttaaaaacaaatatagtaaacagcaattaatgttttatgatttgtaaataaagttatatttttaagattgaagcctctcttaccattctcaaagagccatttcaagccttgaatctctcagggcttcagtctgaattattataactttccagtttgagaacatttttcatttattcaacacttaaattgtatgagattatattttcaggaacaattatgtttattttttatatgaaataaaagtggacaaaatattaactgataattgtaaaagtattacaagaaatacaaggcatattataattatgtgtcaataaaaagagaaatgcctgtaaaattataataaatcattcaaatatcttaaaagcaaaatgcataaaatgtagaatgtatatattttcatttgaatgaccattttttaattaaaaaaataaaaggattcttaaaacattcaattagaaactacggattttcagcttttcccgattctattagaaatgtaaaacaaaataaatttaaattcaaaaacatgacagacccttcataatgttttctctgcctactcattccatgtcacttctaatttctccctccatacaaaatatgttgaaatcatactaaatctttgccttctgtgcttttattgtaacacactccatcatctttacagttgcaattttctgttcatataatttgccttctttcttccattttatggcttagcatctttttatctttcttggatcatctaaggtttagttttcttgtggaaatttacattggctgcacttcctagatattcccattgggcgttgatttcctcttatagcacttcctccactgcgatgtgttgccacactaactaacatagctaacctgttatacagtaagaactgttaggagagagttaggataaaaagactaaagtgggtagagttagggtttgggttacaatactagctgtatcttgatttgctagcatagcatacatactagtcaacaagtatatatgtattgaatatacctataaataaatcaataataacttttaaaacatagacctttggtttgtatcttataaaaagcttccctaaaatgtatgaaaggtctcactgactttatgaaatatacattgctctgatttcttatttatttttatttatttatttatttattttgagacagagtacctctgtcacccaggctggagtgcagtgtcacaatcttggctcactgcaacctccgtctactgtgttcaagcaattctcctgcctcagcctcccgagtagctgggattacaggcgcatgccaccataccagctaatttttatatttttagtagagatggggtttcaccatgttggccaggctggtctcaaactcctggcctcgtaatctgcctgccttggcctctcaaagtgctggggttgcaggcgtgagtcaccgtgcctggccccttgctctgatcttagtcttcttaggctctggtccttaatatttgagaatgtctgacaggacccgtgaattttattttttaaaaattgtatatgcccaaaatttgcatgcagtttgtatggaattttgcaaaatgtatggaaatcctgaagtctggcttgtttttttcttttttttttttttggcagggtctcgttctgttacccagactgggatgtggtggtgttatcgtagcttactaccttgaactgctggactcaagcaatcctccaggctcagcctctgagtagctgagattaaaggcatgtaacaccatgcccagcttattttattttatttttttcagagacaaaatcttgcattgttgcccaatctggtctcaaactcctgtcctcaagtgatcctcctgtctaggcctattaatcccaaagggctgggattccaaacatgagcggctgtgctcagccttgaggttctggctgtaatctggctgttatttatggaaacaacagaagttcttggtattagcagcagtcattcttcttgagagagtcaccccacaagactgagatgaatatatttaagaacccaaaatgaggtcattatggcagaacagaattgatagtgcacattaaaagacattacacactttgggtgattcaactaaatcatagtctgaaatgcagttacaaagtggtaatgttcaaaagatcatctattagtcaaagttacaaggaaagtcctggttatgttggtaaaaattgatatctgtgattatccatcttcaaatgatttgttaaatgtttattaagataaaaaagttacatttcaaaagtatttatattatttgtcaattcctccataacaaattatcccaaaataaagtataataataaaatttaaaaaaagatgagaaacatattcttcaccacaggaaaaaaaaaacaacctttattatctcaaagtttctgtggtgcaggaatctgggcatggcttaactgggtcttccattcagagactctcacaagttataatcaatctcactcacatgcttgatggtgtattcagtactttgacagctgttgtccagaattccatataatgtgagcctcttcggtatggaaggtttcttcatcaaaatgtgccaagccaaaaaaaaaaaagctattgaaaagagtccaagacagaagtcacatcttttgtcacctaatcacagaatcaacctctcatcatgtttgctgtattctatgcaacagcagcaagcctatagatccagctgacacccatggggaaggtattagacaagggttggaatcccaggagatggagaccattagaaacaatattaatctgctgattacagtagtttgccaaagaatcctgagataataattctgggctcaaaattcttatgaggcactgaggcaggacaataaaggaacagaaaataatactatattaattttaatgatttattaatactaatatactggtataatgtgctaaaatagtatactacatttttggtaatttgtccaggagtaatagaaacaaatccaaatattaaatatcaaagcatattataattctatgataattaactctgtaatttaaaaagtctaatataggaatataccaaaaaagaaagttttaaaaatatactttatttcctaatatatcaaaatggagccttcacatatgaaattagtaaaatatttttgacctaataatttcatttttagcttttctcttaagaagtcatattgtttgcaaaaatgttatgtaccaaggagtttataacatgcagttgtagtcaggaaaaattttaaattaaaaatgtgcaataaatatatgtaaaaacagaataatataggcatctaaatagccctatataaaaagacaaacataacattacaaattagcattaaccaaaaatatgctctgaagtacatcccttgattaaatttacttaagtttcttttggaaaaaaataaaaataattgtatttgctagtaagagaaggtagaacattatttgcccatttgttttcagaagtaaaacaagacatttatgttttcagaagtaaaacaaatacaatattttctaagtaataaggttgagacaagaaaaaaacagcaatgagtaaaaatgtctatttacatgcttttacaggaaaacaagacttaactactttcttccaaaaaaaaatttaagtagaaatgttattgttttactaaaagtaaatacattttacatacttctctcataattttaatctgaagttcagttatggtgatcatattagtcagtgttttccagagaaacagaaccaacaggagagaaaaagagacagggagatgaaataaggcattgtttagcatgattatgggggaaaagacgtcccaagatctgcagtcagcaatctggagactcaggagagatggtggcatagctccagtgtgaaagctggcaggtttgacactcaatgaaagccaaagtttcagtttgagtccaaaggtgggaagaaaccaatgtcccatctcaatgcattcaggtaggaggaagttccttcttactcctaggaaattcagcctttttattctattcaagatttccactgattgatgggacccacccacatcattggggaagtctactttactcagtctatgaattcaatagagaaaaagatatacataagctatcatttaaatttttaaaaaatcatttctaatcaaaatgtagcattttaattgtgtttttagagttttgtaagtgtccttaatttttcagcttattcttaaaaaatcaatttcactttattcaaaattcccttttggaaaacattaaatggtggcccatataatcttagactttacatgctttttgataaatataacattaaaagtagcatgtgtagtaatttaaattacatatataagatgtacatatattattctccagaggaaataaaactgttaagaactctgatttagtcagggttctccagagaaacagaagtgatagaagatgtgtgtgtgtgtgtgtgtgtgtgtgtgtgtgtatacatatatatatatatatagagagagagagagagacagagagcgagagaagaagtgaagagaagacatttattaggagaattggcttatctgatttcagaggctaagaagtctcataataggccatgtgcaagctggagaaccaagaaagttgttagcatggctcagtccaaatccagaggcctttccagactttaccactaatcaatacactatatttagaaaggtatcataataagtctctatttcaatttaaaattctctattttcagagacaatgaaggacaaagggtcaaattttacaattattgtgaaaagagattatagagaaagggcctggataataccaaaaatagaagaaagaaccatccatctggggcagagaatcagcagtgatattacttgaaatatggaaattaataatatgtaaggttgagtttaagatctaaaatataaaagttaaatttaaatctaacatatatgatttaactctctagaatatatctactcaattatatgaaacaagcgggctgattctcaatactttatcaataataaaggtttttccaaatagttttgaagaaatatcaaagtgtctaaaaaaaaagccttagaccatgaaccatagagaaaaagacaaggtttgccatgaaaagtgaataacctttttatttccagttgtgatgtgttgatacaaaccattagcactttcatttcagtgaattatgccagttcttgctttaccttgtcaagattatatatatgattatataagccaaacatgcttccaagctgtaactcacaccaaaataataaagactgcgaatgaacgactatatttaataaaaaacaaaatcatacacttattttagatttgaaaatgtttgggcaataggttaattagatctcttttgagtgttttgtttgggatgtgtgtgcatatgaatctgagtgtatgtctttgtgtgtgtcatcagctcaacccaccttgaagaaaaaaatatgataaaataaataaataaaatatatattatcagaattcggtacagataaaaagtacaaaatttgatgaagatctctgtcttgtttatcattacacaagaaaggaaaaaattggaatataaggcaaaaattgtttgttcatactagctacttttgaacactgctctgcccaacaattttgcatccattaaaataaatataagaatcaaatatttcaaagcaatgctataaaatacttgtatgtagaaatttgttgatgccctcctcagcatcctgtccatgtcttattttatatcagcacaattcacaattgcaaaaacatgtaacgagcccaaatgcccatcaataagtagattaagaaattgtgatataaaaaaataaatatatggggatactattcagccacaaaacgaaaaaataatggggattcacagcaacctggatggaatcagagactattattctaagtgaagtaacgtcagaatggaaaaccaaacatcgtatgccctcgctcgtatgcgggaactaagctatgaggatgcaaaggcattagactactacaatggactttggggacttgggagaaagggtgtggggcgtgaggaataaaagactacaaattggatagtgtatactgcacaggtgttgggtgcatcaaaatctcactaatcacctctaaagaacttactcttataatcaaacaccacctgttccctaaaaacctatggaaataaaataaaatgaagaaattttgtgtatgcataccacatattttttaacttttttcacaggttcattgagatataatttatatattatttaattcactcatataaagtataaaattcaattttttagtgcattaagtgggtgaatatgcaatcaccacaacataattctagaacatttttatgctccttaaaagaaaccttgcgcccattagcaatctttcctcattttccctactctttctttaaacccctcccagccttaggcaaccatccatctacttcctaactaaggatttgcctattctggaaggatttgcctatcctagacatttcatgtaagtggaatcataataatatatagttacatgtgtctcactactttcacttattatgttttcaatgttcatcctttttggagcatgtattaatacctttttctttttcattgccaagtaatgtattttatggacaggccacattttattaatctactcctcaattgatgaacatttctgttgtttcctactttttgttgctataaatacttgtatgctactttttgtgtagacgtttgttttaatttttttggtgtacacataggagtgaattactgagtcacgtggtaattctatacttaaacttttgaagaactgtttcatttttctgcatgatgcttgccaattatcccagcaccatatattgaagagtgtcctttccccactttatgttttgtttgctttatcaaatatcagatctgtagattgctttgggtagcattgagattttgacaatattattttttgagttcataaatataggatatttttctatttatttatgtcacttccaactttcatcaatgtgctataattttcagtatacacatttttcacatcctacattaaaattactccttagtattttatttacttatatatttgttttgatgctactataaatgtaattactttattaatttatttttcagatagtttatcatgggtgtttagaaacaagaatactatttgtatgttaattttgtaactctcaactttattgaatgtgtttatcagctttaacgggtttttttggtggagtctaagattttctttatgttaggattacattttcagaaaacacagacgatctcaccccttcctttcctatttggatgcctttcatttcttggccttgtataattactctggatagtagattacatacaatgttttcagcatttgtaatttgacatgaaatccatctgttgcaatacactgattttcacttttcaacttgaaaacctggacatttatcactactctccctttctcttggtctagtccttatttaaaaaaaaaacctaccaatctaaactaggataattatttttctataaaacaatttcaaaggcatttaaaaaatttaacaatttttaaactttctatgtcaatgattttaaactgcggtctctcaaaacaaatccaatacctttagtaggaaaaattatgttaattcctacactatcattgggtctagccaagagttgatattaatagatatgcttatttattaccttgttctaacagttgtagtgtaagtcttgaaaatcaagtaaaaatttgtaaagattataatcgcacaaactccctctctcatgaggcacacagttaatccaaaatattatttctaacttaccataaagccaacaagtaaatacaatgtagtgtttaaaaataatcataagtatattctagaaatgaaacattaattgatactatttattgaatatctcatatttatttacatagaaacaaaggaatcaaaagcatattatgtaacattgaaatgactaaaaatacttgagatagcattgctacataaatgctatgtaaatgctgacaaaagtaaaaatgccattcgctacatttgctaaacatactgtgacacattataagtattttaaagatatatcactaatgcttgggtcaagtgggcaaaaatgattctaagtatttaattgtggaaaaatttagtgcaggggatagtattcatgtgatggaaaaattttaagtggaactcagagattagaagcagcaggaagttttaataacgtaccaggtgcagtgtataggatacaagacagaactataggtaaagtctgagtctttccagcatagctaggagacatggctaactccacctgtccccaggccttacctagaagttgaacagctccaaaccaggtaaacagaacaattttccaaagtcaatcaatttatgacgttaaagcacttctaaaatttaacctctgacttaaattagacaaaatggataaattttgatgatttttttaccaatgattttaacactgtctttatttcccaaagattactgaagtcatgtgaaataaaaggcattggagattctatttttctgacaaaatatgtaagagccttccttttcttctaagccaagtaattagggctcctttatatatatacatacatacacaacacttctagacaggaaacgatctagcagttgtaagtttttctttctcattttatgaatcctaacacaacttccatagaccatctatgacatgaactttctgacttttcctgtatttccctctttcataattagtcattctactttaggacaagaatttgccatacaagatcctctctcttgtaacatttatttccttcataactttcttaccataaatacatcttcatatccacaactttctttacatctccctccccgactgatttctgatccccatccaaacctaaaaggtcagataacacaaagcaaaacaagggagagctttacattttgagagagacctgtctgcctgaagttcttgggattccatgaggacaaagaggtttctcctaaaatgggttttgtagcaccttctgtttttctttaaggagtcccagcctgtcagaaattaccttagatcctctcatgtgggcactgagtggcaacaagacagactagggaacactggcaacaagacagacaactgagtagaaaaagaaaaactacagtccccactgtaaagatggataaactgaggcatcatgcagtttaaaaatgcatgttacatagagttgggctccacagctcactctcttaaccatcctgtaattttgcctaacctatgcccagtcactgatgcacctgtatggtacttcatggcccccttagagcttagaacctgggtttcattcctgctctacagctatataatttaacaattttcttctgaatttgttggattctaaccctatgcttctaaaattttattaatattactgaatcttaaagggagctttaagatgtctttagtctttagaaatactaaacctataaacaaaggactatatgaagttaaaactgtattcaaatttctacatgttttaagacactgaggcaacgtattaagaaacacacctaagacaatcaatctactctggacaaaaatttagatatggtctcttctaaataagctacctagtggtatttatacatattcttccttatatcaaccgtatcttacatgctcatagccttaaaaataactaaaaagtgtcagaattataggccttacacatttctgttggcttgaaaaatgatacaaaatgcataaacttctagagtgatcagtttaaaaaaggagttcataccaaaggtagtaatactaggaatcaaagagggctaaactctgcaggtttttaaaggtgaaagttaataaaaccttgtttttcattgtgaatctttgccttacaacattatacacatgattcttcccccttctttttcctcttgcaaagatgtggtgatgaaccctttgctcatgcagatgacaatactcttgaaaatggtggcagagaaaaaaaatgaagggaatatggttcacttaatcatctcataaattagaacttattacccctgtgactcctgaatagctccagaaaaaatatgtgagagacatgaaatggctgtttgctaccaatattttatgtgatgcttcattttttgattccttgaagaacacaacgcattagcccatttatgcgagaggttgcaactttttgaatttttgcataagtgaaaaattagaccttgtcgatgacatttagcagtaggatacaagtaattcccacgtgcttggcgtggaacactaggcataagtgggttaacacaattacgaaagcatagctattcaagtaactaattatacaactgacttttttttcctcatctctaaaacatagggatcagttatttaaaaaacacagtgacaagtattttatttttaactcagttttggtttgttaagggcgttgcttggcataaaaaaaacaaaaacaggaggagaaacaagaatacaaacatgacatagaagcagtagcaaaagaaaatgaagagtatcaagaaaatgagaagaaaatacacaatggaagaaaggaaaaagaacaggtgtgggaattaaaaggcctattatgataccttttatcccctcctcgattcataaaatttgagtaactccaagagtatcacaacaaaaaacaagcaaaaggatacacaaatagtcaccccctaaatttggttaggaatgagataatgctgccactcaagcctagctcgggcaccagcaggaggagggcaccctccagagactgcaggagaagggggaggactcctctttgccctatatgtaccaccaccactgccaccgaggccttcgttacaacacccacaggttcctccccaccccagaacgggatgggccctgcagtgctcctactcccccttcccagcccccagacttcctactgctaccaccactagcgccgatgccaatacaaccactgtcaccctcaatgtaccagcccaccctaccaggctcctaccacctggtccccgtgggtgccctcctaccgctccagttgagctgcagtctccatctctaccaccaacttcatgaggcaagtttcagagccatgtcatctgctcgaccataccactggcgactcctccttctcctcctgcagcctggcttggagcagctgggcaggcaaagctagaaaagcccaaaacgggactcagggagtgcaaccgttagagcctcaccttgtcatgctggtgactgggtttcagggatcagtttcattgaaggcactcacacccacttccaaagtccagcctctcctcttctggcaaaagctggccaggaactggggcctggggtgggagtgagtgccttcactgaaaccagcccctggccaagtccagctggccaggaattgctgggcccaccaaggctgccctcctcagggagcctgagtaggagaaactcagacccagccagccctccccacccaagagctggttccctttcctgacacctccacccaaagtgccctgtcccccacttcccccatggtgcctcctactacctacccggtagtcccaggtggtcttcccaacacagagcatgagggcgggccagaaaaccacagtgggtgtgggggccctgccctgcaatctagctcgagcgggagaaaattgccttctagagtctggcatctgagaagagaacgatcccttacttggagaccaccagaagaaggaggccactgctgtcactgccgccaccacctcctcagctcgccagcgccactggcagtgtagcccccatagcacccctaatctgccccctgccactagtagtgtagcccccggatagcacatccaacacaccctagtttcaggcaatgtaaccccaatatccccctaaagcactccctccacacctcagggagcataacacccggtagttctcacaatctgacccagccacaggcagttcagctcctgatggcgcactccccagtcacaggcagtgcagcacccaacaacgcccctaaaccaccgcccactgccagcattgtagccccggataactccacccaacccaccccctgccgcgggtagtgcagcagaagatagtgcccctaatccttccccagccacctgcagtacacattagtgtacacaatctgcctccccgacaccacccctgccaccatgggctgtatagccccggatagccagccaacctgccccactaccagcaatgcaacactggagagtgcccccaaccagaccactgccacaggcagagtagcctctagcagtgagcgccaataggacacccaacccttgtccccagaggcatacggggcagcctcagaaaactcacctaccccatcacatttctaccactgtggccgagctgcagtctctgacgtcaccaccaaccacagcgaggtaagccacggtggcacaggctccagcctccagcatgtggcggttcctcttcgttctagtcctccagcccagcaggagaagctcctgctgccggctgccctcctactgctctctcgccaccaccaaccgcagcgaggtagtgtcccaggctccaggctccatccatcctccagtctccagcaagcggaaggttgcggcctcttccagttttctaagttgggcacagagcagctcctctgcttggcacagaagagcctgaaatgacgtgacacgacctcagcatgctttatataccgaggttaatgcaaatgtggttcctggactacatgttctgataggacgagaaaaaaacctctaggcctactctgattggactttattttcatgctgtgatttgttgtgttaagacttgctctcatccaattacaacattataataaagtccaatcagagtaagcctggaggttttttctcatctactcaaaacatgcagcccaggaaccctcctgggcataactgcagtatataaatgatgctgaagagggatgaggttttttcgggttcatgtatcttcctgtggagttgctcggtgtagaggactaggaatcaggagtcactggcctcctatgctaggggctggagccgtgggagcggcggctcacctcgctgtggttgttggcagcgacggagctggcagcgcggctggagtggtaggagacggaaaacagttttaggatagatggaggggagtaaagagggtagatagtgccaaagggaaaaaaaggtagcttagtcagagaaggagttgcaaaaaggtggtagtgaaaagatggtgggggaaaaagtttttgggtagatggaggcagaaaaacagggtggggagtgggaaggaaggaaggttttgcagaaagacggtgggtaaaaagtttaaaggtagatggagggggaaaagagggcgtcaagtgggaggaggaaaaagagggagatgatgggggaaaacgggggtgagcagtagggagagaaggtttcgtgaaaagatggtggggtgaaaatagagtggggggggaaggtttttgggtagaggagcaaaagagggcagcaagtgggagaaggaaaaagagggtagccagcaggaggaagacaaagttttgtgaaaagacagtggcagaaaagaaagaccatggacaaagaaaagacggtgggtgaaaagtgtttcgatagatggaggggggaaagagggtgacgaggaaagagggtagcaagagggagcagggatagagggttgggaaaacgacggaaaaataatttggggtagatggagggcaaaaaagagggtggcaagcaggatggggaaagaagagcatgagcggtaaagggaggagactttgaaaagatggtggggaaagtttttgggggtagatggagggggaaaagatggaggtgagcaggagtggggagaaggctttgtgaaaagacggggggtggaaatgtttttgggtagatggagaagggaaagagaatggcaaggaggaacgggggaaagatgatgatgagaacagtttttgggtggatgaaggggaaaagaggttggtgagcagcaggagtggggagaaggtttagggaaaagacgggggaaaatgtttttgcttagatgaaggagcaaaagagggtggtgagagtgggagggggaaaaagagggtggccagggtaaggggaaaagacggtgggaagaaactggggaaagggtttgggtagatggatggggaaaagagtgttgagcaggagagtagagaaggctttgtgaaatgagggtgggcaaaaaatggtgaagtttgggggcagatggcagaagaaaaagggtggcgagagggagggggctaaaggcggtcgggaaaagaaggtagggaaataattttgggggacaaaggtttggggtagattttttaaaataagattatttgtatttttgattttgatgagttctttattttgtgtatgaaccccttgcctgatgcatagtttgcaaatacttgcttccattctctgggttgtttcttcatttttaaaaaattttaatttaatttttttttgacggagtcttgctctgtcgcccaggttcagtgcagtggcacaatctctgctcaatgcaagctctgcctcctgggttcacaccattttcctgcctgggcctcctgagtagctggaactacaggcgcctgccaccacgccaggacactttttttgtatttttagtagagacggggtttcaccgtgttagccaggatggtctcgatctcctgatctcgtgatccgctggcctcggcctcccaaagtgctgggattacaggcgtgagccactgtgcctggccttgaaacataactttattttttatttttgtatttgtatatatactttagtagccctgagttttaataaagttgcctttaaaatatgtatcttatttttcagaaatataccctaaggcatgtgattagttgggtggcatgttctttagtttttacaattgaaggattgtcattcctttatacaaaaaaagtgaatttttatcatatgctagaggaaagaaggtagatactaaataaatactgtatgcttccatgtagataaaatttgaaattatataaagacacaataccttaaacttttctggggttaaagtggggaatttcattggcaaagttcatgcaataaatgtgtaggtgaagggaacattccatatttgattatgtaggtgattatcaagctttataaatttataaaactgaactggactaaaatgtgtgccttacacgcaaattataattctataaaattgattaaaactagttagataagagagaatcaaggggaaaagagaaaaggcacgtgaaaaaataatgccaatgcactagaattatctttgatgacattaaatatagcctggtcttctcttaattctttttaaaattaatgtagatttctcaatcctttgatactttttcctgaacgcatcttatattctcatacatgttaatgtatggctacataggagaggattcttttacagctggactggaacagcttgatatttatatctagagatgcattggaaacataacactgacccgtgagcaagatgaaaatggcatgtgctagtgattcattaatatgttgctttaagtttagtgccaactggtctacatcgttgagaatgtttagtttgatggtttacacaacttgacttaagaagtgtatgaccaacagtgtatgagagagcctgctataaagacttttctgcacttcccttaaattattatagtaagctcaaatcttgaaggttcagaatatacagataaaatgtgtccgtgaggctgagaaaggatctttagggagaaaggctctgttcctgaaagacagactttcaatgatttcctgcattttatttctgttctagtttacctttacctttattaatcactaataaggtggttcttatagggcctcataggcctttttagttttccaacctattcatacttagtgcaaacctagtaattttttgcatgatagtattgggattttactctgaggctaggcttcacactgtaaaaacatctttttggaattgtatcattttcagtctttccatcgtgttccactgtcccagccacacacacaccagatatgaagactacaagcaacctcaaaaagtaacccatctatagtagatgtttttacctcttgtgaaatctaaggaaaatatactaaaaatgaaggcatcagtaaaacagtatcattttaggttgacctcgagcatttcaacatcagtctaacttcagaataatacattagcaaggagaaatggggtacttttgtggttttttacacctgttatttcaattgaaattgaaaaaaaaaactaatttgaactaaccataaaaggaaggttttatcagtattgaaataaaataacagaaaatgcatttgtgggtctgacctcaggaccgattttaaatagtcaatccctctaactctcattcccctttctctgagcattagctttattcttattccatcttacttgatgtggcactgacagatacagactcgttcttacaacatataccatcagaagtgaaaccttcacactctccaactcttgaaaaatctgagatgcactttgactattctcagattatgggtatattacttggatcaaaaagtactgcacagggaagtagatactgtaatctctgacattacagtttcaaggttggagtgagaaagggatagctccctaacaagggagtatcatagaaatgatattttcatggtcatacttctgtgaactaggcagacatcccttcatgtcaactacatctctactctactttgaacagataaatatccttgcatatacaaaattatgcagtagtgtaagcatgacttttcattaaaatttaagcaaaacagtctatttaggtgaatacatactgatacaggagatagttctgcttgaatgatctttacccttggggagagatacataaaagaatgtcatactttattatgatatgactatccagcatatttatgagtaaactttcataatacctttctctattgtctaaaataagcacaaaaacccttttagttaattaatatccctttttaatatacagaataaatagaaaatagcacaaaaggtattatgccagcacacagaaatagttccagttaaaagtcaatcctgtattttgagaacttgacaaaatcataattgaaaatagtgtactatcttacatgcagatgttgtgtaatcagggacatccaaatcaacttacatccaaatatttcacaattagtttttgaaatattctgtgaagtattataaaaccaggccctcaggaatataaaagcacaaagggagccaggactccaaatagccatttattcatttcctaaggttaggtacaatgaggactgcatttttaacattatcagggccatagagacattggagcttaaggataagatccaatttcatagcagtctgttaaagtttaagccagtctaatgacccaaatgttcaccataataattaccatcttgagtgatgatgttatgaatacaaaggaacactgcatctctaaaataaactacgtttatatgacatgagaccaatttgatggaaagaaggcaaaactgtgaatggtaattttgttttaattgttttcattgtgtgtactcatctgaaaatataataccatgtaattagaaaagttatcataacagaaaatagactggaaccttaactttttatatcaaatgttctgcacacgaatatggcctcctactgatgatctatggctccaaaatattggtagctataattatgctttgtaaaacagaagctgtgaatgtcttactacataaagacacaaagaatcatttccttactcattcactgctagtagaccctgaggcacagcatttcctgcccagatacctgattattaatccagtttttgttaggggtacactaacgttaactaacggagattggtgtttaaaccagttaatgtaaagaaatgctgtaggaactgaaatattccttttaaattaacaaaagtgttctttctagatagtcaaagttacatgaggacccaactgtataccagaaaatcatttgatgaatatggaattaataaaataatgttttgttgtatggttttagtactttgttggtgccaggttaaagacatgtggccctagataggataactctacagaagagaatttaatttgtttgcctgcttcactagaaatccaacaattaagtcagtgactctattttccaatattcatttcctccattttttcatctctttttgattgatggtatcatttcgttattttattttcattgacatggaattcattttggctaaaatgactttttgactatttgtgtatatatatatatatatatatatataattttaaaatcaatggaacaatattgtttctctacttccaagattatccctctatattctctaaagtcgataccgtgaaacagtccagatatgagtctaggaatggcagtacgaaatactgtaaaactggaagcaacttagtaggtaatcagtagggaaaatgaaactcaatataactgactctatttagttaatgtaatgatgcatttattttatatttttcatacaagtatttttttcatattttaaaatttcaaagttaagtatacatgtgactacagtcctcgcaacttctttaaggtactttatccggcagtcactagcagatgtgtttgtctaattcttagttttttttctgcctcataattttgttcacatttgctgtggagattttagaaatcacctagattgtttggtacaggaaggaaatcaaccctgggctgcctaattactgacaatctgtgtttctatggatacacatacattgatgattttggttaaccctttccacaaacagtcatacgtcccatgatagcttgctgtatattaaatcaaactttttatattgaaagtggataaagtaagccaaggtgttccagaagaaaatacatttggttctatatttttaaaaataagctatagcttgaaagtttcacctgcagtcctaacaagaaacaaattgggataaatagtccaaataaatgaaacacataaaaaaagaatctatatcaagtgtaataaattgtttacacctcaggtttttttctgctttgaaatttgtcttgacgtttgaccacatacatatttctgttgtattcacttctaaaaatagaacaggaaagatgtggacaacaaaaataggatatgaattgagagaagacgtgaactctcagaagaggagaagaatggcataaggataattagcatcgagatattgaatctcaacaaactaggacatggtggtgtagataatgatgaaagcatgcttgatatgtaaactagtaatttggtcgagcgagtaattttgacattcagatcaaatacaaataatttaataaaattagaccacaaactgcatagtgtgctcacataattgttttcattttttccttgctccgaattcaggtctgacagaggaacagataatacaaataacagttgatcccttacatcatctagctagacaaaatgatgcatatatactaccaccaatggaagttttcttcttttccttatatctttaatcttatttttaaattttatctatttcaatttataccttttatttttttttattacctaaaatgtgctatatgaataactttcagggaagcttggattaatgctgcatttgttcaatatgtgacattttccagttcctccataatattctagttaagtgtgtatggcccattaacctcctcctttgtgtttcagtgcacagacttctgtcattaatcatctgtacaactaaaaattcagttcttttttaaaactcacatcagactaaaactttagagatttgacaggcactggatacttttttattttcaaaagaataatcaaaatgtctcataactatcaaaatgaggcttagatggggaatatgtttaagacagactttgactaggggaaaaaaagagaaataacaaatccttgggtccaagtactccagtgacaagcttcaagtataaatgcaaatccttttagttgaatgagttacttattctagtttaagcagataatgctgatatcagacattttggtattatataattggtaggattaataattttatagaaaattggctcatttatctttgggatagcatgagatattaaaattaactctagaaaagagaaaataattttacttcaatatttccagtacatcttttggggcgtttcattttttaaggtacgtttttggaactacctgtaagcatatgataacaatatcagcacactagcaaacacactgttaaattttgtgaaaagacttattggcttatggattcagacatttacaaggttactatatccctcactaagaaagcataattaatttatcactgaatagatagactagttggcttttttttgaaagcccagagattatattaatttagagaatgaatataaaattgctttgcattttattgctatgggaataatttaaattgcttagtgactttttgctattttgattttgtggtggtggtggttgctgttaaattctttcattctagccatattttctcctcccaatttttcattcatttattaataatacatttattaattcatttattcattattcattatgtgaggaaacattgagttggaccacctgatgtagatataaaaacgaattaaatttttcttgccatcaagcataattgaggcagacataaaaatatttgacaaatattataattgttatagttgaagtcactattaaataacaaagtagcacagtttgagcttaaactccacctggagagtagaggaaggcttcatagaagtagggcatgaactggactttgaaggttgagaaggctcacttaagaaggctgcggggttggcagtcatatacaaagcctcagaaaggtataaccacatggagtaattgcagaaattgacataatttaatattgctttgaaattgcatagaagtggttacatataaaactggatatgtcagaacgagggtcaggtccatatgttcagctgaagaggtttcacattgtttcttgagaaatggggagtcatttcaaaaaagaggaatcatataaatagatttctgtactagtgaaattatccaagaaacagtgaagatgactgagttcatagtcaaaactggagtcagagagataacagaataattcaataaggtatatatgggaggaggagagtcgatttaacacaggcagagtgtaaatgatgagcaaagaataaatataagaaatcatataaatttcagagattatgaacctgaagtcagtatacatataggagaaatagaagtggtggatgcatgagaagtagtagttttgacaaagatcaattttctatgaaagaaaaggtacagtgcacattttgccttaaagtagctgagggtccttcaggtagagatattcagcgttgactaaaatatacagcaaaattctagaagaaaggtaatagaactaacaagattctatgctacaggtatagcattagcaattttcaatgcacagttagcagtcaaactctacccacttttcagtaactatattgtatttaactagaaatgatttttttgagaaatagattttcaataaaagttatctttagctaagaaaaagtgaaggaaagagtgggtatctagaatctaaagaaaaaagtattattcctctatggaataatttttctttctgtcaagcaacagttgagtaatgggagttatattgtccctcagggaccaaaactggctacgtaaaataataataagattatactcttaggtataaagtatggatataaatatagtaaataaatacacagtataactgtggcattaaaatttaatggaaggcaatgacttggaaaaagaaaagttcatgaatgctcctaggaaaaggtaaaaaatgaagttgagaaacattaatctgatagagggatgtgtcttcctttttttagtgaaggtatttctgagtgtaaggtatttttagtgaaggtaaaatttttagtgaaggtatttcgtatgtaatttgtgaaatcagctctcatactaaaagtgacttaatgatcacaaaatcacaaagactagtgatcttcctctcttaacattcttacatcaagttcacagtctgacattctgacatagtctgcccgctcagttgctgtggagttgaactcctctgtcgagtccatatccctaagggatcataagcttttatttctgagtaaggcagaaacttattgccaagataattagtgttagttattggaagatcattaatggcatcagcatcaaaaatcgctccaagtgggagagcttcctttctcttatggagttttcatttaataagccatgcttccacttaacgtgaccaaagaaatcggttgtattttataaattttttttagaatgtatgtacattcaaagtgagcatagatcttatacagaggatatttttaattgtatattaaaggtttttttcttagcacatatagtcttctgcataaagaagccaagaagaaactataatgataagacttctctggtactatcacataaataatgagttgtaaacaagcttaaaaaatacatacatatgatatagaatatataggcatgcactacttaactaaggggatacattctaaaaatagtgccattcaacatggtgaaaccctgtctctatttctaaaaatacaaaaattagctgggtgtggtggagcacgcctgtagtcccagctactccagaggctgaggcaggagaatcgcttgaacccatgaggcagaggatgcagtgagccgagatcgtgccactgcactccagcctggctgcagagcgagactccatctcaaaaaataaataagggctcagcgcggtggctcacgcctgtaatcccagcactttgggaggccgaggcaggcggatcacgaggtcaggagatgaagaccatcctggctaacatggtgaaaccccgtctctactgaaaatacaaaaaaattaatcaggtgtggtggcgggtgactgtagttccagctactggggaggctgaggcaggagaatggcatgaacccaggaggcggagcttgcagtgagccgagatcgcgccactgcactccagcctgggcgacagagcaagactgtctcaaaaataaataataaataaaataaatatacataaataaaaattaaaaaagtgccattaggtgattttgtcattatgcaaccatcattgggtatatttatacaaacctaaatggtatagcctactacatacctaggctacatggcataacctattccccttgactacaaacctgtgcaacatgttactgaactcaatacagtaggcaattttaacacagtggtatttgtgtatctgaacatatttaaacatagaaaaggtacctaaaaatacactattataatcttatcagaccactgttgtatatgcagtctgtcattgagactgaaaagtcattatgtggtgcatgactctattgtttaaaataagcaagtggcttctctgcctaacctatgcatgatggaaggtcatgagatttgtaatctaattcctctcatgcagagagtcactttggatagataagagcagcctaaaccctagctgaggttaagtgcaaatgggtttgcacctttaatttctaaattctagcaagcaaaattgtttaaagtatgtggaattaacagtctgactttaagttgtacttttcctgaattattttatcaacaaatgaatttaaggatttttaaaaagtatcaattgactgtgactcagtaaaattccatccaagaaagtcaatttctttctttcagtcttatgcgttcactagagatctagatctggggtagaaaacgtaaggttttcctttctaacattttactttcttacatgaaaaaagttttaacttagggtccataaattgctgctgcaagcaagggtctgttcagctgcaaaagtggtagaaaaaatatgaatgtgtattcttttgtttacttttccccctttaggagagatttttcaaaggagttcttgactcgcaagcattaacatttatctggtgctttttcggttcactcttccttttgtgtttggagggagctagtatcattctttatttggcaggagacagaaaagtcacctccatcacacgtttttatggttcccctttagccaggtttatgcttactgcagtgacagccaatttctctttcttagcacaggaagaggcaagctgacttgtgttggcttgctctctctccacatacacttctctcctcattgtgcctggacaatactaaagtctgtttgacaaggccaggaagtctcacataatctaacaaattatgtataatttttaaataaatttgatattaatcataaatgtttcatgctgcaggcattacaatgaatttcactagaatattggtaatggaagagctgaaacatctattgtgccactttgtttttttcttaagtgtaaattaatagaattatttaatgacactattggaagtgattatgaaaaaaaaacacaagagataaaccatgagacaagaacgttattcctttgcatatttcagtacagaccgacatgcagtaataccttaaaaatctgataataaataaaaccagaaaacattggcagcaatcttctttggggaagaagaaaggatttacttttgccatagggtataatacatttacatcataataacaccatacctgtgtcttttataacctagagaattgaactcttacatgatgtcactttttaataataaatgcaggaagttcaccttgagagtaaatagtagctagagctcagtaaattaactgaaggaagagaaaaaaacatatgaatagacaacagaatgttttcccttgaggaggagagcaatagaatattcacagaaaagcaattactgtgaaacatagtaaggtatgcagaaaaagtgaaaggaaagttaatgagtttaatagaaagatggcaataagaaaaataggttattaaattgttaaacttatcagtaaatacatatctatatgtaacatctgtagatcatctgcctgactgcatttatatgcacaacttaccacttttgctcgattgtaaactacatgagaacagaatctgtaatacattcattttaaaataactgacatttcctgttagaatgcctatcccggagttcagatctcagaaacacattctgtaactagggtctatccgaacctccagatccaacacgtataaattgcctgagaatatttcctgatctaggtctaggttgtcacttagaggttctcttgaacttaaaaatccagctcagaaaagatttccatatgtctttccccatgtttctctgtgttcaaacatctgagtcccaaaggctaatgatcattcaaatagaaacacaaaacaagagccttagcaaaaagtataatttctaaaccatgctgcagcaaagattccctggtaaatgtgatatttaaggaaataagtctaaacctttacctaatctaaatttcaatggcatatcatttttgccatcataaaggcaaatgctttgctagtttggtttaatttcttaaagtattgccttaatgttacaggacaccaacacttacccaaaggtggccattgggttagggtttctgcattatagtcccttctgtagtcaccagaaatatgttacaggaatagggttccaatccagaccccacgagagggttcttggatctcatgcaagaaactattcagggtaagttcaaagtgaaagcaagtttattaagaaagtaatggaataaaagaatggatactctataggcagagcagccctgagggctgctggttgcccttttttacggttatttcttgatgatatgctaaaaagcggtggattattcatgtctcccgtttttagaacatgtagggtaacttcctgatgttgcaatgacatttgtaaactgtcatggtgctggtgggagtgtagcagtgagtacgaccagaggtcactgtcatcgccattttgggttttggtgggttttgtctggcttctttattgcaacctgtatcatcagcaaggatttatgacctgtattttgtgccaacctcttatgtcatcctgtgatgtagaatgccttaactgtctgggaatgcacccagtaggtttcagcctcattttacacagctcctattcaagatggagttgtccttgtttatgtgcctctgatattaatgctgtgccttaaactattattgcaagaaatcaagaggatgttaatattcttttcagcatgactaatccttagacaggattcttcttattctaggcctctgacctctcttttcttagaacgtttacattggaacacttcccattccatattatctctttgcccctttgagatataaatcttgttaaaagcatcttaccagtttagaatttaggaatgtcttcctaaagaatctgggaaccatctctttgaaatgtaaatatttgaggagatagcaccccagtttccaatttccttgggagggcagactcctaacatcaatgagtaccaattagctaacacagatgacataatctcaaagaaaaacattttgaaaactcaggaataactaaatatgctccatacatcccacagatcagcctcccttctaacatcttgcaagacattttcactggcttaccctagtatataaaaactctcccacttcttgtttcatctgagttgagttcacagtgagttctggcctttaacatctactgcaatggctttgaataaagtattcctttcctatttaactttatccagtgcaatttttgatttgacaatagttatcaaaaaagtagtcatatcaaattgatgtttcatttaccctgtagttgttataaaatctattacctgtggactttgtttttgctgttttgagatagagtttcactctgtcacccaggctggagtgcagtggagtgatcttggctcactgcaacctctgcctcctgggctcaagccatgctcccaccttagtgtcttggactacaggtgtatgccaccatgcctgctaatttttgaattttttgtagagatggggtctctccatgttgcccagactggtctcgaactcctgaactccagcagtccaccagcattggcctcccaaagtgctgggattatgggcatgagtcactaacttgtcctattacttgttttgtgattgagggtctctgtgttacaggattctctccttagttcagttaaagatgggatccttgtcacatagccatgaaaaattagtcttgcagacaattcaaagggtgaggaaaatgggatttattgggaaaaaagggaaaaaggaagcctccacaaacccagagtccctgctgttcacttcctgccttgcagattgaataccaggttctgcccaggaagaggaggagcctggctcctctctgctgcaaatggctcagacttcctgaggctctaccacagtgcacaccaatcccagtgtgtgggctggtgggggtttgtcgaaaacacctttgtaccagctgtttcatgagaaatgtctttcataggatgatcacaaaaaatgttattttttattgttttttcaatggataaactttatgttgttgagttattgatgatatattgaaatggacttttcattaccagtgaggaaaaagtggcttccctttaccttcctagattatttcattagactacaaattaaatgatcataaaacagattaccaacaaaaaaactatagttaactatgtacatgcacaggagtccaacagaaatatgagattcaatgaaaagccagatgattgatgcttacatagcattctgagctatagagaaatatttgaggcttggggttagtgaaggatggtgaagacaagttataagggtgagggggtggagatgtatggtaaataaatgttgtcttgttctgcagatcaaaaataggtaataaaattgtctcagaggagctatcttcctgtattggacatctgtattaagtacttttactaaagcagtgaagaggcaaggagaaaacttccccttcacccttggaaggctcactgaaaattcaactctcaaaagaaagattaataagagaaaagccatctcatttattaaggtgcacatggagagatccggagtgattacccaaacccctagtggggtatagaagcttatataccaccatgaggttacagatagaatggggactcagagcccaggcaaaaataggttatgttggtaaatcaggttatagcagtaaggcaggttatggatagaagagaagcggaggcttggctagcaaaggtgaccttgtaatgtaaatgaaaccttgcatgtagctgccctcagataaaatagatggcatatatttctttcaggcctttaaagctgtcagactctcagttactctttgctagatccaggaaagggaagtcctggctgcatcaatgcagattgtccacagatgcaaatctctgccacaaaagatagctttgtaaggctacatctgtttgctggctctctgaacagccatctccatgtatgccaaataaccatattttggggtatgatactgttcgggtctgtgtcccaacgcaaatctcatcttgaattgtaatccccacgcgttgagggagggacctggctggaggtgatcaaatcatggtgaggtttcccccatccagttcttgtgatagtgagggagttctcatgagatctgatggcttaaaagtatgtggcagtttcccccttgctgtctgtttttcttcccccttgcgaagaagaaggtgcttgctttctccttcaccttccaccatgattgtaaatttcctgaggcctcccaaggcatgcagaactgtgagtcaattaaaactctcttctttataaataacccaatctcaggcagttctttatagcactgtaaaaacaaactagtacagcataaaatatttttttcttcagtagattttctttatagattacaaaaggacaattttcagagctactccttttctgcagtttctcaggataaccagctgaaaatataccaaaagaatctactttgcagtggcacattctgctctccaacagtcatatgagagttaggctcagatgtatcctgagccctaagagtgccaaatcactggtacaaaccaaaagtaaaattgtaaatcccctcagccatctgcatagaccacctcctctccgtcaagagcattccaaagttaacctgaaaagctagttgaggccatgatgggaatgggaaacaagccatgtctcattatactctcctctgttttggaattgctgatagaacagactctgagtctgataggaaacatttacaatctattctctgaaacctgctacctggaggtttcgtctgcataataaaaccttggtctctacaaccctttaacttaatccagacaattcctttccattgattctgagtctgtataatggcttaactcttcctaccaattgccaatcagaaaatctttgagtctaactgtgacttggaagccagtttcatgcctttctggagtgaaccaatgtggagtacaggagaaggtcagagagactttgcttccgaggcttccatttcctttatttcaaagtactcagcatgcccaagtgccatactttggggtatggttttctgagccctaacaagagtaaaatctgtacatgaggtaacagtgtgctagagacacagtgagaaatagctttgttaatggggtagctatttgaataaggcgtcttttcctaggatctgtcaattctcaaggacagctttaggaaatatgtgtctcctcccaaactaacatggagattttgtgatgtttatgtattttcctgggcaagaagtttttctatttaagtcagttctcaatggattaaatcttcaaactcttaaggccaaacccatttaaattaatagaagagcatctcttttgttggaccagagtgatttttcagctattccaatagtgatatagaggtagtatgtttagacattcctctgggcatgcacagctttctggtaagttcaggcccatcatctaaatatcatacttaaaaacataaatgggccgggcgcggtggctcacgcctgtaatcccagcactttgggaggccgaggtgggcgggacacaaggtcaggagatagagaccatcctggctaacacggtgaaaccccgtctctactaaaaaatacaaaaaattagccgggtgtggtggcaggcacctgtagtcccagctacttgggaggctgaggcaggagaatggtgtgaacctgggaggtggagcttacagtgagccaagatagcatcactgaactccagcctgggcgacagagcaagactccgtctcaaaaaaataaatacataaaataaaataaaaaataaaaaacataaatggaacaaaaatgattttattaaacaggggtcttccatttacattagccaatgttgctttcctcaaattgtgcacaatacccacagtgttgctaagagtgacagagattaatggaatcaaaaattatctctcactcatgcaggtgcaagttagatttcaaattgtatggccatttgctttgttctagggaaaactctttctttagtaatagcattctactttctatggtaattgagctttccaaaagcaaactgcttcttcaattatgtttccatgaatgaaatttttgcagaatatatgaagagttctgtttctttaaacactttaaaacattagtttacttttttatatactgcacaagtgcaatgaaatgaactcattgactattatttaactgtgatgctgaaagctaaaatattgcattgcaagagcttttagtgatcatcatttagcattttaaaggtactaaaagcactattcatccatcaaattgttcatttgtttaaaacacgtgcaacaaaagctgagtgtacctaaaagcacaaaataaatctgctcccttgcactttagttagatgaagcagaatgtgcacaggtaaggtcagtaaaaacacatacacacacgcacaaacacacacacacaaacacagtatgtttgtactccaagaagttcaataacagttgaatgcacattcataacacatctttggaaaacacatgaatatacttttaaatcctgaaacaataaaaaagagaattgtcacaagattggtttggattttagtatcattctattagaagtaaacttcataatcattttaagaactgcaatcatctgttttactttgcatttctttcctttccttgtttccctctgtctgcttctgggctattagagtttctcaaattgtttgtatcacatagatacccacgtaaatgctgcagggttaactccaagacactgttagacacaagtgtgcttgtatttcaattcttgtaattataagtggccccacttcagactattctgttctatgaaacacaacggaaagcatcaaattaggggaaaagagtggctcagactgccccaagcaattaattaaagaaaattactactggatgctttatgcacagcaggggctctgtgcatgaagaaatataactgctagtcacacctgtgctgattctcactgtggaattgaaattatcatgagtaaatgtaattacttagcaaatttaataaatgttgtttggggttctgaaaacagcacttggatctacaaattacacagtgataagtgtggcagcacaagttcagtggtctctaatagcactaaaatatgtagagcatcctggaatgtaccaggaaagcttatgagtaagtaaaggtaataaattgctacaaaaaaatgggtactaagccactcatagttacccatgctttcatgttttcctttgattatgtaattttgacaaagttatttttttcaaaatccccagtagtttagatatccaagcttatcctcctgaaatacaaataagtttattcctaacaaaaaatgagttagtatttggtaacgcttgaaatgaagtgctctaaataagtatttaattaagaataaaacagctattgctcttgggttgtgatgattggcaataattgctttacatgatttaatggttataaaattaacaagagataagtaataaaaataagaaattaagctacatttttcatcataactttaatttgtatgctcttaagaatcataatgatgattggtcttttattaaatgaatattaagatgaaccttcatataatctatattatctttgaagaatatgttaatcattaagtcataatttataattaaaatgcaatacaatttattttgtcaaaaggaaataaagtatttgtgtattttgtaaaattgccatatggtaaaagcctattcagagtataagccttctgctataatactaatagccataagtcttctactttaaatcaagaaaatgttagaaaatgtttaatagctttagtatatttaaacaattcatcaaaattatttaaaattttgctagggctgtcataacaacatgccacaattgggtgatcaaaagtcacagatacatattctctcacagttctggagactacaaatccaaaatcaagctttctgtgggaccatgatctccacaaagactctgggaattaatgcctccttgatcttctcccttctggcgtttgctgtcaaatttcagcattccttgttttgtagacctggcactgaaatctctactttctttatcacatggtcctctcccttgtgtcttcatgtcttcatgtcttcacatcatcttccttctctgtatattcacatcatctttcatctgtgtatgttcctatgtccaaatttctcccttattagggaaaggaatttatctagtatccaatgtcttaagttcaataatggattttgtggctgcactagtttaagatggctatatgtgaacttgattacagctataagaatcctatttccaaataaggttacattcgcaggttctgggtgggcatgagttttcaggggccactaattaaccgagtacaaatataaggtgttaatgttcttgtaagtcgtgtggctgacttctccctgttttgtcagtgccctgcaataaatacaattcccacttagtatgcacctatacacaaaaaagaatatttattatgctctaatggaggaatcagggtcagaacacttattctgtgaccagataatacatattttaggctttgcagaccgcatggtctttgttacaattgctcacccgtgctgtaaacaataggtaaatggattggaatagttggatttggcccccagtcatgattttgcctacctttcctatggtggaaaggaattctttattttgtttaacagagtaaatttaaatatctatatcaaggaaaatctgttctttgaaagcattgtccacaatttttcaaaacccagattttatttttaaagctatttcaagacctaggaaacataatgcattttaaaaatcaaacccatatgaacaattaagcctagagaaaagaaatacatatatttggggtgaattgtaaattcagacacaaagcccttctgagtgtgggaccccatgtgacttcacagatcatatgcccttgacattaattctgtctgaaagtatttttgaaatcttgttctttcaacacactaggtcctactaaatgggatttttataaagtcactagtaataactcacaaatggatcaaatgaataatatattacttaaagtgcctattataatgttttgcacattaagtgttgtcccagtacagaggtttttagatgtatttacacttttaataatataaatatcaagtggtgagtattgccccaatataaggttattttaaatgtgatttattatataattaacaatattactcttataatcatagtaatattttagtcaaatatcaacaaataaggtgctattgctttatgagtgttttgtagaaatagtcaaaagttctagctatgaatcctgaaaagtcaacacttagtgaaaactttggttcactaaaaaattatacaaccaattttgtgaaattactgttgcaagtctcattcatttaagtgtgattaacaaaggaggttaaatttcacatagcataaactttttctgtttttttatttttagtgtgagaactttctctaggaataaaaaaaaaccctcatgttattttcgttttaaatgtataacctttggcacaaaactgagaaaatggctgcttcactagatgtgaaactgcctttcccttgcaagggttaattactaaagaagaaattcaaacttaaacaacaaactctgcaatcttaattaaaaagaaactatcaactggtgactccgggtagtttagagatgacaagtatcaaatatgtggtaaagtgaaatgtaaaaagtaggagaaggtgattataaggcaggtcagcttttagatttgccatagcagagatagaaatactacgactgattttaaaatctgtatgttgaactttacctaatgagttttatgtggaggcagatgaatagagtacagaacacaaaaactacatttgcgtaatggaatatggttctgcttaactggcaagagaaaattattttttaaccattaatgcaaatatctactgtttcattttatgttatctgattattttaaataatgtgtctgagtagcaaatagaaggcttttttccaacaaaagatcattatatcatttcatttttccaattctgtataaatgtccaagttagttttttttgaggtcttgcaaacaaaatagacattcaaatattcagattttaatttttcttaaattaattttgttatttaaacaatgtaaaatcttataccacttgatatatgttgataatccataattccatttgatggcacaataaaaatcacatttgtgttttaaattttaaaaagcaggatttatttttaaactaaaaatttagactctcttagaataaattacacagtctcaaaatactattgcactctgctacaagtgaaaagcaaaattttttttattaaagaagttcaatcttagtgaaataatttacaataacctagtagggatggtgtttaagagattgaagcaacataattcacttgattctgatacatacatacaaaattttctaacagttacttttaaatacattggctctgaaagttcattttaattctttattctgagtataatacttttattacaattttaaacttaattttataaagacttttctgaagtataattttaacccctcatatattttctaaacaattgaacagaatatttatagattgaaattttaggcttaaaacagaccctcttaatattccaatcttttttgagtctaagcccacgttccctgatctaacagataactttaagaaaatgatattaattcatgtcaaacaggatttctgtctttgagagaatcacttactttcctcaaagttatttttgaccatctattgtgcttaatatgagatggttattgagttacttgataaacttgtagtttccatacataaaagtataaccattctgaatatcaaatacttcatgataataaaattataatttacatctatattttactttgtctattcaaaaaatgtttagaaaaagtacatggagactgtagtcagcatattatttcaaaattaatactaatgttaatgtatgttgaatacctgtgatgataataactgtacattctgaaaaaaatgttactatcctgtatctaattgctaagtaaatcactcaccatttttaagcacttattatatgccatgcagtgtgatatgttgtgaaaggatgtataaggtgacacaaggttctatcattaaagacatgaggaataaacttatcacaataaatgatatctaatggcttaaaaaagaaagaaaatattctgactgtgttattagagtttcaggctggggaaacagtcacaatgatgatgactaatagatcatttaggccttaaacataaatagaactttattaagcatatagaggaaggggaaacaaatctatgtaaacgaaatagtatgaagagaagcatagaagataaaaatttaaaaatacaagaaattttaggaaatttttaataaccaacctagaaaacaacttgagattcttccttatttttaatttcatttatacaccatcattaaccttgctgagtcttcctccaaaatgcctcttaattttattacttcatttctatttgtgttacttgctgaataaagtttcacgtcatcatgatcagggattcctgcctaagggtgattttcatgcgtgaaggatatttggcagtgtgtgaagacattttttattatcgcaagtgggggaagagcactagtagtatgtagcaggtagaggccaagtatattggctaaattgtagccaatactaatacactgaagaatatgctaaatattctacaatgcctaggtcaagttcccataacaaagaattatctgtccaaaatgtcaaagtaccaaactagcaataacttcctaactttatctccgccttagaaattcctattcttgattagaaatcatctagtcatgtaatgaatttgatctactataaaatatccaagaagagatatctatgagacagttaaaaatctaatgttaggcatcaacagggaaatcatttttggagatacaaattagtgagaaagtataaaggttcaaaatacagagatggttaacattttctagagaaaatctttaaaaggaaagaaaaaataataagataataaaatatttatatttaaaaggaggatgggctgggcgcggtggctcatgcctgtaatcccagcactttgggaaggaggccgaggcaggcaaatcgcctgaggtcaggagttcaaaaccagtctggccaacatggtgcaaccccatctctactaaaaatacaaaaattagctgggtgtggtggtgcatacctatagtcccagctacttgggagcttgaggcaggagaattgctttaacccagtaggcagaggttgcagtgagccaagaaagaaccactgcactccagcctgggcaagaaagtgagactccatctcaaaaaggaaaaaaaaaaaaacaaacagaagaatgaggatgtatctgccaacaaaatattgaacaaacaactgaaacagaaacattaagaaaggggaagaagagaacatctcttaataaagcacatgggttcagctactgaccacttccatgaatttggctgtcttcaacatgcctttaggattagtaataattccactttttccaaatatatgtttgttatctacacatacattagatattgtttcttatattgttaacccttgtatttattctcatttggtaaagtagtacaaccaacagagaataaaacaagttatttcaaaatgtaaaaatctggggggtcacaggatagaaggcaggagcacatcagtgggcacaaaatcccagatgaataccaaccatttctcagcttttggccccttcaatccactgcatgatgcaccaaggatgttcaggaaagtaaaatagcactctttcatcaatcatttctaaggcatctgtaaaatgctgccgttttcagggaagaggggctttttcccttacctgaaatgaaaatcagcttaacagaaattgagcttaaacatttacccaactcagtaattttggcatttgtgaattacctgatgaatacatacttgtttcttatctagaaattaaaaaatcttacagtggttttgtatggtgaaaaatctatttctatcattgacccaagtattcccagtaaggaaagaaaagcttttattgtattagatcctgcttgcattaaaattatctttaaatattttgacttcatctatttgttaaaactatcaaatagcttacttagcaaaatgaatatttaattcagaaaagaaaataaagcaattactgtgtgtatattcagccatatacgtagaaggtgccaacttaattgcttagaggggaagtctttctttttcattctatggtcacattcccttttaaattcatatgtgtgtatgtgtgtgtgtgtgtctgtgtataatttatatataattgatgtacaaatatatatgacataaatatatataaatatatgttatacataatatataacaatattatttatgacataaatatttgtatttacttatttgtcaaacatttagtgactgtcaacaatatgcaaggtgctaagcatgccactatgttaacaactataaaaaagccaaagaagctttgagcttggaatctgaaaggagagacagaaatcaaagtttatttctgtctacagaattagtttattaaatattaataaatgatgtttgagaaaattataagttgctatgaaagcataaaccacaggatatgacaagtctagagattttgataaagctttgtagggagaatttgaatgaatcaaactaagaatttatgaagattgagctggtaaggaaaagggataaattcattctaggaagaaaaggaacagcagaatgtccttaggaagaagtgagcatgaattatttgctaaaagtggaaaatgctaggaaattacatggagtgcaaattacacacccaagtagagatgtgaaagtgcataggaaaagatgcagcatttaatatgcatttaaagtttattattaatagcttgaaaataaatacatgaatgaatggatgaagaaaagatttagcagaagattatttactatcaagaggagcagaaaatacttattagacaaaagtgaaaaatgcacagaaaattgagttacttgccaaaggtcatctggaaacatcaaggaaagaattaaaacaaagtggaaaagaagcacaagcttatagaaattatgttgagaccagaggctatttatttttaaaattggaacacttttttctgaacttacaatacatttaaattgattggaaatattattcatacacatatctaagtcaaatatataatctacctaatggtttctggcatgtattttcctttcagtcttttcttcagcacataccatgaaaatacatgagatagaagggatttttaaaaagagacctagagattgtggggctacattattcagaataaataaaagcgaaatgaaatctaatttaaaaacatatcacaagatctaacttactgttatatacacaaagtgcattttagtagacaatatacagacaatgtttcttttaaatcaacatttgttgacaatgttatccattatccactattattcttattagttgtgtcttatttttattaatttttttttctattggattttttatgagagatttgtttggttataagattttaaatgtggctattatgtcagaatacatatctcaattcaaatgaaatctttttccaagtttacaatcaactgtgtccttccgtaatttaatttgttgaaaataggaagcatactggtagtacattttagtaattttaaaatcctttagtaaaggaaaaattacattttggctttgagaaatatcatcttcaagaataaaaacactctttcatattcatgtattcatagagcataaggtattcactctatagtacgtttttagatttgcaaatatttttgagtagaacataaaagaaatatctaacttcctaatatcaaggatggtgtgaacatcagaaagctacctttgttatcctaaaacaacttaggttttgttgagaaaatataattaaaaacagtcttattccaatcttgaaaacctctctacagaggtagaagagaaaaaaaaaagcaattttattattgaataagcatgaaaccaggatgtgatgcacatcacaggcaatccactaaagagaatgcagacagaaaggaatctcacccttttatatagccaaacagatgcaacctattgtatacaccttttcattgttgtgagataatcataggatgtaatggacttacacaaaattggatgttcttatagcacagaggctatatggtatagcctattgctcctaggctacaaatctgtacattttaccaattactgtaggcaactataacacaatagtatttgtgtatctaactgtatctaaatatagaaaaagtacatgaaaaatacattataatcttatgagaccgccatcgtaacatgatccattgttgaacaaaatgttgtgatgcagcacatgaatatgtaggccttttagtaattattcaatcttcctaaatagcttttttcagttttgcaactcagtagcatccatggccatcatctaatataaaagtcttggccgggcacagtggctcatgcctgtgatcccagcactttgagaggccgagacgggtggatcatgaggtcaggagttcgagacagcctggccaacatggtgaaaccccgtctctactaaaaatacaaaaattagctgagcgtggtggcaggggcctgtaatcccagctgcttgggaggccgaggcaggagaatcgctggaacctgggaggcagaggttgcagtgaaccgagatcatgccattgcactccaacctgggtgacaagagcaagactctgtcacaaaaaaaagtcttattataaggtacaaactgaaaggcaccgattaaactttgagtgtttaatgtatatagctattattattttaagtcttgaagacaaacctctagcctataggtattttttttcccagcgtgggatctaaaccaatagctctacattataatagtcaacaaaatattcatgagtaacagaaatttagtttcatgtatcaatctatacttaggtgggagagaagttacatcacaaagttaattaagtaacaatagacctgttttttgtggtcgctatcttacaatgccaagtttctatttttctattaactggaatgtttgttttcaattaagccaattaattgtttttgtttgttttacaagtagagcttgtcttagtccattgtgtgttgagatagcagaatactaagatggggtaatttaagaagaaaactttttcttacatttctggagactgggaagtctaaggttgaggagctacatctggagaggtcatcttgccatatcataacatggcagaaagcaccatatggctcagatttctcttccctttcttaaaaggccactaatctcatcacgggggccctattcttatgacatcatctatcactacatcccaaagaccctgcctccaaatagcaacaacacataaatttgggaatttaatttctgacacatggaatttggggacacattcaaaccatagctaggcttgaatacttggatgcatattagttttattttattatcaacaattataaagaagatggtgtcacttttactctgccaataataaaactgttggttatacaattccaggtcctgtttctgctgggaggacaatttgaactaactggaaaggacatcatgagaaccattactgggagtacagaaagaaaaggtcatgtaacaaataagttttgattcctagtaaaatgtgattcttaaagtagtcaaaataatccactggaaataagacagtaagaccatctaaaatgtaatatgtaaatatgttctctagagtacctcttcatctgaattcagtaccaagatcagttactcttgaaaacttaaatttcaaggccttgtgagaaccacagtcaagtcttgcccaggtgctgtctccgtgtgggaagcatgactccagctgagttgtttctcttttgttttggttttggtttttgttttattttgttttaatctctgatagccaaacgagtgatcagcagcactcgaaagccttctttccagcatggtgactgtattttctttctggaatacctttttgtagatgaaatttcctggtccacagagatagccaatttccactggtgtgtccttccagatcctattgtctttaagttttagggtttctagggaagatataaacccttttaggcattggaaatggttagaagaggatttgcttatatcaggcacaggatgtgctcttagacccaaattcatggacctgccaaatgtaggttcaaagagaagattctgtgcttgaatgcagaggcagcaggaaaaagactaatgataaaactctggagattttaacccagtacatagctgaatcttagctaattattttttaaaatttgatttatctactttatttatctggaggactgaggaatataaggtgtatgctacattatggaaatcagcacacgtttgcataaatcctaggcaatggtacagataaaataactttctctgtctgattcaaatactgtggtatcccaaaagttagaactaaggcttttaagagagtgtttaccattgcctgaaaatcagtttttatgttttgtttcttttttttttgaagagggtaaggcctcaggccatccagacatcatacacacagtaaacagacaaagctcttaccttttacatgtagttctatggaactcaactaccaaaaggctcctggtagttactcagagagcatttcctgtggtttcttaggagtagcatgtaaataattctgctgatgaatatcacatctctctaatatgtttgtattaaaaaaatcttttttggtgtgcaggctcagagtctagtgactttaaaaatcattttttcttgagatgatttgttgatgacataagaaccctaaccaagctgggcacggtggctcaagcctgtaatcccagcacttggggaggctgaggtaggtggatcacgaggtcaggagattgagaccatcctggcttccatggtgaaatcccatctctactaaaaatatgaaaaattagccaggcatggtggaagaagccaggaattcaggttctgggactttttaaaattttgacatgtatattgaatattcaagtggaatgcaaataggagttggaaagtcagaaaagtgttctgagatggagatgtaaatatgtgagttactggcttttcaagagtgtttagagcatggtaatgagtgaggtcatcaaaagcagtagcatgaatacacaagagatgtctaaggcctgatacctggaatactccaatgtaaagagcttggggagaagcagagaaactaccaaaggagattgagatagtgttgcaaataaaacagaagaaaaatcaaaagccatgtgatacccagctctaggaagcacaaatggtaattttgtgcaaatcaaaaatgtgtcctttcctcatggcacagtactgccatctgctggaatatgtttctaaaaactgtattaagattataatgcccccaaggtaaatgtccttcagtgcttagctgtaagcagtagagaaagtgtatgaaggtggaggaagtatatcaaatgtttctgatctgtttaaggcttatgagtattgaaaaacaattaatggatttagcaacattaagtatgtggtgacgttgacaaatgtcggtttgaagtcatgaaaatgaaagtttagttactgttgagtttaaaagaaaatgaaaaaaaattgtacacattattttcattttcttttaaacctacagtaactaaacttccattttcatgacttcaaaatgacatttgttatggtcaccaaataatctgtacaacaaacccccatgacacaagtttacctatataacaaactgcacatatgtccctgaacttaaaataaaagttaaaaaaaagaaataactgtagatagtgacaatggaccattctatcaagaaattttgttggaataagaggcagagaaataggttagtctgtagttgacatggaagttgcttcaaggaagtagggtggaaaaattggtaatgaaggagaaataagaaaaattaagaccacagcagtctgtagtagatgagagagaataagatctaaggcactaatgaaggaattgtctgtagagagacagaaatatatagttcatgcacaggagatggtgaaaaacagagtatgtgagtagtggctctaggtgggcagatatggtaattagagtccatagacactttcttcttttcacagtatagtaagaagcaaggtcagcaaaagcaagtagggatgaaaaaggagatgtgagagctctctggctagcatcttctcactttactattgctatgggaactgggagaatctcaaaagtatttacatacttcttggagaatacatttttctgatgaatatttatagcaccagcctaaacaaatattatttagtagaacatgcttgtttttaataatcttctttcctcacagtgttatctgttctactcatgtattgccaagtgaccatttcatctgaatattacccaacaggtttgcatccttctctgaccttggacagtggcatgtgtttctaacctggttttcttctccattaatgaaacacattattatttaatttccaaactctgtcaaataaatgtgtgaaaatatattcatgtgataaaaataatcactgataatttgtaatacatttgtagaagtgtgacttgtacctcatttgtgtgctgacgtctagtgcagatctcagagtcaggccaactctccattgtcctcactatcctacttgtcttagtctgttttctgatggttataacaaaatattttgtactgggtaacttagattgacaatacatttatttctaacagttatggggactgagcattccaaggttaagggctacatcttgtgagggctttcttgctgatgggaactctgtacggacttctgagccagcacagggaatcacatgatgaaaatgccacatatgataacatgcggtgctcaagtctctctccctcttctgataaaaacaccagtttctttcccatgaaaaccaattaattaattaactatttaaatacaccaaactatgaatgggctatttcatgaggccagagccctcttaaaggcctcatgtctcaatactgccacgttagggattacatttcaacatgagatttggaggggaccaaccattgcacttcacttccccattttgtgaccaaggccttcagactacaaagtagctatttaattctatgtttttgacattgtcccatgcctgccttttagtcgaagaggtatagtttccatggtttcaaacaatactaacagtcccaactatcttttctttataagatcaatatggaaaatttgatgaaataaatgaaaaaaactgtatatatactaaactactatgagctagttaatacagaatttcttgtctccattgttgatgggggtgactaaaatttgagttgagtttctgcctaatttcaacttttattcttgaatgggggatttccccatttttgaatactactatattcaagaagccaagcacaagaaatatttaaggataataatggctattttcttgcccaaagtggatattttgcatctctaggttttcaaactaatttatattgctcttaccaacttgttgcctgtaatcatattttccatattgatagtgagaatctttatctcattccctgcctttaaagataacttttattatagattttgttactgtttacaggatagaatgttactttaattcttagttttcaaagagtttttattaaaaccaagtattgaacttttgcttatctattacactagccatatatttttctactttagttaactactttggtgcattgaaaaaatacattttataatgcgtagtcaactttacagtcctgaaataaactgataattatgtcataattttattaatataccctgggtttgggctaaccactggttcatttaatggctttaacattttcatctgcctcactttgagtccaagataaaactggcctacggtattatatttctactttctttgttcaataatgttacaaatgttaccctaacctcataaaaacattaaaagaaattttagtatcatcaagtggtgagagaatttttgttttctatttcctcttactaattgtttccaagatacctggcttctctgtaaggctagtttaaaatgttacacttcttacagaattctagctctagataggccataattacataaataacagaggatgaaaatcccttcaaaggatgaaacatagaaattgatgtagtaaagctttaggctgtccaagataatgttttctatttaaaatattgcaaatctggccaattgaattaaattcactttgaacaggctataataagcacttacttttggtgtgagtaaataacaaataaatcacttaagaaaatacggcattattccccctcatggtgcatttaaactagaataaaaaattgttacgagaggaagatgaagtcaccaaaagagctgagaattgttaaagaatgtcaggcagaatactcataaggttgaactgataacataattaggtacttgctaaaaacttaccaagatacaacctgggcaataacaccctctagaatggcaaccagactatatagagtgttaaaaagaagaatcttggtaaaaatgaggctagcaattaaaaatgagaaaactaaggataaacagaaagggttctagaaacaattcaggaagagatatttgaaaggcatgtggtatgataaagttcaagtgacataaaattaatagtaatatcatgaagcaaaaagcagaaatggaaagatatagaacgaaaggggataatcacttgaatcacaagattatatatttgagttcagtacactgaaatatttcatttttcaatatgaaagacatatagtgacctctaggcactcattttaatatacaagagccattaaaaaggcacttcaaggtgttagcaggatctactccattataaccatggatgggaggtttgcattcactctgaaaagagtttcctttgcagttttatgtgagaaaaatacagtatcaaaatgattatattgtgatacagaatctccctattaaccaattgcaatgacccaaatatgaccccacaagaaatgaatctggtgcatataactaacgagatgggtgaaattgttcatcctgtaaaattgatggtcagtcactgaagagaagaatttgggactgcatttcaggaaaaagaaccaaaacagtaacagttctgcttctacataattatacggatcctcatgagtcacctgtgaagaaaacaaaacaaaacctcttctcaaaattctgtccactaatttctaaggaaaaaaatgtggtagataggaaacatgatactgctagagcacagagatgcagataatgaatgagaaatctttctctaaattaagatttttaaacattgattttgctatttgaatataggaagatgactcctgttttctcatttgatatatttaatggtgagttcacagatacaattgtttcctcggcttaaggtcaatgatcatggtggaataggaaaatagagaaaaatgctgaaagttttcagctttagtgtactatctgttaaaaagagtatttcaaagacactgtttttacactgttttaatgaattcagactatgtctcatgatcttttggaaaattgaaataatctcaaattattttcctgagtacaaaatgtcaatttaatgagagtttaaatgtgatgacccaattatttcaattaaattatacaatatttattagactataagttgcaaactgctatcatataactatgaattgcagaagatagaagaggatgaaataatacataagaccataaaattaattatatcattctctctttcatagaaacagacaatatatgctcattataatatttgatgacttagctatcataatcagttctatgttttcacaatactgtttatcctgttataaacctaaattccgtttgatcaattatcggtctcagagcaagggaatcagtcttgcatgtattaattgaagcttatggtatgaagtacagcccaaagattaattttgcaagaaatataactataaaccagattctgacacctctatacaacacattaacacatctttgtcataagcacgattcaagacaacaccactttagaactttagttctctgctgttgaaggttgggagattttgtaaaaattttttacaaagataatctagtcatttcaaaaatctgccataagagaaagattttaagtttgaaagaagtcagaactatagttaatgatactgtattgtttacttgaaatttgctaagagggtagccttaagtgtaacactatgttatacgcatgtacaagtgagtcttaaaacaaacactcatgattttacttgtagcaactttgatttgctctctttacaaccaaacttcttgaaagtgattttgactcccagttttcaattcctcatttaatattattttaagtcataacacattacttcatttaaagccctcctagtcatactcctaattgttcttgtctctaccaggcacttgacatttatccaaccattcagttattaaacaaatattttttcagtgcttgacctgctgcctattgctgggatatgtcctggaaatccaacagtggatgcttctattgttttgtctacctccgtaaatagctctgcttctgttggtctccagcaatgctgtccaatctcaaccagttagttatgcagaaaatgttgtaaaactcatgtgccagcattatctttatttttgcctcaaaaacagagcctattgacaataagagtaaaatgtttcagttcagaggcaagaattatacaagtgaacattttgaagtaatgacaatgagtgactataacaaaatttagagacttataaaggaaactacgtgatgcccaggtgctgaaacaccattcatagtggagaaatcaaagtcacgccatgtgtgttttacaaatcattaacacattcagaataaatgcttgaaaatatgaatagcttagagaggaaagagtttttctgtcctacttacttacctatctgataacttgtgaaaatggctgcttcaacctgtatgcacattcagtgtaacatttccaaaacctatactttctctaatatcaccgagccatgtcaggtgaaaatacacgtaatttctgtagctattgttttgtgctaactttacagaattttttcagtcaaccaacagtattacattacttagtagtgcccttgtctcagagccagttaatcataaacattccgacaggttgaaccatctaacaatggaatggattctcatgtgttttctgcacactcgctccccaattatgttctatgagaagatccagaagagactcccttcactaagggattaagaaacatatgggtaaggggagattttccatcagtgaaagttctctggttgctcacttctgtgggccagatatgactataaaagaggccacaattgagaaatgctcacagatttcaataagaatgatgtgattccagaaaatcacatgcaacattgtagcacttaaccaccaaacaaaatgtgggcatacctacaatcaaggctggcagagttgtacaggtcatcagagtgtcttggaccaagaaaacttgggcaggggctaaatgatattgacatccttagaacaaaatagagaccctttcagaatattgcttaattcatatgacaagaaattcttcaggtctggagccaaaaacttgactccagtcaccactgtggagatatagcctcccaccaagttttatgttaattttctgattcagagccctttgattaaatagggtgcctggagggctctgcactattgacgcaccactcacagtaaatctttccccatgccttccccaaagagacctgtggccttctttatagcatatctactctgtgaagcaattcactgtgaatagcttttcctggcacctgagaagtttacctagactactcttcttcatggatttcatagtctgggactactggtcacatctttctttccagaatactttcctattttttgttgttgttgctgtttgttgttttgagacagggcctcattctgtcccccaggctggagggcagtgacacaatctccactcactgcaacctccacctcccaggctcaaacgattctcccacctcagcctcctgagtagctgagaccacaggtgtgtgccaccgtgcccagctgatttttatatttttgtagagacaaggttttgccatgttgctcaggctggtcttaattagagggctcaagtgatctgcctgccttagcctcccaaagggatgggattacagatgtgagccaccatgcccgatctgcttttccatttggattcatggaatagcctctcctgattctacttctatatttttagctactttgtattattggagcataatatagacacagaaattgtcctaaattatgagagtgtaggtcaatgagtttctcaaatagaacaacctcatataatcactacattgatcaacaaatagggcagcccccacaccttagatatcatcattttgacctcttccagttagtaaccatctaggtttgtcattaccttgacttctaacactatgaattagtttcgtctgattttgagcttaatataaatgtatcatactgtatgcattcttttatgtatggcttcttttgctcagcatgataaatctaatgtttggaagattgcttcaatgttacatatcattatagtaacattcattttcttacctcttttgtatgagtaaacacaaattatccattctacttttgatgaacatttgagttgtttcccaaatattactgtattataatgaaaactgttatgaacattatgtacaagtctttggagaacatattatacacttctgttgtttgattcactcattaaatattatttttaccagtgttctgaaattggtcctctttggtgatcacgcatcacttttgttactacttatttctttaaaatttctacaaacacatctgtctgctgagaacttctgaacttttaacaggtacttccagtacttaatatttaattatttttcttctttaattttcctttctatattaccttcttagattaatgtgtgcaagacacacggtagagttacttaaagtattgcctttttcttatttggtaatgaaatgtgtcaattctacttaattaacaaccctatacttaatgatcttctgccacggtcttagtttctgccttcatcttatttgaaagtgtttgtaaaactaattttctgatagcaatgctgatgtctagtgatttagagtagttgggttgttaaaaattagttactgcattccaagataaaagttgttattatcacaaactctttgagcaatccttattgtagcagtgcacgagagaatgaagtgaatatcaactgagaaactggaaaataataagcaataaaatgcttgaaaagaaaaaaaaaaaagaaaacagtttttgtgaatgtttggcaggtgaatcccctgaggaatgaatgccttggtatttgtgactccacataaatcaaacggacataaaaagagatctcaattttggcacaaacaaattgatctgactggatggtggctgataaaatgcatctttaccccaagttcaaaaagatcttggctgatcaaggcagcaattcagaagataataaagtctggagagacttgaacaagttttgtggagtttatataaaaggaagactgagagggaaatgtcaaaatattgaggagtacaataccatgatcattataaacattacattactgaaggttgcatatatggatatatgcaaatgatatgaaagggatgaaaccttttcataaaaatataaaaaatcaacattcattttcactggtaatttattctaagccttatttctaatgatgctgtgtgtgtgtgtgtgtgtgtgtgtgtgtgtgtttctaggattaaataaatatgtgcctttcttctgggattaaatcttttcactcattttctcgttgctgctttgattgtgtccaaacatcttatgacagagatttggcttttgctttatttctaaatgcttctcattagcacctaggttcctgctgtatcaaactttaaatgtttgaaatactatatataattttagttttcttggccttggctcatatggtttaattttcctggaatagttttaccttacttgaccatttggaaaattcctattcttttctaagattccggtcctggatctcagtatttttgaaagcttctcttgaccttcataagcaaacctgtgttgttacttcttcttgtgtcatttttttcataatatacagccttggctcttcacctttagcatttacaaaaattgccattattttttaaatggactttctagccccaatgctaaatttgctcacaataatttttagaataaattcaaaaatatactaagaagattcttatacaaaaagtttgagtatcttactctgagaacactgttccatagctattatcacttttcacattaatattttctaacagtctttgttttccttaagggaaggaaaggataacatttattttcctagcacctgttatagggatagacaagtagtattaatttaataattgataatttttgtttattatacacttatgtggaacttaatgtaggtctgtacaattgtaagctttttataagtattaaactgattaagtctcattattaacctgtgaaggtgctactcttattccttgttttcaggtgagtaaactcaacagacaagttactaacttgcctaatttcaggcagttagaaaggcagctctaattaaaatataagaaatatgatttcaaattaaaggaatttatccacttcataacactctggaatgttgatttttaaaatatgtattgtagtataacactgacatatgtaccaacatcaaatgtacaggctgaaaaattatccaaaagtcagcacagcattataaagatgactcatgtgaagtaataaaatctgagctgaatcctaggaaattccttctttcccctacacagtagtaactctccctctcaccattatcctcacatctgttcatactttacagttatttatttcactcaacatgcagtttgtgtgtaaacaacacattgtacttatttattccatatttgatatctatttttccagtttggatctaatataaattatgtttctagaaagattattatacatatctttaggaggaagtatatgtacacatttatgtatttctatatacacactatatatacacacactgtatatatgaatacatacacacaaacatgcaaacacctgtatgcatatatagtcaggatggatttgggcaatgaggtcgaaaggatacgttcattacgttcattacaagattaagtcgaatgtttttcagagtcgtagtgatttacattcccttcatcagtgcgtgcaaatttcgtttgtgcagcttctatagaaaccctaaatacactttattttttaaagtttagctttttagtaattatagagtagaatttatttttatttttaatttgtatttaataaaagtagcttgatttccttttatttttttctttctttaattttttttttaattctgtgtggtaaagtgctttgaaaaggcctttcttgatgtttcatttggttgtacttttatttcttatttattaatttttttttttttggagatggttctaactctgtcacccaggctggagtgcagtggttgattagagctcactgcatccttgacctccccgactcaaaagagcctagctactcaggagtagctgggactacaggccagagccaccatgcctggctaattttttaaattttttgtataggcagagttctctcactatgttgcccagacaggtctcagatccctgggctcaagtagtcctcccactttgccctcccaaagtgctgggattaatgttgtgagccaccgtacctgaccatgttttttttttcaaaaaattcatttgtgaagtttaaaaagtatcttttaagagttcttactgtatttatattgcaaatttcattacccattctgttgctagccttttcactctcagtgagttattttatgattacaaatccttgtttatgttattttattactattaacttatttatcttatttattagccttcagtggttagttttttagtctttttttaaatcttaaggtcatagaagtgccctctatattactttttaaaaactgtactgttttatgttacacattggcttctatatgaaataatttttgtgtatgttgtgaagttggatgttaatattcatttttctctatggatttatgaaagacagcacaatttattgaaaatacatcttttccttgctgtactgaagcactatttttttcacaaatcagctaaatatattgttgtgtggttctctttatgagttctccattctgtttcattgaaatatctatacttgcaccttttccataatgtcataattaatatacatttataaaaactttaataaagtcttcacattatattttttcttcaaagttatttatgcactgcgtttttatttgcattttacagtcagtttttcagttgccgccaaatataatgcagacaaattacactattactaatcacagtattgtgattttcagtgtattacaaatatagatttatttaaaatactgactctttcttctaatactaggaataacaaagaaacatggtacatctttatttctgttgaatgtctttaatttctcttaatctttcacaattttcagtaaagggattgaatataatatgttatattttatattaggaattcaatgtttcttcctggaaacatttcagatttttaatattttacttgatttagactcactacatttggaaagcttcaattacaattttacttttaacagatatagagctactcagatttgctattcttgtgtcactatttacgattttttagaaatgtcttctatttcatcaaattatttcacaatttttgacttaaagttacttattacattctctttttctctctcgtgactatagaatctataatgatttcctcattattcatgatatttagaatttgtggatattcttttttaatttcatgcataatcatggtatatttttatcagtcttttcatagtaactttggcttttgctgatttcatttattttatgattgtttctttttctcctgcttcttatttatattctcttttttaattctttggatttaatttgacattacatttaaaatttttgagattgacgattacattattaattttcaaactttatttttttaacatatttatgtaaccatatatttatctccaagctgaggtttgcctaagtctcccaacttttaacaagcagtatttttactttcatttttattaaattcaaaatatattttaatgttcactgtaattacttttttgatccatgaataacttagaaatgtgatgcttaatttccaaacatttgttaactttcaaagtcttgctatagatttccagcttaataacattgttgtacaaaaaacactgtcaaagatttcaaatttttggtatttattgattcttgcttggggcctaacctcagcctctatctatctatctatctatctatctatctatctatctatctatctacctatctatcatctatcatctatctacctagacagagatatctatagatatctatggtaaattttgaaacatgttccaaatacactataataaattgtatgttttgctgtttttgagtgcagtttttatgtcaaagtatttaattctactgctttaaatgtttgtattattgatattttgtatcctttttgctatcatgtatcaaaaatgtgtattaaagtctttatgattgaagatgtgcctattgctccttttagttctataaattatgcatgcgcattaactgtgtgtgcgtgaatataaatacacaagttagacaacttcctcaataattgattcttttatgtgaatgatgtatacatcttcctctcaggtaataatttctgccttaaaatctctattgtctaatattaacatagctaaacaaattttcatttggcttgtgtttatcttttatatacatatatgaaatttttaaatttagatggttccatagatagaagatagaagatatatagatagaagatagtatatgtcttctacagatacagatatgtatatgtatatatacttatagatatattaatatttatatctatgtttataaatgtatatatgtagatagctatatatgtatatctacatatatatctacataccaatatatatctctaggtgtgtatatgatatctatatacatatagatatagatatgcaggtatatacatacatagataactatgtatatatatctatgcacatgtagaaatatagatgtagatataaatatatatctgtatagagttatgtgtagacatatatagatatatagataggtctatatagagaaccatctacctatatctagatagatatctatcaattgatatctctacctatctagctctagatagattatctaatctatctataaaactatcttgaaacgatcctaatttaaaaatcaagattcgttttaattcaaaaatcttaacttaaaagttaggaaccatctttattttgtggttcatatacaccatggaatactaggtggccataaaaaagagtgagatcaagtcatttgcaggaacatggagggagctggatggaggtcttcatccttagcaaactaatgcaagaacagaaaaccaaatactgcatgttctcatttacaagtgggagctaaattatgagaacacatgaacacatagagggaagcaacaggcactggggtctctgggagtgtggagggtgggaggaagttgaagatcaggaaaaacaactaatgggtactaggcttaatagctgggtggtgaaataatgtgcacaacaaacctctgtgacactagtttgccacataacaaacctacacaggtgccattgaactgaaaataaaagttaaaaatgatgaaaatacggaaacaaaaatcttcaaccaacacaaaacggttcatcccaagaatcatcttaatttaaaaatctttacatcttaagaagctacacgggaggctgaggcaggagaatcgcttgaacctgggaggcaacggttgcagtgaggcaagatcgcgccattgcactccagtccaagtgagagtgtgagactcagtctcaaaaaaataaaatgaaataaagagcaactttgatcttaaatagagtatatatccgtttacatttaatgtggtgaatgaaaaatttggttttcatttaccaccctacaatttgcctttctcaactaatactttatagataaaaggacttacggaaagcaaatatatgactcaatattccaataaaagtgcttgaaataatttatattgagcacgttatccttctttcttaaaaaccttaagctatacacattacatagataagcactgatgagaatctagtactaaataaccattatttcaaaggcatagatagaatgctttccaggtatggagtgtttccatacttcccttccatacattttcaagccattgcataacaaatacggaattttgtggagaggagtgaatttatatcctttaatattttctcactttagaaatgcagtcttggaatgatataaactctgtaaacagactatcatgttgtatttacgaagaattatattaaggtgtctatttttaagacaagaataaatatgtttttgttctaataatagaaatggataagcagaattctggcttataataatgagaacatactatcccctagtttgaaataagttaaataatttaactttctcatgttatcttgaagtttgtattgaatgtatcagtgcactacatgaaatgggacatttggtgctgtcaggcctctgagcccaagctaagccatcatatcccctgtgacctgtaggtacacatccaaatggcctgttcctgccttaactgatgacattccaccacaaaaggagtgaaaatggctggcccttgccttaagtgatgacattccaccacaaaataagtgaaaatggctggtccttgccttaactgatgacattaccttgtgaaatcccttttccgggctcatcctgactcaaaaagctcccccactgagcaccttgtgaccccccatgcctgcctgccagagaacaagccgcctttgactgtaattttcctttacctacccaaatcttataaaacagccccacccctatctcccttcgctgattctctttttggactcatcccgcctgcacccaggtgattaaaaagctttattgctcacacagagcctgttttgtggtctcttcacatggacgcgcgtgaaagttaccatcccttttatcctacacataaaatgattcagtggtttaaaacacttctttccatatcctgcagttttgcatagcaaaagaaacatgcactttgaggaaaatgtaccttttaattttttgtattttaaatattatgggtacaaaatatttgtatgtaattatggagtacatgtgatgtttcaatacctcctttttgatcccagatcttccctgaaatttttgtccaatttgtattgcattatttaagtttgagaaggagtaatgatgtttagtatatactgttataaaataactgattccaaagatgtaaagtatctgatacttactatgtccaaatataatttttaaggaaatgttcctaacgatgtgtaaataataacatggaataaaataaattcatataactttatgataataattttacttaaattaaaaagtgttatgtgcaaacagatggtatacgacgcgtggcatgcaataatgcaattgagtccaattaaatatattgtttgatttatttccacaatctgataaatgtattgtagaccaaaacatcaaaaaccataagtagggctgggcgcggtggctcaagcctgtaatcccaacactttggccaaggcaggcagatcatgaggtcaggagattgagaccatcgtggctaagatggtgaaaccccgtcgatacgaaaaatacaaaaaaattagccggacgtcgtggtgggcgcctgtagtcccagctaatcaagaggctgaggcagaagaatggcgtgaaccccggaggcggagcttgcagtgagcggagatggcgccactgcactccagcctgggcgacacagcgagactccgtctcaaaacaaacaaacaaacaaacaaacaaaccataagtagcctgtataatgtctttttattcgctgccatgtttttaatataaatatataagagcatcttaaattatttaaataagtcaattattttataagtgaatttagtattagaacatatatattcttttgcacaggaagcttttttaagtgtcagaaattatatacttatatagagacttttgttcacaaagtagttagttgtaggtacatacaacatacttgaaaaatatttttgtcgacattggatgcatttttctcttatagactcttaaaaatgttaacaagccaacatgtgaatatactgaagtattttttaatcttttctagtgtcgataacgagttggttgatataaagtcattagagtggcaattcaacaaatattttctatcgcataacaaatgtcattaacttgctagtctgtcatgctgttgcaaagataaagccacattcattagtgttttttgttgttgtttcttattggtgctttgtttgttttgtaacatgaagtggcccacttcttgtattaaattatttattctttctgaaaatgttcaatcagaatgtaataaaacctttgaaaaatgatttaaaaatttattcctgtaggtgggaaattgaacaggtgagaacacttagacacagggcagggaacatcacacccctgggcctgtcgtggggtgggggcagagaggcagggatagcattaggagaaatacctaatgtaaatgaggagttagcgggtgcagcaaaccaacatggcacatttatacctatgtaacaaacctgcacgttgtgcacgtgtgccctagaacttaaagtacaataaaaaatatatatttatttctactgaacaaaatgtccatatattagatggcctaggactggtaggggtctctaatccaggggattgttgataaactgagacaacttctataatttttacattgttactcttaaagtcttgtcattgtctgactgtctcaatattggaaaataacgtcaatattcagtgtaataaaccagaagaaaaatgggccgatatcccattcaattaaagacattgaaaagaatgtgtatgtattacttttactcacatcttaatgctcatcgtgttgtcaccaagccagatagaaccatatactggggaatgtaatgtttatctgagaaaccaaatgcctaaatacaaattttaatagtatgaagtaagaggaaataaatatgggggattttctagtcttctccattagatataaattgcaagatttggccactttaaaaaatattaatatttactaatttttcatcaattcaaatatcatatcatagagagcaatttaatcaaattagataacagttctaaatataaaatttaactgtatatctcccagaaaccaaaaaatgagaaattatctgtggcttttggctagacaaaggtttcttagatgtggcccaaagaacaacctagagaacaagcaaaaaaaccaattacaacaacagtaaatatgacttcataaaaacaaaaaattctatatttctagcctaaatgactcaaacttgtaatagacatttccaaattatgtctgataaaggatgtgtatccaaaatatgtaaactcaattttaaggcaaattacagtccaataataaacaataaggaaaagaatatatttgaacacatactttgccagaggaaattcagagacagcaaataatcacatcgaaagatgttcaatatctttagccattggagaaatacaaattaaatgagatgccattccacacctactagaataaatataattaaaaatactcatcatcttgtgtgttggtgatgatttaaaaaatctgtagctctcaaatactgatggtaggaaagtaaatgatacagccactctggagaaaaaaatggattgtttcttacaaagttaaatagacacccactattttacctacttactctactgttgttctttaagcagaaaacagtagagcatattatacatataagaatgtgtttacaagtgtccatggcaaacttatttataataagactaaactgtcaacaacccaaagtttatcaatgggtgaataaataaatccaacacggtatactcataacatgagatataacttcacacacacataaaaccatattttcagcaaatggtgctggaacaattggacatccacatccaaaaaaagaatctagacactgtgtttacacaatatacaagaatggataatagatttaaatataaaaatgcgagactatagaagaatattataaattgaattttatataagttagtacttctgctctaggaaagacatagtttatatttaaaaaacaagccaagactgggagacaatatttacaaaacatgtatccaatgaagaactggtatgagcaccccacagaactcttaaaactcaaaaagaaaaaaagttaaataatccagttaaaaagtgggcaggagatctgaacagacatttcaccaagggaaacatattaatggcaaataagtaaatgaaatatgctcaacatcatatattgttagagaactgctcattagaacaagataccaccacatgcctactaaaatggctaaaatccaaatcactgacaacactaaattgtgttgaggataaagagcaagggaaacttattgattgcttgtgggaatgcaaaatggcacaaccacgttagaagatagttttgcatttcttacaaagttaaatgtagtcttaccacatggaccagtaacttcacccctatccaaatgagtcaaaaatctttctacacaaaaatgtcacatgactccttaaaacagcttttctcgtaacaaaacttggtagctactaagatgcccccaacaggtgagtgatggctcaataaactggcatatctataaaatgggatattcagtgttaaaagaataagctatcaagccatacaaaatatgcaagaacctagagtacatataactaagtgaaagaagctaatctgaagaggctgtacactgtatcattccaatgatgtaacattcttaaaaaggggaaaatctataaaaagatcagaatttccagtagtctccaagggaaaggatgaataaatcaagcacagaaatttttaagaaagtaaaactattcttataataccatagtagtgggtacatgacatatgcacttgtcccagcccatgaaatgtataatgccaagagtgaaccctaatataaaactaatatatggactttcatttataataatatgtcaatacggatgcatcagttataacaaaggcaccacactaatgcaagatactaatcataaagaatatggagggtagaagaaagtgtttggaaattctctgtgctttgttagttttttctataaacctaaaattgttctcaaaataaaatctattaatttaaaaaagaatgaactattgttaccagtatcaacataggtgaaagtcagagtagttatgttgagtgcaaaagacagacaaaaaagaatagattttgtgtgattacatttacataaaattctaccaagtgtaaaccattctgtagtatcagaaatagattagtagttgcatggagattaagtagggaagaggggaagaagccattactaaagacacaaagcaactttggggaaatgaatatgttcattatcttgatcgccatggtgttttcttatgtaccaatatgccaaaactttaaaaataatatacactggattatgttcagtttatgtcaattacacttcaatgaaaaacatttaaaaatattatgtatcttgattttatatttattcagagatattattattctctacctgccatatatgccttttggcagtgtaaagatatataaacatagtatgtaaatatggtatttgtaatattcttattcatatgcaaagatagtttacatttaatttttttaacttttcttctatttttattctgtatcctccagacattaacattgagaacttcatatactattacatatttaaaaatgagtcatgtccagtataatacaaaatttcagcaatgtgacatgacaggaacaaaatataaatgaagttgctttatatagattcattttgctcattaaaacatttcatagaataaatcacttattcaaaagtattaacatatatatttaagagtgcactatgaaaaaacagaatcaagaaatggataccagattgatactcactaaatcgtatgttaaagcattttgaataattttgtagtttttcaaaagtaactcacacatgtcacatattaataatgtatatatttatttttaggaactccttttagataactattaggtatatagttttatgctgagttttatgagaactagaaaaagcatatcattttatgtcagaaatagtatattggttcctaggtcattttctatagctgtcaaaatgtttcaatgtcttttaaaactcaagaaaatgaggaagaaatacagaaatattcctaggttaattgtttttatatccttatctagttctttctattcttaattatattaattcttcccaatggcttatttaaaaatgggtcttcaattgtctttcattaaaattctatggggtctcattacctgtaaaaaggttttatttcacacgaagtattttttggttatgtaaaaggaaactaaagctctgggctaaataaataacttttttaaattttccctattgggaagtagttgaatatatacattgctgtattcagctaaaacatattagaatgtgcttttatttacaataaaaatgaaataaggctgcgttacattggcaagctgtaatgggaaatgtatttgtcaccctaggcaaactgaaaaggcaggtatattgaattcagtaatgctgagtaattaagccttcacttacaacccttatattagataattcaacttaataagttaagtcattttccaagtgtttgttaatgtatcaaaaggatttatacatttcacaaacggggactcaagctaaggtaaagatttataaacacaaccaattcactagagaaagaattttaagcttgtttttcttgtttttccaaacctaactctttcatggaaaaaaataaaggcaatattataaaacagatgaaagtgcaggtaattaccttaagtgacattgagaagcctagagctcacctggtccacactatttgataagccatgtcacccctcatttacttccacggttcccttcaagattgaagagctgtctgaataccacagtcttagtatattatatttttgtaaggaaacctgctcactcaagaacatcttctgtgagagccaatccattcagcatgttaggaagtttccttccatgtatgattcaggcccacctgatccagtggattggacaatgaatgaacacttgatttaggtggaagttatccatttattgattagaaatcagtaagcctctttcacttgagaattccaattgagatgaagaatataataggtatgcatactggatgagcaaagccaaatagcctccgtaatgttataaagaataatattgagccacaggcaagcagtggagatacaaagagtacaagagtaagggaacaaatgttgccctggagtgagagaaattgataaaaagccactgccttgatgttggacaggttcttagttctatgttcagcctttattttctgctcttggattctacactgtacatttcaagtttatttacaaatggttttgactacagaaaaagcaagtgtgccattatgtaatttttgacgtattttgggagaaataaagtaaaaagtattttttccttttcttttatttatttttatatttatttatttatttattttttgagattgagtttctctcttgctgcccaggctggagtgcagtggcgtgatcttggctcactgcaacctccgtcccccaggttcaggtgattctcctgcctcagcctcctgagtagctgggaatacaggcgtgtgccaccatgcccagctagtttttgtatttttaatagagttggggtttcaccttgttggccaggctggtctcgaactccagatctcaggtgatccacccaccttggtctcccaaagtgtttggattacaggcgtgagttactgcacccagccacaaaaagtattgagagtttttcaaagtagtttctgagttacatgtaaaaacaagataaaaaaatttactaacagctctgcagctttcaaaattaagcagtcagatttctatgtggctgagaatttctagcagtctcctccattagaatttgccatgcccaaaatgtcctatgctgtacagttaaatgattgatgtttaagtaatattcagtttgaaagctgactttaaatgtttccttgaggggaaaacatgcttagcatttcattataaaattatccaagctttgctctcatttctatgttcaaattcaatgcatgagttaaagcatcttaagacttccttttaagcaatttatatatttgccctaagatttcaactagtcctaatatcagaggatcacttcattggaaaagttgtgcaaaagtaaaatgaaatggagattaactactaaattgtcatgttgagattcgtgataaatttagttacaatgatattattcaaattggaattaactgcaactttcctaggtatgtaaatgaaagtggagtgaaattgctatataaacctagggttatgaccatcaaaatacatgatatagcaatacaataatttaatgttgactcagggagtaataaatcagatatttcattcaacaagctgtgattttttaattataacttaagaattataagttaacatttataagtattgtttcttaataatgagttgacaaaaataatagttgaaaaatacaattatatagcatgattatattgtgaaaatttacattaaaaattaaaataatgaataaatcacctttggaaactactgttatttaaaatatcaggagtccagaaaattgcaacttattttgatctacataatcatttttacatgaaaatttaattccaaaaccattgcaaagattattttcttaataaccatagtattaagaatcagtttctgtgaaagtacaatagaatacaaacatatcctagatgtattgttttctgcatttatgcaagaacaataagattttttaaatgtttgacttatctgtggaaatatgatagagacaattgtatgatttggtttaaggattactcatttctgtacttagatgaggtaattttttcttttctagataaactctaattccacttttttcatacagtacacacctatacatgcatatataagtttccgttaaacaacagtagtaagatttgaacagattatttacctacctttctgaaaagtgtctgttaacattgttataagcctataagggaagaaagggactatattacaaaagaacagaaatgatccaggagagtatgaacacaactggattctaagaatactgggctattgggtatcgggatgtagattgggataaaagattatacccctatcagaacactgtcagtttcactattgatgtggtacaaacacatgataggatggtttgcagcatcaaggaaaaagtgatggcctcaggtgaggttgcaatgtcaaatttcccatggaagctgacagaagatgcacacgtcacaaagaaaataacatgtagaatacttaaaatctactctcaataatttttaagttattttaaattatatactattgttattaactatagtcactattgccatagtcgctataactacagtcactatagatctattacataatgtacaatagatctctgaaatttacttctcctgtcaatttaaattttgtttcctttgactaacattgagatagcaatttttatcacaatttaaaaattataataacataaaacaatataattttacagcaaggaaaaggcatttcttgaaagttaattcacaacattgaatgaattgctaaacaaaacattgtcaagaaccaaaacaactctagatatctcaggcagaatgaattcaaagaaaatgactgtgcatattatttctcaacattagattcacaatggaatcacctggggcaattttttaaagaaacaaatgcctaaatatcatatccagattctaatttatttgttattagatatggtctggaatcactctactcctgacgtccctgctcaagaatcaacttccaggaagagagactgggactcactgattttggtgctattcagttgaactatgcccctactgattttccacctgctggttctattcattatagatagggagatgttaacatctccaattataatagtagatttatctgtctgttcttgcagttctatctgttttcacctcatgtgttattgacagcccgttacatgcaaacacattaaggattgttatgttttcttggaaaattaaaccctttgtgactatgtaatatcgcttttgtatccccctataattattcttgctctgaagtctttttgttggaaattaatatattaatccagctttcttttaattagtattatcatgttatatatttttcaaagttaactctcaagcttgtccacaatgcgcttccagaaattaatcaactacatgttaaagttttctgctccattactaacatctatgggggctcctgggcttttgctccactatgctacaattctttgcatttccccatctctctaattaagtggagatttagggtgggggcagcagtttgttctgtggcctcagtcccctaacggatttaaaatgagttgttgatactctgtttatacagcatttttcttgtaaggatgggagtgatgacttccaagtttcttacatgcttgaataactgacattttttactatattctcacccctatggtggtagaaaaatgctataatttttggatccacagaactaaagtactaggagaggggttttttcacaggaaagatggttgctactgaaaaaaaaaagaaaaaaaaaagataaagtcttctctgctatctctgctagattctctaaactctcttcctgtctctggagtccagacacacaagcctccttttagttttgagctttcactatgcttttatcttaaaaactttgcctactatgtcctttctgctgagaaagcaccttatcccctcaattacctagttaacatcaaatatcaaatcatacttcttactgaaggccaagtaccacctctagaagttttccctaagaacagcctacatacacttaattctgtgagcccttttcttatatcctttgaatgctcttccttcacattactcttccttcacagcctttagccaggcaatatattacaggaaaacagggagaacataatttttgccatttactcttacctttgcctagcccagtgcctggcaaacaatagattctcattatgtattttttttgaatgaattaataaatccaagtaaaataattgatgttttggaattatctaagactgttaaaatcagttaaatatagttaatgtgaagcaaaaaacagtaaacaaaattaatgtaatatacatgctgatgttattttagaaaaaacacaataatttacaaattcctttcaataattcaattaacttttatgagatttgattgaagacaaatctatgaatgctttgttgtaaataaaaggtaatccttgtaataagcaaaaataaattaacataacaaatatcaatttacagatagatgaaaagtgattgttttctagatgaaaggaagattattaatagttggcataagaaatcaaaaattagttcaacaattagtcatacggaaatgttgaatattgacattaatgtgataaagaaaacgagagtttctgcaaataacctcccatatctgatgtgaatctttcacgtcattctatagttcaactagttcttaataactcaaaaacaagaaggataaaatccatcattttgtttggctacccagatccctcctgtagctgtcatacagagtgtgatttatgagttgtaagttgtgctgtggagcttgacaagtaagtttgatttcatttagtatcttctttaaaccatcttagatcttctctttgacaagaatttatgttagtgttctcaaaatgtaaaatgggtaacttaatgagaacaaaagttgtaccctaagatatatttgcattatctacatactcacaattaaatcttaacagttcaaatatacccatttgtaatagaatctaacagttttcctcttgaattttttgacaccagaaatttttggtcccaataatgtttagcttcctagtcacaaaccaaacagaaagcaaatttcatcagcttagaatggttaaaaccaacacagctgcaatatttttatttttgttttaaaattttgtttagtcaaatatagttttaagatgagtagaaattctcctgaagataataaagaaaaagtatgtcatataatatcttaaataaaaataataatagttattaattttttctgctcattatgttccagaatctgtactaagcattttagaggattattttatttaattcacacaataatcccttgagaaatatataattattatctttaattcacagttattgaaaatgagacacaaagaggttaagaattttgtccaaggtcaggcagctaatgtgacttagcaagggtgtaattaagaaaaaataagtctttcttatcttatgggaaatttggaaaagcaaatatctaggttctctttttaattaaaaaatataaaatgtaaaatgtgagtctctcttaaagcagggaatcaactttaattaaattgaaacaatacagaatcttttgttattcaggctctatattattattatctctgctgatagcaaaagctaagaatagaaaatatttctgacccaagttggtaaattatgaatcaacctgctagataatcagaataggctaacaagtggaattaaatgtaattattctatattaaatataatataaacaatttcttattataattttactaagattctaccagttgcaactgaaatataacattttaaatccaagcttaataaaagaacttggcatgagatgttttcataggaaatagtgacaattcatattatttttaagtgtaaatgagatgtattatttctgtatttcattttccttctaaaagttatttttaaagttttagtttttctgaagttgatagctattactaactcttttgggcaaagttttttgagatagattaatttatataattaggaagaaactaaagtagttgtgaaagtttctaaaaagataataaagtagttgtctttatgttataatagaaaatgagaatgtgaacgcagatcattttgactctcagagtttgtgttttcagcaaatattacctgaatattgatatataaattagaattccccaaaggaaaacatttaaaaatgttaaaattaataaaatcattagcttatatacttgtccttagtatcaggacattctccagtggattcaatagagcatctgcagttttattttttgaacaaaggtttctgcaatatagactcatggtgtgagcttactgggtcatgttctttgttccttcttggagctttgggaggcatttataaaagagctgctgtagtagaaggactgagttgtatcaccctgaggatttaagtttctgcgggagaatcaaattcactttagtatagggatttagtaggtttccctagccttattaacaaaatatcatggactggattattaacaaaatactaatacgacatgaaaagtgcatactttgtcttacaataatccagttaagacactatttttgtatagcaaaattctttactacacactagttacaaatcaagtgagcaagaggtggtcatactgctctgcttcctattcctgccctttcctcctaccccagctgaaaatacttgctgcaaatgtccttttataggagactttgaccccagggtgtagaaagggaaaggaaaaggtcagaaatatatgtcttgtctataacttaaatctaataccagcacaaaagcctgaaaggactgatttttagagagcgttggcaggaaactgctctgctatcatctgttttaagctacttttatacattatttttttcggcttctactctgctactattcaactgcaatttgttttattgtacacttcaacaccatgaacagtatcttagttattattgaaatgtattacaagttcataaagaaaacagcattttgtttcttcagtcatctactttggatgaaagtgttatttagaaaagactaaatgggaaaaataatacattaaaaataaaaattgcatattaattttttagatcaaataaaccaattttcagcattttcatggacctttataaccaaaataaataaacatttaaagacagatgatttaattcagtattttgtttcttgaaaatactggaatatgtgttttagataatgtatatatttctgttattgaaaagttttcaatagtcagctgacttcatatgcaactttttgcaaataataataccattttaaacttattcaaggattttaggtgttcttaaatattattttataacttattttactcccctaaagtaaatatttatggcatctgtaagccattgtacaattggtatagcatagtattaggattgtcctttgtaatattttatagtattcacatttgtatttaatcgcaaatttgatataatttagccaagccttcaatacatttataaagagagcactactgagactttatacaatggaataaaataacaaaatgtgatggcagcattcttccactcaaagagatatatatattttttattctatccaatttttaactaattttattttttgcacccaatggaggggaaaattactaaaagtgtgattaaggctattataagatacataaactgtatgacacaagcattctcaactcaactttacacttcacattgtttatgaacttagtatgccagctttttaagtgtggtggggtctggtattccacacttatatgtctctgaatcccacccttgtgctgatgctaagatgaactgaagcagggatgaatttttctcttacatggaaacatgaatatattccaaactggagggagctctcacaagcagttcgcctacggtaattactttgtgccttgtaatgggtcacacagtatcctcaaaaaggtgtgtctgagtcctagaccctctcccctcccagtacctgtaaatgtcaccttattttgaaataggagctttacagataaaataaagttaaagatctcagggtgagatcatccggaatttagagtgagtcatggatatttgggacacagaaacacaagcaaggtcatgtgaagatagagacaaaggttacagttatgctgtcacaagccaaggagtaccaggaaccacccggaactagaagaggcagggaaggattcttccctagagccatcagaagaagtacggtcctgagtacgcctggattttggtctttttgcctctataagtgagagatattattattattactattattattattattgtaacaattttaagccacaagttttgtagcaatttcttttggcagcactaggaaactagttaatgcctctattatttggttaaacaaagaacactattaagtatttttaaaacaatgtatatgaatgttgattatggtaagcaaacagtttataatcagatcagtttctatgtaaaatttcatgttattatattgattttgttttgttttaaccatacaagacttgcttggatgtggtaccattgaataccatccccattccctcctgtcccacaactttttgaaatttatggggctttgttctagactgaatatttcttttccctcaaatttcatatgttaaagccctaccccacaatgtgacagtattgggaagtgaggtctttgagaattaattaggtttagacaaagtcatgagcttaggaccctcatcaatggaattagtgtccttataagaacaggaagtctatagagtgctctctctctctctctctctctctctgtgtctctctctctctctgtccatctgctacgtgaggaaaaagcaagctgggaagaagacctcacgaggaaacaaatttgccagcaccttaatcttgcactttccagcttctaaaattctgagaaataaatgtctgttgtgtaagccatccagtccatgacattctgttatagaatcctggactgactgatatgggctggaacatgctggagagatggtacaaaatctaattttagaaaaatattttaagttgtaagatctgaggcaaaaatcagttaaatattaccatttacattaaccaaattactccatttgcagtatcaaattaaggaaatttatgttttattcaagcttttaaaatcagcacacccactttgcagaagtaattaataacccatgattattaattatgtttgccaatttaattttcatccagtattacttgcagggaaagtttgaaatagataaatcatcttccttttgagatgtcacttgtatcactaaaggctacctataatttctgtaattgttactctttaatgcaactttaaacttcgaagaaagatgtttcaatatttttttttggtttttgttttttcttttcttttttgttcattttgtttgataatgtatctttttatattattattatactttaagttttagggtacatgtgcacaatgtgaaggttagttacatatgtatacatgtgccatgctggtgtgctgcacccattaactcgtcatttagcattaggtgtatctcctaatgctatccctctcccctccccccaccccacaacagtccccagagtgtgatgttctccttcctgtgtccatgtgttctcattgttcaattcccacctatgagtgagaacatgcggtgtttggttttttgtccttgcgatagtttactggcaatgatgatttccaatttcatccatgtccctacaaaggacatgaactcatcattttttatggctgcatagtattccatggtgtatatgtgacacattttcttaatccagtctatcattgttggacatttgggttggttccaagtatttgctattgtgaatagtgccacaataaacatacgtgtgcatgtgtctttatagcagcatgatttatagtcctttgggtatatacccagtaatgggatggctgggtcaaatggtatttctagttctatatccctgaggaatcgccacactgacttccacaatggtcgaactagtttacagtcccactaatagtgtaaaagtgttcctatttctccacatcctctccagcacctgttgtttcctgactttttaatgatcgccattgtaactggtgtgagatggtatctcattgtggttttgatttgcatttctctgatgcccagtgatggtgagcattttttcatgtgttttttggctgcataaatatcttcctttgagaagtgtctgttcatgtcctttgcccactttttgatggggttgtttgtttttttcttgtaaatttgtttgagttaattgtagattctggatattagccctttgtcagatgagtaggttgggaaatttttctcccattttgtaggttgcctgttcactctgatgggttgctgtgcagaagctctttagtttaattagatcccatttgtcaattttggcttattgttaaattgacttaaatgactaagactgtagcttaaatgaatgagattgtggtggagaggatattccccaaactaactctgtctctgacatttaggggtttgttgtaatagtaacaccttgctagcaatcatctactagtgatttgctcatggaacatgctggagagaaggagtgtctgagtcctagaccctctcccatcccagtacttgtaaatgtcaccttattttgaaataggagctttacagatataataaagttaaagatctcagggtgagatcatcctgaattaagattgagtcatggatatgaatatatgcatatatatatatatattgcatgcatgtggaggcaggttgtatataatataatatgtatatatattacatatgtatagtgtgtgtgtgtgtatatatatatatatgtgtgtgtgtgtgtgtgtgtgtgtgtgtattatatacaccctgcctccacatgcatggcctccctcattatcagtatcctcccctagagtggtacaactgtcaaaattgacttgcctacattaacacaatgttgtcacccagtggtaaatatacataacataaaagatataatttaatcattttaaattctaaaactcagtgatattgaatacattcacaatgttgtgtaattaacactgttttcataacttttatatcacatcaaacagaaattctgtaccattaagcaataattctccattccccttgccccagcctccatgccctagaaacaagcaatctgcattccccctgcatgaatttgactattcgtgatctttcatataagtagaatcatgtactatttgtccttttgtatctggcttattttatttagcataatgttttcaagatttatccatgttgtaaacatgtatcagaacgtcattccctttttatggctaaataatattcccttgtgtgtacatgccacattttgtttatccacacatacaggtttgttttcactttttgactcttgtgaataagaatgagtgatggtatctggcatgtgcaggcagccactttcttgctaaagaccaatagcatcaagcactctactaatggttgtaatttatctgattaggatccagatttccaaaaatgttaattcttattttttccagttcaatggcagttttcatggaggtattgacttctaaaacttcctattccaatcttctgaaatccactttaaaagagtggtttaaattctgtgtttgtaggatgaaattgataaaaaaatattttaacaactttcaaaattgcattacagagataatgtctttggctattgggtgttcacatatttggtatgttataaacaactttctggaaggtaaaggccttttatctcacacttaatattaagacaggaaccattgtcctagcaatagcttttggatttgatgtgatatatttgtatgtaatgagtttttaaaagttagagtgaaaagtcacctcatacaaaacaaaataatttttactgttataagaaagtagttattaattacttataaaacatgcaagtatctttgtgatatttggtgatttatttttctccagtcatcttgtgttgttcttagtggagaaaaaaatatgggtgctctttgtctatgacaatgtgaaaagtaagtatatggtttccctaaaaattcttctaagtttttaatcctctaaaatgatcattgatatgtaaaaataaatattaataatagcaacttaaggatcatttttgctgttatcagaaattgaaaatactgtaacagtccatcaataaatggttatgtatattatgatatatagcatacatagcgtatgtccatatatagaatatgtaagaaatgtatacaacaaagcacaatgaatacacgattatactaagatggatgggcatggatccacgtattattctgtttgtacatggtcttttccaaaaagaaataaaatgtaagaaagaagaaaaaaataaagagaaagagaataaaggcaactaaataaaatataaaccaggatgtgtaagtggtctcatcttaggactggaacaccagtaaagcctctcttctctggaaaaagtttatgtctctgaagttttctcagtgcatcacaactgacagcagcaggaatgtgtttttgctaacagcaatagaaaagcaaaactgtctcaagattgtaatattaatccaaaggttaaaacttcttaccttagtgttgctgctttctctatgcacatcccaaaggacctaggaaggtggaaaggacataggagatggaaaatgtagaaaataaaaaaataaggtaaatttaaaaggtaataagactaacatccattcattcacattaagctcctaattgtaacacattctctggtagacactgcggatatagcagtgaaaaaaaaaagaaaaaaaaatatgcctttttggagcttatattctcttggaaggagatattatatagcttaattacttttgttattatatatgttaagtgttgataagtgctatggaggaaagcaaggcagacaaagcaatcaggcaggagaaagaaagaaagggtattcaattaggaaaagaggaagtcaaattggccctgtttgcagatgacatgattgtatatctagaaaaccccattgtctcagcccaaaatctccttaagctgataagcaacttcagcaaagtctcaggataaaaaatcaatgtgcaaaaatcacaaacattcttatacaccaacaacagacaaacagagagccaaatcatgagtgaactcccattcacaattgcctcaaagagaataaaatacctaggaatccaacttacaagggatgtgaaggacctcttcaaggagaactacaaaccactgctcaacaaaataaaagaggacacaaacaaatggaagaacattccatgttcatggataggaagaatcaatatcgtgaaaatggctatactgtccaaggtaatttatagatttaatgctatccccatcaagctaccaatgcctttcttcacagaattggaaaaaactactttaaagttcatatggaaccaaaaaagagcccgcattgcctagtcaatcctaagccagaagaacaaaactggaggcatcatgctacctgacttcaaactatactacaaggctacagtaaccaaaacagcatggtactggtaccaaaacagagatatagaatactggaacagaacagagccctcagaagtaataccacacatctacaaccatctgatctttgacatacctgacaaaaacaggaaatggggaaaggagtccctatttaataaatggtgctgggaaaactggctagccttatgtagaaagctgaaactggatcccttccttacactttatacaaaaattaattcaagatggattaaaggcttaaatgttagacctaaaactataaaaaccctagaagaaaacctaggcaataccattcaggacataggcatgggcaaagacttcacatctaaaacaccaaaagcaatggcaacaaaagccaaaattgacaaatgggatctaattaaactgaagaacttctgcacagcaaaagaaactaccatcagagtgaacgggcaacctacagaatgctagcaaatttttgcaatctactcatctgacaaagggctaatatccagaatctacaaagaactcaaacaaatttacaagaaaaaaacaaccccataaaaaagtgggcaaaagttatgaacagatgcttcacaaaagaagacatttatacagccaacagacacttgaaaaaatgctcatcatcactggccatcagagaaatgcaaatcaaaaccacagttagataccatctcacaccagttagaatggcgatcattaaaaagtcaggaaacaacatgtgctggggaggatgtggagaaataggaacacttttacactgttggtgggactggaaactagttcaaccattgtggaagacagtgtgatgattcttcaaggatatagaactagaaatatcatttgacccagccatcccattactgggcatatacccaaaggattataaatcatgctgccataaagacacatgcacacgtatgtttattgcagcactattcacaatagcaaagacttggaaccaagccaaatgtccaacaatgatagactggattaagaaaatgtgtcacatatacaccatggaatactatgcagccataaaaaaggatgagttcatgtcctttgtagggacatggatgaagctggaaaccatcattctcagcaaactatcgcaaggacaagaaaaccaaacactgcatgttctcactcataggtgagaattgaacaatgagaacacttggacacaggaaggggaacatcacacctggggcatgttgtagggtgaagggagaggggagggatagcattacgagatacacctaatgtaaatgacgagttaatgggtgcagcacaccaacatgacacatgtatacataggtacgaaacctgcacattgtgcacatgtaccctagaacttaaagtataattaaaaaataaataaataataaataatttaaaaaaattaaaagaaacaaaacaacaacaaaaaacaaagcaaataacatgaggaggagatacaattttaagtagggaataaaggatggcatgacagagacagtagcatatgagtgaaaagcttgaaagaggtgatatggtttgactgggtcccccactaaatctaaagcttgaattgtagttcctgtaatccccatgtgtcatgggagggacctggtgggggttaatttaatcacggggtcagttacccccatgctgctgttcttgtggtatgagtgagttcttatgctctctggtggttttatcagggtctttttccccattttgcttggcacttctccttgctgccaccacgtgaagaaggatgtgttgcttccccttatcatggttataactttcctgaggtctcaccagctgtgcagaactgtgactcaattaaacctctttcctttataaattacccagtctaggatatgtttttattaacagcatgagaaggaactaatacagaaggtaagaaagcaatccaggggggatttgaagacaggtgttttcagtcacagaaaccatgtaaaaagcatctaatgtgagagtgctataatctgaatgttgacagccccccaaattcatacattgaaatctaattcacagtatgatactattaaaagctaaggtctttggaaggtgattatgtcatgaatacagagccttcatgaaggagattggtgcctttataaaagatgcctgaggggttggtttgtcccttccaccatatgatgactccaccatatgaagaagatgggtctatgaactaggaaatagggcctcatcatatatggaatatgtgagcacattgatctgggacttagcttccagaactgtgaagaataaatttatgtcctttataagctacttactatatgatattttgttatagctgctcaaatggactaacacagagacaattcccagcctgcccaaagagcatcaggaagtgttgggtacagtaaagctggaacagagccacgaggggaagagcaacagggctgtgatcaaagaggtgtgcctggtggggagcatgagtagagctgtataatctgtacaataatgacccagagtggaattagaagtccttaaaagtgggtgagcagagtggcatgatctctattatattatgttatattcttgcttggatattgagaatagactgaaggtgagggctaatgcagaagcaggaagggagataaaaattcagaggagacatgatgttggcttagcctgggtggataacagcagtagtaaaaattatttaaatgttttgaaggtaggtttgctgagaagtaattttggaggtacattaccaagactaaatttatattttataaaatgaacaaatttaaggtgtataccttaactttatatatttatgcactcatattcacaccacccatattaagataaagaacagaaactcttctggtgctttattccgcagaaaaccttctggtgctttattccagtcaataacaaacactggtcaaaggatattctactatgaccatagttttcttttgcctctcgctaaacttagtttgtctggagtcatacagattttaagcttttgtgtctgacctattttactcaacatgatgttttggagatacatccatgctgatttatgtgtctattttattttttattgctatgtattattactctgtaagtcaatatcataatttgtttatctcttctcctctttatagatgttacatccagtttttgcctacaaagaaaaacaaactgctatgaataaatttatatctgtctctatcgtgtgaatacacaccctcatttatttttggaatatacctattaattgaattatgatgtcattgggtatgtgcgcagtttaactttataagaaatagccaaacttatttaaaatgtagctatacaatttactttcccaccacaaatgtatgagattttctttgtttcataacctcttcagaattgctatattcagttcccaattttttttcttaagagatggggtctcgctctgtcacacaggctggagtggagtggcataatcatagctcactgcagccttgaactcctgggctcaagctatcctcccatattggtctccaggtatttagccattttaattttaccagttctcttggacatgtaatcacatctcattcaggcttttattttaatttttctgatgaccaactgtgttcaacacatttttttatcctgatcacccacttggctgtcttcttttataaactgactgttcaagtcttttgcccacttttaattgagtgatttatcttttgcataacaatttataggatttgtttactctccaaagaaatcttttgtcaggtctatgtatttcaaatatgttatctcactgtgacatttctattcatttttaattgggataaaaacataacttgtgatctatccttttaataaggttttaaatgtaaaatatagtactgttaagtataggcatgatgttgtacagaaaatctctggaacttatgcaacttacacaactgaaattttatacccattgaacagcaacccttcttcctccttcccctaaccattctactctctatttctatgagtttgacttttttatttttattttttttgagacggagtctcgctttgttgcccaggctggagtgcaatggcgcaatttcggctcactccaagttccacctcccaggttcacgccattctcccctcagcctcccgagtagctgggactacaggcacccgccaccacgcctggctaattttgtgtatttttagtagagacgggggtttcaccatgtttgccaggatggtctcgatctcctgaccttgtgatccgcccgcctcggcctcccaaagtgctgggattacaggcttgagccaccgctcccggctgagtttgactattttagaaagctcatagaagtgaaatcatgcagaatttgtccttctgtgactgacttaccatgctgacatgatatcctccaggtttatccatgttgttgcaaatggcaaaatgtacttcttaaaattgaaaatattccattgtatttatacaccacattgtctttatccattcatgcagtaatggacatttaagtttttaaattttgttttttgtgagtaatgctgcaaagaacaggggtatgcaggtacctgtaccacatcctgatttccattcttttggacatatgcccaagagtaagatggggggtcatatagtagttttaattttagtgtttttgaggaacctccatactgttattcacagtgactgaaccaatttacatcccaatttacagagagtgtacaaggattccagtttctccccatcactgctaacacttgttatgtcttgttttgttttataacggctctcctaatgggtgtgaagtgatatcatattgtggctttcattcgtatttctctgatcattagggatgttgaacatattttcatataccttttggctatttgtatgtctttgaagaaaatttattcaatcattttgcccccctttttattttttctgttgttgaaggagttccttatatatgtaatgaggtttttagaataaatgaatataagtttaatatagtaaaaacattaatacaatttttatttttatgtttaatacattctgtgctccagaaaaaaatatcattgtttatctcacccaagatcattatgatgttcctcaaagttttcttctagaagctttagcattcatgcttaggtgtgtgatccatcttacattgaattttgtggatgatatgagtaagatattaagattaatgaaaatgttaattataataggttctcaggtcctagccaaaggttttgtatattaggatctcttgagatctaggttatttaaaggtaatagacaataagtattaatgaatttgttttctttatctatctggtggttcttaaactttgttgcatattagaatcaagtggtttgcttgcttgctttgttttgtcttgcttttaatagcactgccccaatcataccttcaaaaattctaatttgataacctggacatcaggatttttggaggaggaggggacagggtctcactctgtcacctaggctagtgtacagtggcatgatcatatcccacttcagcctcgaactcctgggcttgagggacccttctgcctcagcctctcacgtagcttgaattacaggtgttgagccaccatgcctggtgacattgggattttaatgggtctctgggtgagtgaatataaagtcatgtttaggaatcattgacaagctccagaagcctggaaaaatgtattcatgaagacagaggttagtgttactgtctccttggatgaaaacacctgacaagatttaggtatttatttattgatttattgatttatttattgggaaacaacattggaagcagtttctgatctgcctctttaatcccttggccaatgcaatcttgagttctttgtagtctcaccattaagtcttgtagggagaatacatctttacttcaagttttcatgcactttatcttcatcttggagaattattatttgaaaaaaagttctcaatatataactcatattaagtaaaatatgtataatacattgcaataattcaacaaatattgcttgtgatgttgtacttactttacacttgtgaaaaatgtaagcaaaatttttaaatagtattacattattttcatagaagaatcacagtaaaataagaactctacaagtccatattttactaagttgcattatttgaaaagcaaactaattttgaagtatctgatgatttcaaaacacagttcactattatttaattagaggatttgaaatataatttttaacattgacttagatactttcctgaaatctattagacataaaagtaaatggtatttatacatttgtttgtaagatgctatgattttaaatttaaaagtctatgtagctttttctgaaggaagctgttctacaattgtagaagcaattttggggcatttctcttacttgattgacttttttcttatccagatgctaccaattttcaagcttgcacaaagtccacttctatgagggaactcagcctacaaggctgtcatgtacatcagtaacatctatatctttatagtaccacatacgccttgccttatcaaatgaaattatataccacgaagtcaggatcgtatctcaactgttctgtaaactccacaatgcatagcatagtgtcactcatgggaaaaatgaaatacttgtgattgaaatggattaacattcttctcatgttaaggaacgtacttcttttattgtacctgttgttatgcagggtgtaagatttattattttctccagaattgatatcaataattaaaaatatataaaaattgaagataaatggggaaacgaacaatttatgaaggtcaaaactatgaagtaaatttcagttcatggatatttggtagaaatactaggttggagagtatggttcacatttgagaccaaattaaatattatttaatagatttctttcatacttagttgaaggaaagcatgtaataaaaacctagcttgaccaaaaacctgacttgctcttggcaaaaattgtggtgtagagagagagaaagagagagagaaggaagtaagaaaattaataacctctactctgtgggaaagtcgttccattccaaatgacacaaatagagaatctgatgaatccgagcctaagaaagtcgaaaaggaagcagattggtatctaatcattgaagacaataaacctgaacactaaaaagacatgactaaataaatgtcaggttctgaacaattaaactggttacttctcttacattgaagtaaagagagactggaaatttctgcctcaactctccctatcaactcaataccttagagtcgaacatagtgttccaaataaaaatataatgaggcagaagatgacaccttgtttactaaattttctagttcatattgaatagttccatctgagcttgaaagccaaggtcttggggaaccatttttaatgtgcttttcaaagagctcatattaaaataattactttatatgtaattagcaaataattagatatgaggctcacaaaggaaatatttatgttcatataatatggctaatgtatggtaacaatagtattaaatctatagatctatgatgggagaattactagaaaaacaatagtgggtctcccaatccatgagcatggaatgattttccatttgcttagatgattagttttcagcatacaaatcttacacacattttgctacatttatttccaagggtttatttttatagtattgtgaatataattatttcttaatttttttttaagagagaaagtgtcttgctctatctacctggctggagtgcagcatcttgcaatcatagctcactgcaaccttgaactactgggctcaagcaactctcctgcctcagtctcctgagtacctaggactgaggtgaatgccaccaagcctagctaattaaaaataaataaatacatttgtaaagaagatctctgtttgttgcgcaggctggttttgaactcctagcctcaagtaatcctcctgacttgacctcccaaggcactgggattacaggcctgagctctttagcccagccacttccatttcctgatggttttatcaatgtattcttcattgtattgactataatctccagtgcaatattggatagaattggtgagagtgaacattataaacatctttggcatgtcgccaattttgaggggaaaacatccagtctttcaccattagatgtgctgtaaaacacagtgtttttggtgattgttgttgctgatgtcctctatcaggttgaagaaattccattctatttttttattcatgttagattctgtcaaatcattttcctgcatcattgagataatcgtttcattttagttctttattttacaacataatatattacattatttactttttaaatactaaaacaatcctgcatttctgggattaatttcacttagttatggagtgcaatcatttgtatacatggttgaatttagtttgataatattttattggagattttcgtgtctatatttgtgaggtatactgatctgtaattttatttttattttttcttttttaaaatttctttttctttcttctttcatttttgcttttgaatataggccttataacatcaattgggaagtttttctctttctctattttctgagtatgagtatcatttcttcattgactatgtgaaataatttaccagtgaagtcatgtggtcctgtatattctcttatggaagacttttaattgttaattcaacatatttattcagattttctattcatgtttgtttcagctgtggtaatttatacatttttaagactttctaccataaatataagttgtataatttgtggtcacaaagtatttaatagtatttcccttataattcatacatttggacaggatgggggagaattggcagtagtaacctttgttcctgattttggtaatcaacactttatctcttatttcttttcttttttgagacagagttttgccgttgtcacccaggctggagtgcaaaggcaggatctgggttcactgtaacctctgcctcctgggttcaagcgattctccttcctcagcctcctgagtagctgggattacaggtgcccaccaccacgcccggctaatttttgtaatttttggagatggggtttcaccatgttggccaggctagtcacgaactgctggcctcaagtgatccatctgccatggcctcccaaagtgttgggattacaggtgtgagccaccatgcctggtcttttttattattcatcatctaaatatttctcaattttgtttaacttttcaaagatttagattttggatcattaaatttctttgttttttgttttcttttttctgttatttttttttagcataacatttttatttaaaaaataactattttccacaagaacaaaagtgtagcgagaggagtggtgataaaggttacatcctggcgagtctctctaaggtctggctagcagaggattgctgacttctcatacctgcttctgcattcaccctgctgctaccacacccttatgtagtctctggaaaactccactgtgttcttgtgacagaatgacagtaaaaatggcaaaaacatttattaaggactgaattctatcccccacaccacccaccgaaatttatacactgaagtcctaacccctggtgtgactctatttggagtgaagatttaaggctaatgaggtcataagagtggaatcctggttccatacaattaatgtccttataagaagagacactggagagcttctctctgccatgtgaggccacagcaggaagacagccatccacaggccaggaagagagccctcactaggacctacaacgggcaaacacctcgatttggaacttccctgcctccacaattgtgagaaatcaatgactcgtttaagccttttttttttaataggatttgagattggttatattaaggtaacaatggaaacatgaatacaaaattaatccacacataggaaaaaggaataatacataaaccactgaggttgctaataataatgatgcctgtttccaaggcaagtgaatacattatgagaccactgaagtgacttttagttaccttgcttagtgcctctgtctttttttttcctttattattattattattatacttttaacttttagggtacatgtgcacactgtgcaggttagttacatatgtatacatgtgacatgctggtgcgctgcacccactaactcgtcatctagcattaggtatatctcccagtgctatccctcccccctacccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaattacatccaagtccctacaaaggacatgaactcatcattttttatggctgcatagtattccatggtgtatatgtgacacattttcttaatccagtctatcattgttggacatttgggttggttccaagtgtttgctatcgtgaataatgccgcaataaacatatgtgtgcatgtgtctttatagcagcatgacttatagtcctttgggtatatacccagtaatgggatggctgggtcaaatggtatttccagtactagatccctgaggaatcgccaaactgacttccacaatggttgaactagtttatagtcccaccaacagtgtaaaagtgttcctatttctccacatcctctccagcacctgttgtttcctgactttgtaatgattgccattctaactggtgtgagatggtatctcattgtgcttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggtttcctgttcactctgatggtagtttcttttgctgtgcagaagctctttagtttaattagatcccatttgtcaattttgtcttttgttcccattgcttttggtgttttatacatgaagtccttgcccatgcctatgtcctcaatggtaatgcctaggttttcttctagggtttttatggttttaggtctaacgtttaagtctttaatccatctggaattgatttttgtataaggtgtaaggaagggatccagtttcagctttctacatatggctagccatttttccctgcaccatttattaaatagggaatcctttcccattgcttgtttttgtcaggtttgtcaaagatcagatagttgtagatatgcggtgttatttctgagggctctgttctgttccattgatctgtatctctgttttggtaccagtaccatgctgttttggttactgtagccttgtactttagtttgaagtcaggtagtgtgatgtctccagctttgttcttttggcttaggattgacttggcgatgcgggctcttttttggttccatatgaactttaaagtagttttttccaattctgtgaagaaagtcattggtagcttgatggggatggcattgaatctgtaaattaccttggacagtatggccattttcacgatattgattcttcctacccatgagcatggaatgttatcccatttgtttgtatcctcttttatttccttgagcagtggtttgtagttctccatgaagaggtccttcacatcccttgtaagttggattcctaggtattttattctctttgaagcaattgtgaatgggatttcactcatgatttggctctctgtttgtctgttattggtgtataagaaggcttgtgatttttgcacattgattttgtatcctgagactttgctgaatttgcttatcagcttaaggagattttgggctgagacaatggggttttctagatatacaatcatgtcatctgcaaacagggacaatttgacttcctcttttcctaactgaatacactttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatggcttttattattttgaaatatgccccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgaccacggtggataagctttttgatgtgctgctggattcgttttgccagtatgttattgaggatttttgcatcaatgttcatcaaggatattgatctaaaattctcttttttggttgtgtctctgcctggctttggtatcagaatgatgctggcctcataaaacgagttagggaggattccctctttttctattgattggaatactttcagaaggaatggtaccagttcctccttgtacctctgttagaattcggctgtgaatccatctggtcctggactctttttgttggtaagctattaattattgccacaatttcagatcctgttattggtctattcagagattcaattcttcctggtttagtcttgggacagtgtatatgtcgaggaatttatccatttcttctagattttctagtttatttgcatagaggtgtttgtagtattctctgatggtagtttgtatttctgtgggatcggtggtgatatctcctttatcattttttattgcgtctatttgattcttctctctttttttctttattagtcttgctagcggtctatcaattttgttgatcctttcaaaaaaccagctcctggattcattaattttttgaaaggtttttttttgtgtctctatttccttcagttctgctctgattttagttatttcttgccttctgctagcttttgaatgtgtttactcttgcttttctagttcttttaattgtgatgttagggtgtcaattttggatctttcctgctttctcttgtgggcatttagtgctataaatttccctctaagccaaaagaacaaagctggaggcatcacacttcctgactccaaactacactacaaggctacagtaaccaaaacagcatggtactggtaccaaaacagagatatagatcattggaacagaacagagccctcagaaataacgctgcatatctacaactatctgatctttgacaaacctgagaaaaacaagcaatggggaaaggattccctatttaataaatggtgcgggaaaaactggctagccatatgtagaaagctgaaactggatcccttccttacaccttatacaaaaatcaattccagatggattaaagacttaaacgttagacctaaaaccataaaaaccctagaagaaaacctaggcattaccattcaggacataggcatgggcaaggacttcatgtataaaacaccaaaagcaatgggaacaaaagacaaaattgacaaatgggatctaattaaactaaagagcttctgcacagcaaaagaaactaccatcagagtgaacaggaaacctacaaaatgggagaaaattttcgcaacctactcatctgacaaagggctaatatccagaatctacaatgaactcaaacaaatttacaagaaaaaaacaaacaaccctatcaaaaagtgggcgaaagacatgaacagacacttctcaaaagaagacatttatgcagccaaaaaacacatgaaaaaatgctcatcatcactggccatcagagaaatgcaaatcaaaagcacaatgagataccatctcacaccagttagaatggcaatcattacaaagtcaggaaacaacaggtgctggagaggatgtggagaaataggaacacttttacactgttggtgggactataaactagttcaaccattgtggaagtcagtgtggcgattcctcagggatctagtactggaaataccatttgacccagccatcccattactgggtatatacccaaaggactataagtcatgctgctataaagacacatgcacacatatgtttattgcggcattattcacgatagcaaacacttggaaccaacccaaatgtccaacaatgatagactggattaagaaaatgtgtcacatatacatcatggaatactatgcagccataaaaaatgatgagttcatgtcctttgtagggacatggatgaaattggaaatcatcattctcagtaaactatgacaagaacaaaaaaccaaacaccgcatattctcactcataggtgggaattgaacaatgagatcacatggacacaggaaggggaatatcacactctggggactgttgtggggtcgggggggggagggatagcattgggagatatacctaatgctagatgacgagttagtgggtgcagcacacagcatggcacatgtatacctatgtaactaacctgcacaatgtgcacatgtaccctaaaacttaaagtataataaaaaagagaaaaaagaaaccccccccaaaaaaagaaagagatatttattccttctatattttcctataaactcaaaagcctattaaaatgttaactatatggaaaatacataatacatactgatgacaaatttatttataataaaaatatcttagtatctttatatgtggatgatattgacaaagtttttctctttagttattttacaattgacttttaaaatgtcttgttattcagtaacgtctctaagtgctttccaacaataactgagaaaaataggtgattgaaacttgagagtttcacaggcttagtctacttctgaggtgagatgagaagccacagacagactatctctcaactatgatagtaatcttaattgatctcagaattttgctttactaggtcttaagcttattgttctttattacccattatttcacactttgcaactgactgggcattttgccagtgatcacaatgaataaaatgtggcttcagcggcctattactgtgctcaatgtctttgcaagttgctggcaaacatgattttattttagatactgttatatgaagtaattttttaaaatttatagtttgccaatttattcataaatttcttagtatcattttcattattaacacatttacataccgtgcttcacacttacctgtaaaatagtgaattctacatcaaaagtatttaacgagaacactggtggatgaagtgactatacttccaaagcaaaatcatctctttttaattcatcagcttagacggagaatgtttaatgttacttgtaaataatggactaacaaaaatccactaaccctaccttttgtgtttttatatgcaaaatagagttgtgttagactgtcttgaaattgactgacctgctctatataaaggcttgaggtgatcaggaatactctattctaaggatatgggagttttgacaattataatatccagaaaatataatatccattcatacaatatgaatggggaatgcaggtgtacttgtttatatatatatatatatatatatatatatatatatatatatatatattctattcatgtatacacattctgtgttactttctgtgttagcctgccacagtgtcatgaatgctaggagaagatacaggacccctggttcatggacaaagactttatttctcaaggcacagcaaggggcatgagttactcattcttattgttccttttaccccaaaagtctaacaagacaaagtagagggacctgagtagatactacacacagtggatttacatcagagcttagctactctaggctgaaggagcccaatcattttatcatgagatataagcaaacctccccaggatttgccttggagggagacatctttattaccaataagtaagaaaatatattcttgctttaaaaggggatactttgtctttcagaattgttctctacacaaagatcctttaaaagggagcctagtgcagaataacagttgtgcagaaatgcaaaagacacttggaggactgtctcctaacacctatcaaatgcagagtactacattaggtatcagggaaagaaagatgaaattatttgggctgatggaaatcagcagctcacttaaaagaagcatgagtggaaagttagttatggtaacgcaggagaggaagtgataccataatgtttaaaacagggagacatttagccaagtctaggaggtcagggagtacttttcaaagttaatacctgataagagttttgatgtaaattttctaaaaacgcttctatgtagctgtatctttcttactttcttaggggttctaggttatacaaaagtcaagaatttcaaggctttttattaaaaattgctcaacatatgtttctaagatttgtttgctaccagtagcctcctttagccaaaatttcataaggtttcaagattatataaagataatgaaaactaatctgaattagagtttttgcttaattagtaggatcttggaaattatcttgaagaatataagaagattttaataataattttatgtgcaaactcttgcccataacaataatgttttataattttatctccttctcatctcacttgaatatgcaatgttcaactaaaatcacttataaaagaagcaggaatatgggaatatttagcctttggggaatcttatttcctatgttgttgactatggcctccaaggaggaattttagatccctatttccctgcaagatgatctattatggtggattataacttctatgtctcattttatctcataatggataaagaaaacttggcacatataccatggaatattatgcagccataaaaaaaggatgagttcatgtcctttgcagggacatggatgaagctggaatccatcattctcagcaaactaacacaggaacagaaaaccaaacaccacatgttctcactcgtaaatggggctcgaacagtgagaacacatggacacagggagggaaacatcacacactgtggcctgttgggggttgggagggctagggtattaggagaagtatctaatgtagataatgagttgatgggtgcaacaaactctcatggctcatgtatacctatgtaacaatcctgtatgttctgcacatgtatcccagaagttaaagtataaaaaattccatatttttatattttgatgtacatattataccagtatagttatatatgtaaaaattttaagggtaaatacatataaaacatatattagtctttgatcagaattgtattaccaatataaataagaatatcatttagaatataaaattcctgattctgcaacaaatgacttaatattatcaatattaatcataattatttaaatgctttttagctgcccatcaccatattaataataggaataatgacagctaattttaattgagtacttcctaaatgtggcccagttacagtaaaacaaacactattagatacaccccatcaatcattacagcaagtctatgaaacatactgcattactaagtcaatattagaaatgaaaaactcatgggaaggatatgtataaaacttgctcaaagttacccagctaataagaggctaggacaagattaaacatctatgtagttttctttcctgagctgaagttcctaaatccttggctgcatggcgcctcattcaaaagtcctaaattggctaaaatatatataacagaaaattcacagaatcatttccttctacttgtccactaccagggctgttaacagtcccaagcaaaaggacaaaaattttttctacttgagataagaaaaatatacagggtgacagaaggtgttctaccaatataaaaacactttaccaggaaaattgagaagagggctgttaacctttggggaaatgtaggccttcagtggattcttgttagaaacataaagatgtagagagaagattttcatttaaaagcctcttccattcagcaaagtatattctgaatcctttatggtattaggctcccatatagttacaagtaaccccatgtggttttagaattcttaaatattcgcacacatagtcatctgaagaatgaataaatccatgaatgactaaacagagtttattcccatatcattttcaatatccctaaattatgcttacatccttaaatctgttacttcattctcaaagcacatagtctgtaactcataaaaataaactcctgttggccaggcacagtggctcacgcctgtaatcccagtactttgggaggctgaggtgggcggatcacctgaggtcaggagttcctgaccagcctgatcaacatggagaaaccctgtctctactaaaaatacaaaattagccaggattggtggcgcatgcctgtaatcccagctactgggaaggctgaggcagcagactcgcttgaacccaggaggtggaggttgcggtaagccaagatcaagccattgcactccagcctgggcaacaagagcgaaattctgtctcaataaataaataaataaataaataaataaacaaacaaacacctgtcttcctagtgttttatgtctatagttcagaaatgctttacctacttcatgatgtgtagtttgttctgatctgttccttttcttcattgtgtctagcctcataagtcatcttcctagttttggaataacctaatcccgtaaggtcattgctaatgtttcagctttgaataatttcctattttctgccctatgtattgaacccttctgttaattatgctgtctttaatatatcttacttgctttgaatagacttctgtaccattctacttataggttgttccagccaaactcattctaaataggtcaggcatggcctaaacattctaaataggccaggcatggtggctcacgcctgtaatcccagcactttaggaggctgaggtgggcaaatcaaaaggtcaggagttcgagaccagcctggctaaatgttgaaaccccatctctactaaagatacaaaaaattagccaggtgtggtgacttgtgcctgaaattgcagctactcaggaggctgaggcagttgaattgcttgaacacaggaggcagatgttgcagcgagccgagatctcaccattgtactccagcctgggtgacgggccgatactccatctccaaaaaaaaaaaaaaaaaaaaaagtaaagaaaaacatttatgaaagtgtgcacaacaaaattaaaatgttgactctaaagtgagcaactgaatgactgggatgcataagagaaaagggtacttaacatttttatacctattgaattgtatcctatgtacgtattataaatttaaatgtgcaataatgcagataactgaaatgtgggtatgctttgattaggactttgcatttcccatttgctcaaactcctcatgattctggatgcatatgaatagaaatacaaaatgtaaggggaccgaggacttctcatagccctttcttctttccacattttgtgtctctggctgtagtttgccatatgagtctatatggctaatgagcaaaatatttttcagatggatacctgtgaccaagcattgcattttaaagatatttctgaatcttggacctcttatttacagtgaagccccctcatgcatagtaaagcagacaggaatgtaaaaggttgctgcatcgataatcaatttctggtgagcagtaattataggtaatgtaaacagggacaattattgcttttcatcatatcttgagagaaatcctacagccaatgattttgaaaaaaataaaacatctaagttcactcttttctataatgaaaagacattatccagtagaagttcaagagtacagtctgaaggcagcttatctgacctggccacatggtcttgccactttagttaaagacaacttcctacacagtaacctctccagacctcagatcctcaactctctaaaatggaaacctagtagtatttacctctagaactgcagctgaactgagcattttaggaaaggaacaaacacacacacgatatatataatcagattatgaacgcagtgtggcccagagtgcaaaaatttctcagtactagagattctcaagagaaaaatgagatgtagtctatctcagtggcctttcatgtggcaaatgaaaagtgaaagtccataatgagaaatacatgggcagccagtgacaccacccattcaatgtagactctcaacatctctgacagtcattacctgttgtaccctgacctgcttatatattggggtaatatcaccttttgatcaaaacatacataaacctcaagcctcagtaagaaatatttatggacaaccagattttctgtgtttccagtcaaaactcaggtagaccacattttatgtgacaggagaaggcacagttgatgcccagttaaccctgagatcatctctgcctgcagcttcctatcatcatagcaagctctttccctgaagtacatcatctgtatctgctctttgctatataagtagcaaaaataagcatctgaaaagatgctcagcaccatatgtcactggggaattcaaattaaaacaacaatgagataccactacacatctattagactggcttaaatccaaacgctgacaccatcaaatgctggtgaggatatggagcagcaggaacactcattgattgctgctgggaatgcaaaatggtaaagccactgtggaaggcagttttgcaaattcctgcaaaactaaacatatgcttaccataagatctggcaattgcattctttggtgaatactcaaatgacctgaaactttatccactgaaattctgcacgtgaatgtttaaagcagcttatacatattcgacaaagattggaagtaaccaagatatcctacaatagggaaatggataaactatctctgaaacattcatacaatggaatattcttcaggaataaaaagaaactaccaaggcatgaaaagacttggaggaatcttaaacacgtatttctaagtgaaagaagccaatgtgaaaaggccacatagtgtagagttccaattatatggaatactagaaaaggcaaaactaggcagatggtattataaaaagttcagtggttgccaggggcttgagcaaagggaaggatgaataggtggagcacagaagatttttcgggcagtgaaacttttctgtgtgaccctataatggtggatatatgtccttaagcatttgtcaaagcccataaatggtagaacacaaagaatgaatgttaatataagccatgaacttaataatatcaatattggctcatcatgcataacaaatgtaccacattaacaagatgataatagaggaagtgtgtgtactatggtgtgaggcagatattagagcacaataggccttctgctctatttttctgtacgcctacaactgttctaaaaattaagtcaattatttatttatttattatttattaatttattttttgagatggagtctcactctgttgcccatgctggagtgcaatggcacgatcttggcttattgcaacctctgcctcctgggttcaagtgattctgctgcctcagcctcccaagtagctggaattacaggcacccagcaccatgcccggctaatttttttgtatttttagtagagacagggtttcaccatgttagccaggatggtcttaatctactgacctcgtgattcacccaccttgccctcccaaaatgcttggattacaggcatgagccaccgtgccaggcctaatttatctttttgagacaggttttagctctgtcactcaggctggagtgcagtggtgcaatcatggctctatgcagccccaacctccagggctcaagtaaccctcccacatcagcctcctgagtatctgggaccacagggatgtgccaccatgcctggcacatttcttagacctctgaaaagatgctcaacaccatatgtcactaggaatattcggtattcaactagaggcttcaatgggctctgaaatatcccctggtaaactctataaatgtgtttccaactggctgaatgaaaacaaaggtttacatctgtgtgagatgaattcacatatcagaaagcattttcactgagaacttttctagttttatagcaggatgttcgttttttcaatattggtctcaacgggctccaaaatgtccctttgtacagtctacaaaatgttttgccaacatactgaatcaaaacaaatgtttagcactgtgagatgaattttcacatcaccaaacatttttacagatagtttgtgtctagtttttaatcacaaaattttgaatttttcactgtaagcctcaaagggctctaaattgtcccctcttagcttctactaaaagagagttttgaacctactgtgtagaaacaaaagtttaactctgtgaaatgaattcccacattgcaaagctatttcacaggtagcttgcttctagtttttatcacgaattatttggcttttcactataggcctcaaatgggctccgaaatgtcccttcatacattctacaaaaagagtgtttccaacttagctgaatcagaggaaagtttaaactgtgtgagatgaaactgcaaattgcaaagcattttcacatatagcttctatagtttctatcagataatattcagtttttcactataggcctctgtggactatgaaatgtcccttcataggttatacaaaaaggtgtttccaacatgctgaatgaaaataaagatttaactttgtgagatgaacccacacatcacaaagcatttttatagatagattttctctagtttttattgcagaatattcaatttcatactataggcctcaatttgctccaaaatttcaccttgtagattctacaaaaagaatatttccaacccgctgaatcaaaaccgatgttcaattctgtgagatgatatgcaaagctttttcacagatatcctgtttctagtttttatcctgtggtgtttggtttttcactataagcatcaatgggctctgaaatgtccctctgtagattctacaaaaagagtgtttccaacctgttgaatcaaaacagttttaactttgtgagatgaagccacacatcacaaagcattttcacccatagcttgtttctaatttttaccatgggttattggtttttcactaaatgcctcaatggactaggaataattgccttgcagattgtacaaccaaggagtttccaacctgcagaagcaaaacacaggtttaactttgtaagatgaatctacacctcgcaaagcatttttacagataggttgctttgagttttcatcaagagatatttgattcttcactgtatgcttcaatgggctatgaaatctccccttacagattctacaaaaaaagtttccaaactgatgaatcaaaagaaaagttcaacttttgagatgaaatcacacatcacaaagtattttcagaaatagcttctttatagtttttatcacaggatattagattttccaatattagggtcaatgagctctgtaatgtccctttgtagattgtacaaaatgagtgtttccaacctatggaataaaaaggaaggtttaactctgtgagataaatccacacatcacaaagcatcttcacagatggcttgtttctaatttttattgtgggatattctgtttttcactaaaggcctcaagcgctccgaaatgtccctttgtagattctataacaagagtgttttaaaactgctgaatcaaaacaaatgtataaccctttgagaggaatccacacatcacaaagcatattttcagatacttgtttctagttattaaagcaagatattcagtttttcagtatatgcctcattgggctcagaaatgtctcatagtagattttgagacatagtagattttgaaacacaaaaatagtgtttcctacctgccgaatcaaaacaacagtttaaacctgtgagatgactccaaacctcgcaaagcattttcacagatagtcgtttcctagtttttatcacaggatactcggtttttcagtataggcatcaatgaactctgaaatgtccactcataggttctataaaagtgtgttcccaactccctgtataaaagcaaaggtttaactctgtgaaatgaatctgcacattggaaagcattttcacaaatagcttgtttctagcttttatgatgagatatttgattttttactattggcctcaatgggctcagaaatgtctctttgcagattctaaagaaaaaaggtttttcatttttctgaataaaaataaaggtttaactctttgctgtgaaatcacacatcacaaagaatttttacaaacagcttgttcctagggtttatcactggatattgggtttttcactataagcttcagtggagacttaattgtaacttaattcacaaaaagagtgtcccccaacctgctgtatgtaaataaaggtttacctctgtgagataaatcttcacatcacaaagcattttccccgatagcttttttctagtttttatctcgggatattgatttttcactataggcttcaatgggttttgaaagtttcctctgtagattctacaaaaagagtgtattaacctgctgaatcaaaacaacgtttaactttttgagataaatccacacatcataaagcattttcacagatagctctttttttttttttttttttttttaagatggagtctcactcagtcacccaggctggagtgcagtggtgtgatctcggttcactgcaagctccgcttcctgggttcatgccattctcctgcctcagcctcccaagtagctgggactacagatgcccgccaccaggccaggctaatttttttgtgtttttagtagagacggggtttcaccatgttagccaagatggtctcgatctcctgacctcatgatccacccgcctcagcatcccaaagtgttaggactacaggcgtgagccaccgcacctggccgatagcttttttaactttttattttgggatattggtttttcactacaggctgatactggcttcaaattgtaccctcatagattctacaaacagtgagtttccaagcatctgaaatgctagatattcggtttttcactgtaggcatcaatttgctctgaaatgtcctattgaagattttaccaaaagagtgtttccatcctgctgaatcaaaagaaggtttaattctgtgtgatgaaattacccatcgtaaatcattttcagagacagcttcatatagtttttatctcagaatattccgtttttcactttaagcctcaatgggctttgaaatgcctcctcataaattgtacaaaaaaaaggagtttccaacatgttgaatcaaaacaaatatttaatgttgtgagataaattcaaatatcgcaaagcatttttacagattttttttctcatttttatcgcggaatattcggtttttcactagtcctcagtgggctcagaaatgccccttgtatgttctacaaaaagaatgtttctaacttgctgaaccaaaacaaaactttaatgctttgaggtgaaaccacacattgcaaacattttcacagatagcttgtttctagttttgatcacggaatattggatgttttacaataggcctcaacgtgctaagaattgtcccctcttagattctactagaagagtgtttccaaaatgctgtataaaaataaaggcttaacactgtgagatgaactgacacatcacaaagcattttcacaggtaggttgtttcaacttttcatcatgtgatattcagtttttcaatatattcctccatgggctctgaaatgtcccttcatagattctatgaaaagactgcatccaactgactgaatcaagacaaaggtataactctgtgagagaaatgcacacatctcaaagcattttcactgatatcttgtttctagtttttatcatgggataatttgtttttgactataggcctcaatgggtttcaaaatgtccctttgtagattctacaaaaagagtgcttccatcctgctcaatcaaagcaaaggtttaattctctgaaatgaatccacacatcacaaatcattttacaatatagcttgtttctagtttttattgtgggatatttgattttttactttagacctcaatgggctctgaaatgtgccttcttagattctacaaagagagtgtttctcacctgctgaatcaaaacaaaggtttaattttgtgagataagtccacacatcaccaagcatttttataaatagcttgtttctaatttttatcatgggatattcagttttttcagtgtaggcctcattggtctctgaaatgtcccctcatagattctacaagtagagtttttgcaacctgatacaccaaaacaaacatttaattctgtgagataaatctataactctacacgtctgaaagcattttcacagatagcttgtttctagtttttatcacaggatatttgatttttcactatagacctcaataggctctgaaatgtcccctcaaaaattctacaaaaagagtgttttcaacctgctgaataaaaacaaagttttaactctgaaaaataataaatcataaaacattttcacagttggcttgtttctagtttttatcacgcgatactcagtttttcatgacagggcacaatgggctccaaaatgtccctttgaacattctacaaaaagagagattttggcctactgaataaaaacaaaggttttatactgtgagaggaatccacacataggaaggaattttcacagatagcttgtttctagttttcaacacaggatgttcaggtttttcatatacttcttgatgggctctgaaatgtcccttcatagactctacaaagacagcatttacaacctgctgaataaaaacaaaggtttaacctgtgagttgaatccacacatcacaaagcattctcatatatagcttgtttctagtttttatcttgagatataacgtttttaactttaggccttaatgttgtctgaaatgtgccattttagtttctacaaatacagtgtttcaacctgctgaattaaaacgagatttaactctctgatatgaattgacacatcacaaactattttcacagatagctttttactagtttttgtcatgggattttaagtttttcactaatggctttcatgtactctgaaatgtccctatgtagattttacaaaaagagtgtttccaacctactgaatcaaaacaagggtttaaatctgtgagatatatccatacattgcaaagcactttcacagattgctagtttctagtttttatcatgagatacttggtttttcactatagacctcaataggctcccaaatgactctcatagattgtacaaaaagagtgttttcaaagtgctgaatcaaaataaagatttaactcagtgaggtgaatccacgcattgcaaaatattttcacagatagcttgtttttttttttgtttgtttgttttgtttttattgtgggatatttcatttttcactacaggcctcaatgggcaccaaaatgtcttctcctagatcctacaaactgactgtttccaacttgcttaatcaaaacaaaggtttaaccctgtgatatgaatacacacatcccaaaggattttcacagatagcttatttctagtttatatctccacttattttgtttttcactgtaggtttcaatgggctttgaaatgtttctttgtagattctgcaaaaagcttttcaaatctgccgaattaaaacagtatttaactctttgagatgaatccacacactgcaaagcattttcacaggtagctttttttctagtttttatcatgggatatttggtctttcactgtagtagtcctcaatggactctgaaatggcccttagtagattctacaaaaaagagtgtttccaacctgctgaatcaagataaatgtttaactctatgaaaggaatccacacaatgcaaagcattttcacagatagcttgtttgtggtttttattgcaggatatttggtgttttaatgtacttgtccatgggctccgaaatgtctcttcatatattctacaaaaatagtgattccaacctgctgaaaaaataacatgtgtttaactctgagagatgattccccaaatcacaagacgttttcacagacagcttgtttctagttttcattgtgggatatttaacttttcactagaggtcttaatgagctttgtaatgtccttttgtacaatctacaaaaagagagtttccagtctgctgaatcaaaacaaaggtttaaacctgtaagatagatccacacattgcaaaacattttcacagacatcttgtttctacttttcattgtagcatacttgctttttccaaatacttctccaggggctccatattgtcccttcgtaaattccacaaaaagagtgtttccaaccagctaaatcaaaacaaaggtttaaatctgtgagttaaatctatgcattgcaaagcattttcacagatagcctgtttctcatttttatcatgggatatttggtttttcaccataggcctcaatgggtactaaaatgtcttctcatagattctaaaaacagactgctttcaacctgcttaatcaaaagaaaggtttaactccatgatatgaatccacacattgcaaagcattttcacagatagcttgtttctagtttttttctccacatattttgtttttcactataggcttcaatgggctttgaaatatttctttgtagattctgcaaaaagagtttttccaccctgtgtatttaaaacactggtttaactctgtggcatgaatccacaatggcaaagcattttcacagatagcttttttcttgtttttttttttttttttttttgggtggggtgggggcgatatttggtctttcactgtaggtctcaatgggctctgaaatggcccttcatagattctacataaagagtttttccaacctgctgaatcaaaacaaatgtttaattctggaagatgaatccacacatcacaaagcattttcagatatagacttttattgtttttattgtgaaatattttgttttttactataggcatcaatgggtgtgaaatgtccattcatatattctataaaaaagtgttttcaacctgctgaataaatgcaaaggtttaaatatgtgagatgcacccacacattgcaaagcattttcaaagacagcttgtttccacttttatcctgagatattttgtgtttcactatgggcctcaatgggcttcaaactgtccctttgtagattctacaaaaagagtgtttccaatctgcttaatcaaaaaaatgattaactctgtgagatgaatccacatatcacaaagaatttttactgatagcttgtttctggatgttatcacgggataatcggttttttatcaacctgctgaatcacaagaaagatttaactctgtgagatgaaatcacacatcacatataactttcagacacagctttttgtagtttttatcacagggcattaagtttttcactacaggcttcaatgggctttgaaatatccttgtgtagattgtacaaagagagtgtatccaacctgctgaatgaaaacaatatttaattctttgagataaatccacacataccaaagcatttttacagataggttgtttccatttttcatcatgagatattggggttttcactataggtttcaatgggctctgaaatgtttcttcatagattctagaaaaggagtgtttcaattcgattgaaatgagtgttctgattctgctgaatcagaaggaagttttaactctgtgagatggatccacacattgcagagctttttcacagataccttacttctggtttttttcatgggatatttggtttttcactataggcctcaatgagctccgaaatgtttttatgtagcatctaaaaaaagagtttttccaaactgatgaattaaaacaaaggtttaaatatgtgacattatttcacatatcacaaagcattttcacagataccttgtttgtagtttttatcacaggatattctgcttctcactataggcctcaagggtttgaaatgtctttccttagatttatgaaaaacatgtttctagcctactgaatgacaaatgtttaactctgtgagatgaatccagacactgccagtcgttttcacagatagctgtttcctagttttgtgtgtgggggatattcgctttttcacaatatgcctcaaaggtctcagaaattcccattagtagattctacaaaaagagtgtttccaacatgctaaataaaaaaaaaactttaactctgtgagaagaatccacacatcacaaaatattttcactgatagcttgtttttagttttcatcgtgtaatatttgttttttgtttttgttttttgatttttgttttttactataggccccaatgagctctgacattttttctttttagattcaacaaacagagtgtttccaacctattgaatcaaaagaaaggtttaaatttgtaagatgaatccacacatcgcaaagcatattcacagatagcaagcttctagtgtttttttttttttctgcaggatattctgtttttcactgtaggcctcaatgggctctgacatgtttgttggtagatactactaaaagactgtttcaaacctgctgaatcaaaataaaagtataactctttgagatgagcccacacatcctaaagcattttacagatagcttacttctagtttttatcacgagatattctgtttttcactatagacctccatgggctccgaaatgtccccttgtagattctacaaaaagaatgtttccaaattgctgaattaaaacaaaggtttaactgtgtgacattatttcacagatcacaaagcattttcacggatagcttgtttctagtttttattgcaggatatttggttttaaactctaggcctcaatgtgcttcaaaatgtctcatcttagattctacaaaaaacatgtttccaacatgctgaatcaaaacaaaaggttggctctgtgagataattccatgtctcacaaagccttttgacagatggcttgcatcaagttttcttcatgggatattccatttttctccataggcatcagtgggctccaaaatgtccctttgtagatactacagtgaaagtgtttctaaactgctgaattaaaacaaggatttagttttgtgagataaatccagacatcacaaagcatttcactgatagtttgtttctagtttttatcacaggatagtcagtttcttactataggcctcaatttgctctgtaatatcccctgttagattctagaaaaggagaatttccagtctgttgaatcacaagaaatgtttaactctgtgagataaaatcacacattggaaagcattttcagacatagcttctttgtagtttttatcgtggtatatttggtgtttcattataggcctcaatggattttgaaattttccctcatagggacacaaaaatgtctttatccttctgaatcaaaacaaagttttaactgaaaaaaaaaaatccacacatagcaaagcatttttaccatatctgccaagaaggaaactcttgttctcccaattttatcagaaggctgcctgattcctataggatgagaagcaggcagcggtgtctggatttgcctggtcatctaggctctgttacatatcatctgcatgttctttttcattgtggaggggatcttttatggatctgttgctagcggggactgcctctctttacagatcttttggctgccaggaatttcaaggagcaaaaagtactttgggtaggctggctgcactccaggttgtgagtagcggtctcactgtgggggactgagatgtttgcagtttgcaggaggcttttgggttctctggcaggaatccttgaacatggctttgactctagcacaggccctctcattctccaagggaagcattgattttccattgctttcatgaggagtccatactactcttcatcagcactcctaaacacactttttttggcttgcaattgcctcaggcggccactgagacgctctctgaactgcatctgcacctgtgaagtcagtccaaagtgtgagacttctgcttcactttgaacttgcctttgtcatggttcctgcctttcccaaagagccatgttgagaagcaggagcccctgtgaggcccaggatgaagggaggcagtgagctcaagggcccggccattttctgctgacatctgcctctggggtctcaggtatgatttcatcacctggacaccccttaacatctcagcagactgtattcccttcccccatgggacccgattcttgcacacagcctctttcgggaatggaatcggaagaacagtttctagctcccacctcagtctccaagtgcctcctcctccagcgggacctgaccatggagacagcccgaagaggcctgcatagagggttcgggggtgagtctttttgaaacttgccccctctgtgatgtctaagtacagcctgcctgtgttccccaggctgctctctcccaggaggggcttcctgcagaaacacacagcctctgaagctgctgggatgtgtgtttctttgggaatgtttcaagttgtggatatctgcgtgtgggtgcagacatgtgagtgtgtgtgtgtgtgtggggggtaagtggagtctgctgaaagaaatgtggctaacgcactgcagcactttgttttttgtcaccccaccttccggtggcctgtctctgtggctctgcttgggctgagggtctccatgttcttcatttttccatggctcctgagtccacagtaaattggaagaatggctgacaaccgccagggtcaaaatcacctccccttgcaaaaaaaccacatttctaaaaagaagagaagcacaccacaccccaaaacagacaactccccgtgctttattgttctgtggccagccctgggccagacccccgcagtccagtcgcagggctttttgaatttacctcgattttggtttgtagctgagcaggtgcttcaggtcatcaggaagcactcctccattgtctcggaattttattctgggatgcagagtgtgagcaacaataaggtcagataggggtgaggatacagtctgttgaggtatggatgggatctcgcaccttcacctcaaaaaaggtgcagacaaatgacacagaagttgcttctaactgcatcccctcattcccttcattgcacagtcaacagcatggcccggtgcccaggtgggatgactcaatcgtgcagagaaaagttggattgtaaactggggcccttcaggccagctccagaattgagctttcattcctggagccacattggagtgagacggattgatgctgggttggatgtggcctccacactggcctcctcttttcctgacttccatgtcccttgtgggcctagagtttcctaggtctggcttagagtttcttccatgttcctcatgaacctggggtttttaagggtctggctcaaagtcttccacacaaaaagtttctcagttcatggaggacgactctaatgggaatcaattgcatcagtgttttcttataaacactgtcatgttttaatgactgggcagttgtgatagttttggaatcgtaaattttgagtatatccacgatcaaggtaactcttgttctcccacttctaaaggacagctgcatgactcctgtaggatgagaaacaggcagctgtgtctggcttttacctggcaatctaggctctgtttcatgtcatctgcacttcctttctcattgtggatggggcttttcattgggctgttggtgggtgggactgcctttcatcgtggatgttttggttgccaggaatatcagagagcaaaaggtattttgggtaggctgcctgcacaccaggttgtgggtagtggtctcatagtggtggctggcattgtttgcactttgcaggaagcttttaagtcctgtggcaggaatccttgaacatggcttggactcctgcgcaagtctgctcattctcccaggaaagccttgatttttctttgctttcatggggggtccacagtgcccatcaatggcactcctggacgttattttcaggtttcaaattgccccagacagcctctgagacactctctcaacctcaagtgcacccgtgagaggcctgttagaggtgtgagaacactgctccaccttgaacttgcttttgtcatggtttctgcctttcccagagagccgtgctgagaagcaggagcccctgtgaggcccgggatgaaggaaggcatggggttcaagggcctggctgttttccactgacaccttcctcttggatctcagatatcccatcacctagagacctcttaacaactcaccagacattattcccatcctcaggagacccaattcatgcacacatccttttttgggaatggagtcaggagagcagtctccagagcccacctcacagtcttcaaactcctccttctcctgtgggaccctaccacagagatggatcataaaggccctatgttcgagactattagcgtgctgcagttggttgctgcaggcagcctttttctggcgactaggccggttctggctgtaccattttcctgagctttggcaggcttacagccctgacagccaggtgcctgagcctgcctggtgaatgcgcatgtgacagccaggtcaccaggcaccagtggtgagcagtggctcacgtcacagtgaatgccaccgttgcctggtgacaagtcccttcatcttggcagagaaggaatcctctgtggatgtgtgtcagtgttggactctcacctgtctactctgagggctctatgggatattcccacaatccttggagtgggcagtggtgagccagcctgaagaaacatcaagtggagccccaggaataaaccacgaaatccctaaggatccaaaaggatacccatgatgagtcaggcctgcctagacggtgtgggggtgagtctttttgaaacttcctccttgtgatttctaggtacagcccacctctgtttcctggagctgctttctctcagaaggggctttctgcagaaccacgcagcctcaggagctgccaggctgtgtgtttctgtggaattgttgcgagtgttcggatgtctgcatgtgtgtgtggctgtgtgtgagtgtgtttgtgtgtgtctgtgtgtgtgtgtaagtggcatctgctaaaaggaatgtgactaacgcaccgcagcactttcttttttttgagtcccttcaccttctggtgcacctgtctgtgtggctctgcttggcctatggggctgcatgttctttgtttttccatggttcctgagtccacagtgagttgggggggggggatggctgagacccacaggtgtacaaatcacctccccatacaaaggagccactcttctagaaaaaagaggagcacatcactgtcaggaacagacacctgtcagggcctcattttcctttggccaacccagagtgggaccctagcagtcctgtctgcaggccccttgaatccaattcaaattcagtttgcagctgagcaggtgcttcacatcatgaagggagcactcctccaacatcttgggatttcattctagaactaagagtgtgagcagcaataaggtcagataggggtgagcatacaatctgctccttcatctgcaaaaaaaggtgcagacagatgacacaggaagtgcttccaactccatccttgcattcccttcattgcacaagctgtccacaacgtggccctgtggccaggtgggaggactccaacttgcagggaataaaaaataaggtttaactgatacaaaaagtttatctctgtaagatgaatccacacatcacaaatcatttgcaaagatagcttctttctagtttttatgccaggatattaggtttttcactgtagtctacaataggctccgaaaagtcccttcatagattctacaaaaaaggtattttcatcctgttgaattaaaacaaaggtttaactctgtgagataaatccacacttcacaaagcattttcacagatagatagtttttagtttttatcgtgaaatatttggtgttttactttagtcctcaatgttcacaaaaatatcttttctgtgtatgctacctaaagagttttgtcaacctactgaatgataataaaggtttaactttgtgagatgaatccacacatcacaaagtattttcactaatagatcattgctggtgtctatcgtgggatattcagcttttcaatatacttgtcagtgggctccaaaatgtccttttgtagattctttaaaaagagtgtttccaatgtgctgaatcaatataaaggtttacctctgtgagatgaatccacacaccaccaagtgttatcaaatattgcttgtttctagtttttatcttgaaatattcattttttcactatcagcctcagtgagctccaaagtatcccttcataggttgtacaaaaagagtgttgccaacctgctgaatcaaaacaaaagtttaagtttgagttcgtgagacaaatccacacatcagaaagcattttcacagatagcttgctgctagttttaatcactggtattaggtttttcagtatatccctcaatgtactttgaaacgtccctttgtagattctattaaaagaatgttttcagcctgctgaatccaaacaaaggtttaactctgtaagatgaacccacatatggcaaagcatttacacagatagcttgtttctagtttttatcagagaatattcaatttttcatggtaggcctcaatgggctctgaaatattcctttgtagattctacaaaaagagctattccaacctactgaatcaaaaaaaattatctctgatagatgaattcacacatcacaaaatattttcacagatattttgtttctagtttttatcacaggatattaggtttttctctataggcctcagtggtctctgaaatgttcctttatagattctacaaaaagagtgtttccaacctactgattcaaaacaaaagtttaactccatgagacgaatccacatatcgcaaagcattttcacagataacttgtttcaagtttttatgatggggtattttgttttccactgcaggcctcaattgacttcaaaatatccctttgaatgttctcaaaaagagcgtttttgacttgctgtaacaaaacaaaggtttaactttgtgagataaatccacacattggaaagtattttcacagatagcttgtttcctgtttttacagcagaatattcaattttacaaatataggtctctatgggctgcaaaaggccgcttcatagattctacaagagttttcccaacttctgaatcaaaacaattttaactctgtcagttgaatccacacagcacaaaggattttcactgatagatttttctagattttatcaaggaatatttggtttttttattatagttctcaataggccctgaaatatcttttaacacatttcacaattagactgtctgcaacctgctgaataaaaacagaggtttaactctgggagatacatccatacatcaaagcattttcacagatagtttatttccagtttttattgtgagacattcgattttttaaaaaaggcctcaatggtctccaaaatatcccttagtagattctccataaatagtgctttcaaactgctaaaccaaagcaaagctttaaccttgtgatatgaatccactcattgcaaagcattttcacataaaactttttctatttttcatcatgggacatttgcatttttactacaggcctcaatgggctccaaagtgtctcttcataggttctacaaaaaaaggtgtctccaacctgccttccatagattttccagaaacagtgttttcaacccgctgaatcaaaacaaagatttaactctgtgtgatgaatccagacatcagaaagcattttcacagatagcttgtttatagttttaatcacaggatattcactttttcactataagcctaaataagctttgaaatatccctttgaagattctataagaagaatgtttccaacctgctgaattgaaacaatggtttacctgtgggagatgaattcacacatcacaaagaattttcacagatatcttgtttctactttttatcatgggatattcagttttccactgtaggcctcactgggctttgtagtattccttcatagattctacaaaatggatgttcccaacttgctgaatcaaaataggtttatctccgtgagataaatccacacatcacaaagcattttcacagataccttgtatctagtttttatcacaggacatttggtttttccctacaggcctcgatgggccctaagtggtcccttcgtagattctacaaaaaggaatgtttccaacctactgaatcaaaacaaagtttaaccctgtaaaacgaatccacacattgcaaagcattttcacagataccttgtttctagtttttatcagaggacattcaactttttctaacaggcctcaatgggatcaaattgtccaatcatagatcctacaaaaagagtgtttccaaactactgaatcaaaaccaagtttaactctgtgaaatgaatccatacatcgccaagcattttcacagatagcttgtttccagtttcaattgtgggatatttggtttatcgctatagtcctcaaagttctctgaaatgccccttcatagattgaacaaaaaagtgtttccaacttgctgagtcaaaataaagtttaaactctgtgatatgaatccacacatggcaaagcattttaacacatatcttgtttctagtttttattgcatgatatttggtttttctgtatagacctcaataggctttaaaatgtctcttcatagattctacaaaagtgtttctaacctgctaaatgaaaacaaattttaactctgaaatgaatgaacacatcacaaaacattttcacagataggttgtttctagtttttatcatggggtattcgggttttcactataggcctcaatatgattttaaatgtccctttctagatgctacaataagagtgtttccaagctacagaattaaaaaaaaaggtttttctctgagagatgaatccacacattgaatagcattttcacagatcgcttgtttctcatttttatcacaggacattcgctttctcactataggcctcaatgggcttcaaaatatttcttcctagatcctaccaaaagagtgtttccaacctgctgaatcaaaaaaatggtttaacactgagatgagtccacagatcacaaatcatcacagatagcttgtttctattttttattgtggaatatttagtttttcattatgtaactcaattggctttgaaatgttcctttgtagatcctaagaaagtagtgtttctaacctgatgaatcaaaacaaaggtttaactctgtgtgatgaatccacacattacaaaggattttcccaaggagcttgtttctagtttttatcatggaatattatgtttttcactataggcctcaataagctctgaaatgtccttttgtagattctacaaaaagagtgtttccaacatgcagaattcaaacaaagggttaactctgtaaaatgaattcaaacatcacaaaacatttttatggatagcttgtttctagttctaatcacaggatattcaacatttcactataggcctcaatggtctccaaaatgtttcttcatagattttttacaaaaagagagtttccagactgctgtgcaatacaaaggtttaactctgtgagatgaatcctcacattgcaaagcatattcacagatagcttatttctgtttttatcacgggatctttgatttttcagtataggcctcaatgggcttagaaatgtcacattgtagattctacaaaacagtgtttccaacatgctgaatcaaaacaaaggtttaactttgtaaaatgaatgaacacatcacaaagcattttcacaaatagcttgtttctagtttttaattgcaggatatttggttttcctctgtacgcctcaatgggatctgaaatgtctctttgaagatggtaccaaaagagtggttccaacctgctgaaacaaaaaaaaaaggttgaactctgttacatgaatccacaattgcaaagcattttcacatacaacttgtttctagtttttaccatgggatatttggttttccactgtaggcctcaatgggctctgaaatgtcccttcacaggttctacaaaaagagtgtttctaacctgttgataaaaaaaagatttatctctttcagataagtctacacgtcaaaaagcattttcacaggtagcttgtttccagtttttatcatgtgacattttgtttttcactatagacctcaaagggatcagaaatgtctcttttacattccactaaaagagtgtttcaaacctgcagtacaaaaaaaaaggtttaactctgtgaggtaaatccacataatgcaaagcattttcacatataacttgtttctagtttttatcctgggatattctgtttttgtccctaggcctcaatgggctttgaaacatccctttgtggataatgcaaaaagagtgtttccaccttgctgaataaaaaaaaaaaaaagtttaagtctttgagatgaatcaatacatggcaaatctaattcacagatagcttgtttctagtttttttgagggttgttcatttttcactataggcatcaatgggatctgaaatgtcccttcggagattctacaaaaagagtgtttccaagctgctgaattgaaacaaagttttaacttttgaagatagaaccacacatcacaatgcattttcacaaatagctggtttctagtttttatcatgggatattggttttcactacatgccaaaatgggctccaaattgacctctcatagattctacaagcagagagtttccaaactgctgacgcaatacaaaggtttaactttgtaagataaatctacaaattgcaaagcatttttacagatactttgtttctagcttttatcacagtatattctgtttttcactacaggcctcaatttgctctgaaatgtcctgccgtatattctacaataagaatgtttccaacctcctgaataaaaagaaagatttaactctatgagatgaaatcatgcatctcaaagcatttttagagatagcttctttatagtttttattaggattttaggtttttcactatcagcctcaatgggctttgaaatatctcctcatcaattgtacaaaaagagagtttccaacctgctgaatcaaaagaaaggtttaatattgtgaaacaaatccacaaattgcaaagcgtttttacagattacttgtttctagtttttatcacgggatatttggtttttcactataggcctcagggggataagaaatgtcccctcgttgattctgcaaaatgaatgtttccaacctgctaagattccaacctgctgaatcaaaactaacattcaactctgtgagatgaatccacacattgcaaagcattttcgcagatagctagtttctagtttttatcatgggatattcagttttttactacaggcctcattgggtttgaaatgtccccttgcagattctagaaaaatagtgtctcccacctgctaagtcaaaataaaggttaaactctgtgagatgaaaccacacattgccaaacatttttacagatagcttgttctagtttttatcatggcatatgtggtttttcactataggcctcaatgagctcaaaattgtcccttcctttattctacaaaaggaatgtttccaacctgcccagtcaaaacaaggtgtaactctgtgagatgaatctacacattgcaaaacattttcacacatagcttgtttctagtttttatcctgggatatttggtttttagtacaggtctctatgggctccgaaatgtcccttcatagatattacaaaaagagtattttcaaccttctgaactaaaacaagggtttaactctgcaagatgaatccacacatctcaaagcattttcacagataatttgttgtcagtttttatgagggatttttttttataataggcctcaaggactcagaaatttcttattttagattctactaaaacagtgttctcaacctgctgtatacaaacataggtataactctgtgagataaaaccacacatcacaaacattttcacagatagcttgtttctagcttttatcacaagatattcagtttttttcactacaggcctcaatgggctctgaaatgttccttcatagattctacaaaagagtgtttgaaacctgcagaatcaaaataaaagtttaactctgtgagatgaatccacacatcacagagcatttttgctaataatttgtttctagtttctatggtgggatattttgtttatcaatataatcacacatgggcttcaaaatgtcccctcatagagtcttaaaaaagactatttccaatctgctaagtcaaaacatatgtttaactctgagggataacccacatatcacaaagcattttcacagatagattgtttctagtttgtatcgtggaatattgggtttttgactatgggcttcaatggactctaaaccatcctctcttaaattctacaaaaagagtgtttccaacctgctgtatataaacaagagtttaactctgtgagatgaattcagactcaaagcatttttatggatagcttgtttctgtttccattgtgaaatatttcatttttcactataagccttaatgggctccaaaatatcccttcgtaaattctaaaaaaagagtgtttcacaactgcagaatcaaaacaaaggtttaactctgtgagacgaatccacccattccaaagcatttttactaataattcgttgctagtttctataatgggaaattcagcttatcaatgtactcgtccatgggcttcaaaatcgccattcatagactctttaaaaagagtgtttccaatgtgctgaatcaaaacaaatgtttaaatctgagagatgatttgcatattgcaaagcatttcacagatagcttgattctagtttttatcagggaatattcagtttttcaccataagcctcaatggtctttgaaatgtcccttcttagattctactaaaagtgtgtttccaacctgttgaatagaaacaaaaatttaactatatgagatgattctatatgtcacaaagcattttaccacatagcttgtttctagtttttattgtgggatattgtttttcactgctggccccaaagggctctgaaatgtccctttgtatattcctcaaagtgagtgattccaaactgctgaagttaaaaaaaaaaaaagtttgttgtgcttttttttgttgttttttttgagatggagtctctctctgtcacccaggctggagtgcagcagcgtgatctcggctcactgcaagctccacctcctgggtccatgccattctcctgcctcagcctcccgtgtagctgggactataggcgccggccaccaggcctggctaattttttgtatttttagtagagacagggtttcaccgtgttagccaggatagtctcgatcacctgacttcatgatctgcctgccttggcctcccaaagtgctgggactacaggcatgagccactgcacccagcaaaataaggttttactatgtgagatgaatccacacatcacacagcattttcagaagtaaatttttaattgtttttatcatgaaatattcgttttttttactatagactttcataggtatgaaatgtcgtgtgttctagaaaaaaaggattcccaacctgctgaataaacacaagggtttaactttgtgagatcaatccacacattgcaaagaatttttactgatagcttttctctagtttttatcacgggataatcagtttttcagtacaggtctcaatttgctttgaaatgtcctctagtacattgtagaaaaagagtgtttccaacctgctgaatgacaagatagtttaaactgtgtgagataaaattacatattgcaaagcatgttcagacatagcttctttgtagtttttgtgttttttttcccccgtgggacatttggtttttcactgtatgcctcaatgggctctgaaacgccccctcatagattgtacaaaaagattgtattaaacatgcagaatcaaaagaaaggtataactctgtgagataaatccacacatagcagagcattttcacagataggttgtttctagtttttatcatggaatattctgtttttcactacatgccttaacgggcttcaaaatgttgcttcatagattctataaaataagagtttacagcctgctgaatcagaatgaaggtttaactctggaggtgaatctgcacattgtaaagcattttcacagagagctttcttctttcttttttagtgaggaatatttggttattcattgttggcctcaatgggctccaaaatgtcctatcatagattccacaaaattaatgtttctgacctacttaagcaaaaaaaaagtcttaactctgtgacatgaatccacacatcacaaagcattttcacaagtagcttgtttgtagtttttatcacgggatatttggttttacactatagacttcaatgggcttcaaaatgtcttttcttagattttacaaaaaagtgtttcctacctggaatcaaagcaaaagtttatctctgcgaggtgaattgacacattgcaaagtattttcacaaatagcttatttctagtttttatcatgaaaaatttgattttttactattggcttcaatgggccctgaaatgtccctttgtagattctacaaagagagtttttccaacctgctgaatcaaaacaaaagtttaactctatgagatgaatccacacattgcaaagcatttttagagattgctttttcattgttttcatcgcgaaacattcgttttttactgtaggcgtcaattcgtgtgaaatgtcccattgcatattctacaaaaaaagtgtaccaaacttgctgaataaaaacaaaggtttaactttgtgagatgaatccacacattgcaaagcattttcacagatagcttgttactagtttctatcttgcaatatttgttttttaaatataggcctccatgggctccaaaatgtccctttgtagattctacaaactgagtgtttacaacctgctgaaccaaaacaagggttcaactctgtgagatgaatccatatatcacaaagcatttttacagatagtttgttttcagtttttattgggggatattttgtttttcattataggcctcaaaggtctcagaaatatcttcttttagattctactaagagagtgttagcaaactgctgtatataaacataggtttaagtctttgaggtaaatacacacattgcaaacattttcagatatagcttatttctagattttgtcacaagatatttggtttttcactagaggcgtcaatgggttcagaaatgttccctcatagattatacaaaaagtgtgtctccagtctgctgaatcaaaaaaaaaaaaaaggtttagctctgtgagataaatccacacattgcaagctaatgcataatgcagagatagtttttttctagttttatcacaggatattggtttttcactataggcctcaatgggctcagaaacgttcctttgttgattctacaaaaaatgtgtttccaaccaactgaatcaaaacaaaagtttaactctgcaagatcaactcacacatcacaaagcattttcacagatagcttgtttctagtttttatcaagagatactcgatttttttttattgtagacttcagtgtgctctgaaatgtcctttcatagattctacaaaaacagtgttttcaacctgctgaattaaaatgaaagttaaactctgtaagatgaaatcatacatcaaaaagcattttcacaaatagattgtttctggtttttattgtgggatatttggtttttcaatataagcatcaatgggcttcgaaatgttccttcttaaattttacaaagagactgttttcaacttcctgaataaaaacagtggataaatctgtgagatgaatccacacattacaaagcattttcacaggtaattattttttagtttttctcatggaatattgtgtttttcaatataggcttcaatggactctaaaatgtcctctcttaaattttacagaaacagtgtttgcaatgtgctgtatataaacaaaagttttcctctgtgagataaatctacacacacaaagcattttcacagataccttgtttctagttttcatcataaaatatttgatttttcactataggcctcagtgggctccaaaatgtcccttcatagattctacaaaaaaagtatttccatccttctgaatcaaaactaaggttttactctctgtgatgaatttacacattgcaaagcattttcatagatagcttgtttctagtttttattgtgggatatttggttttttattataggcctaaaagggctcagaaatttcttcttttagattctactaaaagagtgtttccaaattgcactataaaaaccaagtttacttctgtgcaataaatcaacatatcacaaagaatattcacagatagcttgtttctagtttttatcacaggatattgtgtttttcactaaagcctcaatgggctttgaaatgtccctctgtagattttataaaaagagtgtttttaacctgctgaatcaaaacaacgtttaactttttgagatgaatccacacattgcaaagcgttttcacagatagattgtttctagtttttattgcaggatattgttttttcactcaggccaatatgggcttcgaattatcccctcgtagattagattatacaaacatcgagtttccaagatgctgaagcaaaacaaaggcttaactttgtaagatgaatctacatattgcaaagcatattttacagatagcttgtttctagtttttattgctggatatttggtttttcactgtaggcttcaatttactctgaaatatcctatcaaatattctacaaaaagagggtttccaacctactgaaccaaaaaaaaaagtttaattctgtgagactaaatcacacatcgcaaagcattttcagagacagctttataaagatttattgcaggatatttggtttgtcgctataagcctcaatgttccttgaaatgtctcttcatcgattgtgcaaaaacagtttccaactttttactgtaggcctcagtgggctcagaaatgactctcaaagattctacaaaaagaatacttctaacctgctgaatcaaaacaaaagtttaactctttggggcaaatccatatatcaggaagccttttcacagatagcttctttcaagattttatcgtgaaatattcgtttttttctatagacctcactgggctcagaattgacccctcttagattctactaaaagagtgtttccaaaatgctgtataaaaataaagttttaactctgtatgatgaatctacacatcacaaagcattttcagatatagctcgcttctagtttttatcacgggatattctgtttttcactataggcctcaaagggctccaaaatgtccctttgtagattctgcaaaatgagggtttttaacctgctgaacataaacagaggtttacctctgtgagataaatccacacatcacaaaacatgttcaaaggtagttttttatctagtttttatcacatgatattcagtttttcactataggcctaatgggctctgaaatttccctttttagattctacagagtgtttacaacctgctgaatcaaaacaaggttttaactatgtgagatgaatccatacatctaaagcgttttcacaaattgtttgtttttatagggggatagtcagttttttactacaggccacaaaaagctcagaaatgtcttcttttagattctaccagaagagtgtttccaacctgctgtatataaatataggtttagctctgtgaaataaatccacacattgcaaacattttcacagatagcttgtttctagtttttatcacgggatatttggtttttcaccataagcctcaataggctcctaaatgtccctttgtagattctacaaaatgtttccaacttgctcgattaaaaaaaaaaaaggtttaactctgtgagatgtatccacacatcaaaaatctttttcacagatagagtatttctagtttttattgtgtgatattctgtttttcattaaaggtctcattgagctccaaaaaatccctatgtagattctacaaaaagagtgtttccagactgctgaatcaaaacaaaggtttaattctaagagatcattccaaacattgcaagacacttttacaaataggttgtttctaggttttatcatgggatatttaattttttaatataggcctcaatgggctccaaaatgtacctttgtagattctacaaaaagagtgttttcaactggctgaatccaaacaaaggtttaacactgtgagagaaatgcacacatcgcaaagtattttaattggtagcttgtttctagctttatttcaggataatcagtttttgactacaggcctcaatgggcttcaaaatgtcccctcttatattctacaaaaagagtgctttaaacctgcttaatcaaagcaaaggtttaattctgtgagatgaatccaaacattgcaaagcattttcacttatatcttatttctagtatttaatgcaggatattttgtttctcactatagacctcaataagctctgaaatgtcccctcatagattctacaaaaagagttctttcaacctgctgaataaaaacaaaggtttaactctgtaaaatgaaatgacacgttgtaaagcattttcacagatagcttggttctaatttttgtcgtgggatattcagtttttcaccacaggccacagtgggctccaaaatatccatttgtagactctacaaaaggaattattttggcctcttgaatcaaaacaaaggtttaactctgacagatgaatccatacattgcaaagaattttcacagacagctttttctagttatcatcacaggacattctgttttttcatacacttcttcatgggctctgaaatgtcccttagtagattctacaaaaagagtgttttcaacatgctgaatcaaaatgaatgcttaactctgtgagttgaatccacacatcacaaagcattctcttatatggctggtttctggtttttatctcgagatataaggtttttaaatgtaggcctcaacgttctctgaaatgtgtcctcttagattctacaaaaacagtgtttccaacctgctgaatcaaaacaaagttttaactccatgagatgaattgacacatcacaaagcattttcacagataacttttctagtttttgtcaagtgatattcggtttttcactagtggcctttgtggtctccaaaatgtcccttcatagagtctacaaaaagaatatttccaactggctgaatgaaaacaaaagttcatacatgtgagatacatccacatattgcaaagcattttcacaaataacttgttcctagtttttatcatgggaaatttggtttttcactatagacctcaataggctccaaaatgtccccttgtagattgcacaaaaagtgttttcaacatgctaaatcaaaacaaaggttttaatctgtgatatgaatccatacatcacaaagcatttccatacatcacaaagcatttccacaatcaaaacaaaggtttaactctgtgagatgaatccacatgctgcaaagtatttttgcagatagcttttttctattttatgtcatgggatatttggcttttcgctgtgctggtccgtgagctccaaaatgtccctttgtagattctacaaaaagagtctttaatctgctcaatcaaaacaaatgtttaactctgagagatgaatacacccatcacatatcattttcaccgatagcttgtttctagttttatcacaggatattcagtttttcactgtaggcctcaattggctacaaaatttcccttcgtagattctacaaaaagtgtgattctggcctgctaaatcaaaacaaaggtttaactctgtgagatgaatcctcacattgcaaagcattttcgcagatagcttgtttctagtttttgtcacacgacatttggtttttcactatatatctcaattttctccaaaatgtcccctcatagagtctataaaaagagtgtttccaattttctgaatcatgataaaggattaactctgtgagatgaatatacacatggcaaagaatttttacagatagattgtttctagtttttttgttgggatatttggattttcactgtaggcctcaatggcctctgaaacgtccccacctagatggtacaaaaggactgcatccaatgtgctgaataaaaataaaggtttatctctatcagaagaatccaaacattaaaaagcattttcacagatagcttgtttctagcttttatcatgggatattcagtttttcactaatggccctaatgggctctgaaatgtcccttcttagatcctccaaagacagtgtttccaacatgcttaatcaaaacaaaggtttaattctttgagatggatccagacatcacaaagcattttcagagatagattttttattgtttttatcacaaaatattcatttttttactataggcatcaatgggtgtgaaatgtccttttgtatattctataaaaaagtgtctttaacctgctaaataaatacaaggtttaattctgtgagataaatccacacattgcaaaacatttaaaaagatagctcgtttttactttttattgcagtatatttggtatttcactatgggcctcaatgggcttcaaaatgttactttgtagattttacaaaaagagagtttccaacctgctgaatcaagacaaaggattaactctgttagatgaattcacacattgcaaagaatttttactgatagcttgtttctggtgtttatcgtgggataatcagttgttcatcaacctgctgaatcacaagaaagtgtaactctgtgagatgaaatcacactttgcaaataattttcagaaacagctactttgtagtttttatcatgggaaattcaaattttcactgttagtctcaatgggctttgaaatgtcattttgtagattgtacaaaaagagtgtatccaatctgctgaatcaaaacaaaggtttaattctgtgagataaatccacacattgcaaagcatattcacagctaggttgcttttagtttttattgtgggatattggggttttcactataggcctcaatgggccctgaaatgtttcttcgtagattctacataaaaagtgttttaaacctgctgaatcagaagaaaggtttaactctgtgagatgaataaacacattgcaaagcatttttacagatagcctgcctccagtttttgccatgggatatttggtttttccatataggctgcaatggactccaaaatattactttgtagactctgcaaactgctgaattaaaacaaaggtttaactctgtgaaattgaatccacacatcacaaagcattttcacagatagtttacttcggtttcttactgtaggcctcagaggtttgaaatgtcttttctttgtttctacgaaaagtgtgtttccaacctgtggaatcatagtaaatgttaaactctgtgaaatgaattccagacattgccaagcattttcacagatagctggattctagtttttattgagggatattcgtttttttactatagacctcaaagggctcagaaatgcccatttgtagattttacaaaaagagtgtttcaaatttcctgaatcaaaacaaaggcttaactctatgagatgaatctacacatctcaaagcattttcacagagagcttgtttctactttttattatatatattatatatatttatacttggtttctcactgtaggcctcaatgggctccaaaatgtttcttcgttgactctacagaaacatggtttccactctgctaaatcagaaaaaaggtttaactctgtgagctaaatccacacatcactaagcattttcacaggtgccttgcttctagtttttattacaggatattttgtttttcaccctaagtctaaatgggctccaaaatgtcccttcttagattctacaaatacattgtttccaacctgctgaatcaaaacaaaggtttaactttgtaaggtgaatccacacatggcaatgcattttcagagttagattttttattgcttctatcatgaaatatttggttcattactataggtgtcaatggctgttaaatgtcccttcatataacctataaaacaagtgttcataattggctgaataaatacaaagttttaactctgtgagatgaaatcatacattgcaaagcattttcagacatagtttctttttagtttttatcgacgaacattcattttttcactataggcctcaatgggctcagaaatgtaccttcacagattgtacaaagtgtatccacttgtggaatcaaagcaaaggtttagttctgtcagataaatcctaacatcacaaagccttttcacagatagtttgcttgtaatttttatcgtcggatattctgtattttactgtaggcctcaatgggctctgaaatgttttctcctagattctacgaaaaaaagtgtttccaactctgtaagatgcatctcacattacaaagcattttcacagaaaacttgcttctagtttttgctgcaaatattcagtttttcactataggcctcaatgggctctgaagtgtccctttgttgattctacaaaaagactgtttatgaagtgctgaattaaaacaaaggtttaaccctgtgaggtgaatccgcacatcacaaagcattttcacaggaagcttgtttgtactttttatcgtgggatatttggtttttcactataggcctcattgggcttcaaaaagtattttattagattctatgaaaaacatgtttccaacctgctaaatggaaacaaaggtttcactctgtgagataaatacacacattgcaaagcattttcacagatagctttttttctagtttttatcatgggataatcgatttttcactataggcctcaatgggctttgaaaaggccctttgtagattctacaattaaagtgttttcaacctgttgaaacaaaacaaaggtttaactctatgagataaatccacacattacaaagcttttcactgattgataggttttttctaggttctatcgtgggatatatagtttttctttttctttttcttttttttttcaggggacggagttttgctcttgttgcccaggctggtgtgcaatggtgctatctctggctcactgcaagctcctcctccccagttcaagccattctcctgcctcagcctcccgagtagctgggattacaggcatgtgccaccacacccggctaattttgtatttttagcagagatggggtttttccacattggtcagggtggtcttgaactcccaacctcaggtgatccgccctcctaggcctcccaaagtgctgggattacaggcatgagccaccatgcatggcgggatatagagtttttcactgaatgcctcaatgggcttcaaaatgtcccttcattgattctacaaaaagagtgtttccaacgtgctaaatcaaaacaaacaaacaaacaaaaaaaactttaactctctgagatgaatccacacatcacaaagcattttcactgatagcttgtttctagtttgtactgggaatatttggtttttcactatagaactcaatgggctccaaaattttcttttgtagattgtaaaaaaggagtgtttccaacttattgaagcaaaagaaagatttcactctgtgagattagcccacatatcgtaaagcattttcacagatagcttgcttctagtttttaccaccagatattctgtttttcactctaggcctccatgggctccaaagtgtccccttgtagattctacagaaagagtgtttccaaactgctgaattgaaacaaatgtttgactgtgtgacataattttacacatcccaaagcattttcatggatagcttgtttgtagtttttattgcaggatattcagtttttcactatagacctcaatgtgttttgaaatgtcccttcttagaatctacaaaaaatgtgcttccaaatagctgaatcaaaacaaggttttaactctgtgagataaatcaacatgcagtaaagccatttgacagatagctttcattaagtttttattgtgggatattctgcttttctctataggcaccaatgggctttgaaacgtcccttcataggttctacaaaaaaaaaagtgtttacaggctgctgaatcaaaacaaagatttagctttgtgtgattaatccagatatcacaaagcatctcactgatagtttgtttctagtttttatcgcaggataatttgttttccactatagtctcaattggcttctgaatcaccctggtagattctagaaaaagagtgcttccaaacagctgaatcacaagaaaggtttaacactgtgaaatgaaaccacaaatcggaaagcattttcagtgatggcttctttgtagtttttatcacgggatattcggtgttacactataggcctcaaagaattttaaatgtcccttcattgattgtacaaaaagagtgtatccatccttctgaatcaaaacaagcgtttaactctgtataacaaatccacacaccctaaagaattttcaccttatcccccagcaaggaaactcttgttctcccagcttctatcggagggctgcatgattcctgtaggatgagaaacaggcagccatgtctggcttttacctggtaatctaggctgtttcctttcatctgcccatcctctctcattgtagagggggtctttcactgggctgttgctgggtgggactgcctctcactggggatcttttgtctgtcacggatttcagagagcaaaagggatttcaggtaggctggctgcgctccaagttgtggatagcgatctcattgagggggttgggttagtttgcactttgcaggagacttttgggtcttctgacaggaatccttgaacatggcttggactccagcacaaatccgcttgttctcccaggcaagcgttgatttttctttgctttcatggtgggtccacagtgcccctcaacagcactcctagacaccattttcaggcttgcaattgccctaaacggcctctgagacaccctctcaacgtcatctgcacccgtgagatgctagttcgaggtttgagaacactgcctcacctcggacttgcctttgtcatggttcctgccttctagagtgccctgctgagaagcaggagcccctgcaaggcccagaatgaagggacgtagtgagctcaagggcccggccatcttccactgacccccgcctctggggtctcaggtatgattccatcacgtggacacccgtcaacaactcaccggactgtattttcattcccatgcgaccggattcttgcacacagcctctttctggaacagagtcagaagagcaatttccagcacccacctcacagtttcgaaacgcctcctcctccagcgggacccgacctcagagacgtgccgaggaggccttattgtcgagacatttagggtcccgcagtgggttgtcgcgggcagcattttcccgagaccaggtgcgctctgcctgcaccattttcctctgcttaggtaggctgacagcactgacaacccggcgcccaagactgcttcacgaatgcgaatgcgtcagtctctaggcaccaggcgccagtggtgagcaatggctcgcgtcacagtggccaccgttgcctggagacaactccctgcggcttggtggaggagacctctgtggacatgcattggtgttggactctcgcctgtgctctctgggggatccacgggatagtcccccgattctaggaactggcagggggaagcaagcctaaagaaacatctagtgaagcttcaggtataaatcgcgtaatttctaaggatccaaaaggaactgcaggatgcgccaagcatgcctagtggtctccttgaggggtctggggtggtttgcagtttgcgggaggcatctgggtcctctagctggaatccttgaacgtggcttggagtcaagcacaagtccgctcgttctcccaggcgggccttgatttttctttgattttatgggggttccacagtgccaatgaacagaacttgtggacacccttttcaggcttgcaattgccccagtgggcctctgagacactctctcaaccttatctgaacccgtgagaggccagttcgaagtgtgagaacactgctccaccttggagttgcctttgtcttggttcctgccttctcagagagccgtgctgagaacaggagtccctgcgaggcccgggatgaagatcttctctctggatccggaagaatcataatatttatcaactctgtaaactctcgggaaagcacttgtgctagcaaggtaacctggcctttgtgaattcatgcactagtctccatttctgggaagagcttcagcaccagcagcacataccactgtgagggcaagtgaaaaagtatcactttgggtagatggatataatcctcccgtaaagcttcatttgcaagaaaaccactatcacccttttccacctgtggaataaagatccttcttacatgtccaagatcacctgtgtttaacatatttatgttggctccccagtcatctccgtcttgttcacaggcagtatttgggattgagattcgagatgtaaaagtaatactagattttgtatccctgtgacccaaagacattgaatgaatatacctcaagccctggctaccttgcaaaaggagagccttcaactctgcttctttaaagtaatttatgattctgcagttttcattcacttcagtatcagctaaatttccaccatgacaatattcatcctgtgtaagcataggaccatcttctgcccagacagagaaatacggaactgcatgaggaagccgtccaggcactgcagtagagcctgtgctcctctcagagttctttgctcactgcagagtcggcttaaggctttcctgatcacctaatgtggtgcatgcacccatgctgcctcttcacacagtaaacacagaaccaaaacctccagagcaactttctgcagctcctgaaactgctgtgcgccttaacctcgctttgctctcagtcactgcagttctctcagcaggccacgtttcatctcccagctcctgagcactggcttccatgtcttcactacaacaatcatccccatacccccaacagaatccggagtgaaagaatccggagtgaaaggatccgaattcacttgaagtctgttgcacatccaattcccatttcctgatttttctgtatcacgaagaagaacggtcccagagtttaacagggctgggatcaattcttccagctctggagagaaaaaccgggagtgcaagtggcgggtggcagaggcgaagcttgcaggagatccactgggacccccgggatccctcagcgcccagcagggccctccccgcccgggcccccacagtcctgcgaagcctccccccagtgcccccagcactcgccagaaccagtagcccaggaagcaggtgccgctggccaccaggagcccaagtaccctccccgcaccagtcacacagagacccgctgccaggccggtcagcgcagggcagggccccagaagctcctcaggctccagctccaggggctgctgggcctggcgggcaaggttccgctcacccccagaaaaggagacggagacccacaaggacctcagcttgtctggtgctggaggcctgggctgtcagaatgcctctccgccttccggcaggcgggagccgcatgcgccccctagtggccgcggccagaagctgtcacatcccatgggcgcaggcgcctcagccccgcaaggggcgggctggaggtgccactcccattcatagaccaggaatcagagccctgggctggaagagtctggtcaaaattcttccaaactgagtggggacagagaccaactcacccccagctgcagtgtatgcagtgtagacagatctggactttagccattcctgagcccccccttgcctcacccgtacatgcccggcccacctttcccttcctcgccaggaccccacatccctccctctgagtcgcttcctctctgaaacaaatagtggtgatagcgagtaacacatcagtaacaagaaactagcaggtgctcagtaaaatggtctaccctggcctcttccacagtcaagtgagcattaacaggaaaatgctcattggaagtggagagtcgccggcagcccctccgcctccctccggcttggccttcccgcagagcaaactggggcccagaaagggtgtgggcgaagaccctgtcacctcccagcagggggcgtgctgcccgcggttttcgggatcctgggcgtggagccatcctcacaggaccctcagaggtggagaggagaaagagcacactcatttgacaggtgcagagactgaggtccgtggggcaggggtgagcggcccagggcagccagacctgtgaacagtagagctaggattccagcaggtccccagccagtcactgggtgagcccctgttgtgtggggatcactgaggtgcaggcattctgataaccaccggcttgaggaactcatggtgctccatcctgaattctggggcgctttctaggatacaatatggtaaaggttgtgtaacatgtgtgaggtccagcatgtgcacgaagcaaacagggatagattggggtggtagtacagggacagaatcacagttgggacccttgagaaggcagttggaatttttctgccagagcaggagaaaccctctgggcacccaggctggcatgtgcaaaggcgtagaggcaagctccccctgacacacggctggaggggaagctctaagtgctgcgcacaggctgttcacactgcatccttctccctggacttgctccccccacagcacctccatccttccagttagctatccaggccaccaccctcaccctctcacacccacatcctgtgggccccacatttgagagacaagaattcagttgcttctcaccctccatgggtgctcatcacctggtctgagtccccatcctctctctccccatacttggtctctgcttccatccttgactcctgacgtctaattgcaactcaatactaggtcagatcatgtcacacttctgctctggtgcaagaattatgtggttccttcagttcagtgtccaccaggatttgatattcccaaggcacatctctcactcctttgttctcattttaccttcacacaggaaaacactttttcttcttgaagtgtgctgttatgtagctactcttggcgatgaaatctctgttattacttttgaaattattttaattgtctttatgccctaaagatatttagctatatattcaatgctagcttgaataataatttttctaagcatgcgttttgactttttaaaatttaagatgacattagatgattttattatgtacatcatgatgttttgaacattccacatatagattgttgaatggttaaatctaactattaacaaatgcattatctaagatcgttatcatttttgttgtgagaacacttatcatccactatcgttgcaattttctagaatgcaatatatcatcagtaactgtagccaccttgctatacaatagaattattgaaatttgtttttttctatccagttttaattatgtgccctctgaccaacatctccccatcctgttcccctctctaaccactccagcctctgctcatcgccattctgctctctacttctatgagaccaactagtttagatccctcatatgaatgagataatgcagtatttttctttctgcacttggattatttcacttaatatactgtcctccaggatcatccatgttgacagtaatgacagcattttattctgttgtatgactaactaaatatcattccattgtatctgtttatgtaatacatacataaatgtatgtatacaagcatatgtagatataccattcttcaaatatattattttgcatttatttttattaaaagtatatttctcccttatctaaatgctgataaaaatatgaggtattttcagtccttcctcttaataaaagccaaagttaaaggtctgtttccctgttttttaataagattctatttcttgctgatttttttgagttccctgcacattctgcatattactgcttaatcgtaagcatggtttggattttttttttcctttctgtataatgtctgtttcctctgtggtttatttgttttctttgccaaaactttttattagtttaattcggtcccatttatttatttttgtttttgttgcatttgcttttggggtatttgtcataaattatttatctaggccaacgtctggaagagtttttactaggcttttcttctagaattgttatggtttcaggtcttagatttaagtctctaatccacctggagttcatgtttggatatggtgagagatacaaacacagtttcattcttctacatctggccacccaattttcccagcaccttttattatgtatgtgtatgtttttgtctaatttgtcaaaggttgttattgtttggctgtatttgttagattctctattctgttacattgttgtatgtgtttatttttataccagcacaatgctgttttggttactgtatccttgtagaataaattgaagtcaaaggaaagacaaaggaaagttgttgtctttcctttattttgaaggagagttttagcaaatataagtgttcttaattagaattttttctttcaatactttgaatatgttatcccctttggccctggcctgaaagaagaatttgagaattgcgctgatagttatgtgatgagtagattttctcttgctgcttttaaaattcactttttctctttgacttttgacaactttattaaaatatgtcttggtgtaaggttcttcatgttcaatctacttaaggactcttgaacttcatgattctggatgtccacctcccacctcaaattcagcaaattctcagtcagtatttctcaaaataagctttctattctttcctctatttcaccttcttgtatccacataacgcatatattgctttatttgatgatgtttcataagtctcatagattttttttactctttatcttttgctatttttttttttgttttttgcacctctgtcaggataatttcaagatagctgtttcccactttgccatttcctcttcatgactgaacctgctgttaaaactctctattaaatttttcagtttagtcattatattcttcagcattaacatttctgtgtttatttttatcgcttctatttattactgtaacttctgattttctttatgtattgctttcctaattttgtttagttgtctatacttgttcccatatagttcactgagcttagtatctaaaataattacttccaatttttaaaagcacattgtcaattcctatttctttggggtctgctattgaagcttttttgctttacttaaattgtgtgatattttcctgattcttcatgattattgtggccttgtgctggtatacatatttttgagaaggtggtcactttttctagtctttacaggttggcttcagcaggaaaagttcttcaccattaagtgtggcctggtgttcttgttcggtcaggtggttgagcctgttgatggatttggctgactggcggtgcttcagggtcagaaatgtctgctggttttaatccctctgatttggtagctttgttgggtgaggccacttgaagcactgtggggcacattgagatttgcatgtaccagtcactgagtgtttcaccccatttctttggtgctagttatcttcatgtggtctaagtattaaaattcttccagcgtttgttttgaggcaaagcagaagtttgtccatcaggcagcactccccagatagacattgaatatccactttgatctacttttctcccactggaaaaataatgggctgagggtatacttctcagcacagtattgttctggatatggaagtggtaaagcaaacaaagtaaaatcattcctcttatcctttttaatgagtctgtctttgcttttgagctctttttgggttttgcaatctcacagtggtatttggagttctcacaaaagcattctttcctgtgggtagttgccaaatagatgtctctttgagggaaacagggctgggaacctactattccaccatcttaccagactccctctacatccaaccacttccatctctcaatctctcagtaatttgtaaaataggaaaatacaaacatgtctagaaatcattactaaaactaacagatgagttgagtgaagccacagtatataagccaaatgtgtaaaaaagtcaatgtgtatttttatagactggcagtgaaaatcaaaccttaccctgaaaaacctgaaggaaataccgaggaaaattaaagaatacctacataaatagagctatcatgttcacatgtcagaatattcaatataattaatatgtaaattttccccaaattaatacgcagcatcaacacaattcagtaaaatttcaacaaagggctttgtaaaatttgataaaccaattcttaaagtactttgaaaatataaataatctaaattagtgaaaacaataatgaaaaacagtcacatttagagacatatctgaaataaatactataaagctacagtattcacaacagtgtgttgttacttgaggaaataattataaataattgtaatgatataggaagctcagattatatatatatacacacacatataaacacacacatatatgtgtgtatatagatgtatatatttacacacatatataattttttattaaggaatgcatgaaggcaattcaaagggaagaatagaaatttacataaatattctcggagaagttgaatacccatatgtaaatatgtgaacattgattaatcaaagtacatctgaaaaattaacttcaaatgaatttgagatgtaagtgtaatagataaaagtatatattttgtatgaataaagcataggagaaatttattgtgaccctgggataggaaatggtttcttagatagcctacacatgcagaaaacataaaataaaatgtataaattgagtcttcatgagacactgttaaaaataaattgacaaccatagcctgagagaaatattgaaatacatatatttaataaatgttggtgttcagatttgtatatacataaatcatacagctccgttaaaagaaggcaaatgacctgacaaacattaatgggcaaggtccattagctgctgatgggtaaacacattgcggcgtgcccatatgatggactatttctcagcaataacaagtaagaaattaatgatatgtacaacttggatgatttcaaaggaattattatgaattaacagaagacactaaagactacataaatgttaaaatcgcaattatgtgaaatttttcaaaaggcaaatacagtagctaaaatataatagttttgtcatgggcatcatgtataaggagagaatttaatgaaaaggaccagattgagcttttcatggtcatgggaatgttctacaacatgtttgtggtagtgattatacagtcacatgcattttgaaatgaaaatgtataaaattttacaaattattcatttataattgatgaattttaaagaatgtaaattgaacctcaataaaattatttcaaattatgctatggaagaatgtgtgggacaattggagcatgctcaaaacatagtgaatgtctgcaatcatttagaaaaactgtattttagtatttatttaagccaaacagatgctctccctgtgactaagcaatgttcctgtaaatatatataccacagaaatgtatccttataatcatggcacctttctttataatggctaaaacagggaatgtatccaaatgtttgtcaacagtagaatgaataaattctaaaatatttggaaagaaagctctcaggacagggcagagtgggataacatattcaaagtattgaaagaaaaaattctaattaagaacacttatatttgctaaaactctccttcaaaataaaggaaagacaaaaacattcctttatctctcctttgacttcaatttatactgcaaggatacagtaacaaaaacagcattttgctggtataaaaataaacacatagttcaatggtacagaatggggaatctagatatatagccaaacaataacaacctttgacaaatcagacaaaaacaaacacatacataataaatggtgctggaaaattgggtggccacatgtagaagaatgaaactcaccatatccaaagattaactcctggtagattagagactaaatctaagacctgagacagtaaaattctagaagagaaacctaataaaaaactcacaataaatcacagaggaaacagacattatatagaatgtgaaataaattccaaactatacttacgattaagcagtaatatgcagactctgcagggaactcaaaaaaatcggcaagaaaaaagaatcattaaaaaatggggaaactgccctttaactttggcttttattaaaaggaaggcctgaaaagacctcaaatttttatcagtatttagataagggagatatattttaatgaaaataaatgcaaaataatatatttgaagaatggtatgtctacatatgcttgtatacatacatgtatgtacatacataaacacatacaatggaatgatacttagtcatacaacagaataaaatgctgtcgttactgtcaacatggatgatcctggaggatatattaagtgaaataagccaggcacagaaagaaaaatgctgcattatttcatgcatatgagggatctaaacaagttggtctcatagaagtagagagcagaatggtggttaccagaggctggagtggttagagaggggaacaggatggggagatgttggtcagaggtcacgtaattaaaattagatagataaagtaaatttcaagaaatctatcgtatagcaaagtggctacagttactggtgatatattgcattctagaaaattgcaacgatagtggatgtgttctcacaatgaaaatgataactatgttaaataatgcctctgttattagctagatttagatttaaccattcaacaatctatatgtggaatgttcaaaacatcatgctgtatgtaataaaaatcatccaatgtcatcttaaattttaagaagtcaaatagcatgcttagaaaaaatattattcaagctagcattgaatatatagctaactatctttcttggtaaggagtattaaaataacttcaaaagtaataacacagagatttcattaccaagagtagctacataagagtacacttcaagaagaaaaagtgtcttcctgtgtaaaggtaaaatgagaacaaaggagtgagagacataccttgggaatatcaaatcctggtggacactgaactgaaggaaccacataattcttgcaccagagcagaagtgtgacatgatctgacctagtattgagttgcaattagacgtcaggagtcaaggatggaagcagagaccaagtatggggagagaggggatggggactcagaccaggtgatgagcagccatggggtgggggggtgagaagcaactgaattcttgtttctcaaatgtggggcccacaggatgtgggtgtgagagggtgaggggggtggtctggatagctaactggaaggatggaggtgctgtggggggagcaagtccagggagaaggatgcagtgtgaacagcctgtgcgcagcacttagagcttcccctccagccgtgtgtcaggggaagcttgcctctatgcctttgcacgtgccagtctgggtgcccagaagacttctcctgccctggcagaaaaactccaactgccttctcaagggtcccaactgtgattctgtccctgtactcccacacctatctatccctctttgcttcgtgcacatgctggacctcacacatgttgcacagcctttactgtattgtgtcccagaaagcgccccagaattcaggatggagcgccatgagttcctcatgctggtggttatcagaatgcctgcacctcagtgatccccacacaacaggggctcaccctttgactggctgggggcctgttggactccttgctctactgttcacaggtctggccgccctaggccgctcacccctccccgacggacctcagtctctgcacctgttaaatgggtgtgctctttctcctccccacgtctgagggtcctatgcggagggcaccaggcccaggatcctgaaaaccgcgggcagtgcgccctctgctgggaggtgacggggtcttcgcccacaccctttccgtgccccagttggtgctgggggaaggcaaagccagagggaggcggaggggcttccggtgactgtccacttcctggaaagtggattcattttcctgttaatgctcaccttgactgtggaagaggccagtgtagaccattttactgagcacctgctagtttcttgttactgaagtgttacccgctataactcctatttgtttaaaagaaataagcgactcagagcgcggggtgtgaatactggagaggaagggaaaggtgggctgggcatgtaccggcgaggcaaggggggagtctcaggagtggctgaagtcctgatctgcctacactgcatacagtgcggctggggttgagttggtctccgtccccgctcagtttgggagaatcttgaccagaccctgccacccgagggctttgattcctggtctatgaatgggggtggcacccccagccctccccttgctggtctgaagcaccccctcccacaggctgtgacagattctgaccgcggccagaagggggcgcgcgaggctgccgctggccgcaacacagagctgcattctggcagcccaggctctagcaccagactggctgaggtctctgcggctcttcgtctccttttcggggggcggagtgagcggaaccttgtacttcaggctcagcagccccaggagctggagcctgaggagctgctggggtcctgcccagcgctgaccggcctggcagcgggtcccagtgcgaccggtgaggggagggtgcttgggctcctggtggccagcggcacctgcttcctgggccactggttctggcgagttctgggggcgcctgggggaggcttcgcgggactgtaggggccccaggcggggagggctgtgctgggcgctgagggatccgggctccctagtggacctcctgcaagcttcggctctgccacctgccacttgcactcccggttttcctctccagaactggaggaattaatcccagctctgttaaactccgggacggttcttcttcgtgatacagaaaagtcaggaaaaggggaattggatgtgcaacagactccaagtgaattcggatcctttcactccggattctgttggggtcatgggggtgattcttgtgatgaagacatggaagccagtgctcaggagctgggagatgaaacgtggcctgctgagagaactgcagtgactgagagcaaagcgaggttaaggcgcacagcagtttcaggagctgcagataattgctctggaggttttggttctgtgtttactgtgtgaagaggcaggatggatgcatgcaccgcattaggtgatcagaaaagccttaggccaattctacagtgagcaaagcgctctgagaggagcacaggctctactgcagtgcctggacgtcttcctcatgcagttccgtgtttctctgcctgggcagaagatggtgctatgcttactcaggatgaatactgtcatagtggaagtttagctatgctgcagtgaaaactgcagaatcatgagttacttcaaagaagcagagttgaagggtctccttttgcaaggtagctggggtttgacctatattcattcaatgtctttggttcacagggatataaaatctagtactgtttttacttctcgagtctcaataccagatgctgcctctgaagaagaggaagatgactggggatccaaccaaattatgttaaacacaggtgatcttggacttgtaacaagcatctctagtccacagtttgaagagggtgataggtgttttcctgcaaatgaagttttacaggagaattatacccatctacccaaagagatgtgttcctgctgctgaacctcttcccagaaatagagaccagtgcatgaattcacacaggccaggttaccctgataccacaagggctttcccaaaagtttacagagttgataaaagttatgattcctccagatccagagagaagaccttcaagcaatggccctggtaagcattcggtactgctgtctgcttctagaaagagagaagaacagtaacaaatagaatcgaagcctggaaagttcaaaaatttgcttttagaaggataactcaaggaagcacagatggcagaggctgcagctgaagcagagcgctctgctggcgggacagccatcgtgtccagcacccagagtaatgggccattcagcctagtggaaggcacatgagctgctccatcaaccttcctgcatactcacctactcatgtcccacctcttctagaaactgtgacaaaagggagctaggttgaaatcactgctggaatcccgtttgtaatgactttcactcttggtgtcagtagttttactgcttgggacttttatttgtgaattacagttgaaagctgcatttttacctatgtcaggctttcatctggccttaccagtctttcctctgtaggatggcagtcactgttggatattacaccatcctgtccagggctagccactgtggtggtgtgctgcttatagcttgctcttgtattgtaataaaagatatctttccctgtcgtgatttgtaagaagaactcaagggcattgttacaaaaatattctcccttcaaaaagagaaaagctaaaagactcattactactcagacttcaatacacctgtgtgtcaatcttatatttctttttttatacaaaactgtaaaatatacttttaggtccaaaagtatacttttagtgctttgtaagcattgcgtgaagcctgatatgataattccatggaagcattgccttgggaatttgctgtctttgctgtaagcttgtagcattaaacaaacattgtagttaataggctttctctttgaaacaattatgtgaaatgtacagctgttcttgaggaactttgaagctagttcattgaaaaatgctcctttcccttcccttgtaatgctatattaatgaagtataataattactggttttgtaattttttttctggtaatgttcttctctgactctttaaaaatgtcccttccctcctcccaagttttatactagactgtggttagtctgattctaaatgttttacttagtttatcctcaatattcatgtatataaattgatcctggtgatcctgtacatggctgtttgcaatgccagaatgatttctgacattccaggtttttcacaaaatatattttatttgtgattagtcacttgactaataatatcagctaaaagatgtcacaaaaaataaaataaaaaaagtggctgggctcagtggttcacacctgtaatcccaggactttgggaggctgagggaggtggatcacgaggtcaggagatgcagaccatcctggctaacacggggaaaccccatctctactataatacaaaaaattagccgggcgtggttgcaggcgcctgtagtcccagctgttcatgaggctgaggcaggagaatggtgtgaacccaggaggcagaacttgcagtgatcggagatcgcgtcactgcactccagcctgggcgacagagcgagactctgtctcaaaaataaaataaaataaaataaaataaaatataaaattaaaaagaatttgtgtcttgtttgtttcctcattaatgttggttgaaagcatatttgcacttgtctttgacttgcattttattaacatagattggcatattaaaagtccctctgagtttaccttaattgtctaaaaaaatgtaagaaaaagggcctgtgggaaggacaaccaggcagaggggctagtgtgagcacatgctgggcaggagggaagagataatgacgcggaccagggaaatccccaaacccagcaagtcagggagccaaatgaaagcctttcatcctgtatcggccacctaaccccatcgacactccaagtgagcattctcttttagagatactcattgccctgttttttttctgtaatcttgtaaaggaatctgatttctcccattagactttcacagtactaaaatttcacattagaatgctattctttagaaggcaccttcctagactaggctgcaaggagactgaggaagttactgtcagtcacttaaaccccacagggacattaattcaacagagctttggtgggggagtagaggagctcactgcaggcaggtctggatgctgcacagagtgtaaagggagcagaaagacccaggacacctaggcctggagatagctccaatcccgggaggtactgttattatccccattttacagaggaggaaactgagacacaggcaggtaatatgatcaagaccacgctgccccacagtagaggagccaggatctaaacccaggcagcctgccttgctatcagagctctcacccataacctcatgctgctgttaagcaggattgccctgtggccagggtcacagcctctgggttcacattctagctgctctaccacttcaaggtgtgtgtccttgggcaagttacttgtctgtgctcagtgtcctctatacagtgggtgtagcagtacctgcctcatggagtcccttaagtgagttaatagctgtaacatgcttagaatggtgtcatgtccatcatcaccatccactacatataggccatcatacctgaatcccagatggacacatatccttgaagggtctaaaatccaggatcctgaaatacctggaagtggtatcctgaaatcctctggcagcattctaacatcttttgactgcagaattgtaccctgcttcccagggctagaaggtgtggggtaacctgctacccagttcagccccaaagtaggaaaagaaagttttgtcacaggcttgtctggggcccagcccctgtaacctcccccatccctcctttgcatgctccctcacccagattcacacatgcactccaggtcttctgggcccaaagggaaggagagagggtggggagtgggttcactggtccactggagcatgctgcctccagccctgctaaactggtgggtccagggaatgggcctggagctgaaggggtcttgatctccctttaactttaagccttcatttgcagtgacccaagagcttcacttcttcctgtgagcctgtctggatgtttatgctggatggcacgggccccttctggcagggctgcaaaggtcagggcctggctggcagccatggcaggtgaggagaccttggcagatgagaagaccttctgcttcagcttcaatgtatgggtcttctcctagctctcagtacattcctcctgagccatgattggccccagttcaatgacaccttctgcggcagcatcatggtgtccaggggtataatctgtagcatgtgccagtgctaccccaaggtatatggtggtggggctgagtggagccagaagggctggatcttgttcctctcttccgtgtatgagccccatccttcaatcatcttcttgttcttttcattttgactccctgttttattctgtcttctcttctgagtatccatccattcatttatccattcatccatctattcatccctccattcatttcagcattaatctatcaatccatgcatccatccatttatttatccaaccacccatccatctatctgtccatcatttagcataaagattgatcataagcctcctggttctggagccatggaccagacaccatggggagacatgatgaaaaagaagatataatttgtgtgcttgaaacaaaagttaatgagtgcttaccacctgcctggcagtcctgcattcagggtgcagttctcccctcatcctgagtttttggtaccttctgtagtttcattttgtagtagagaatgctgagcctcacaatatgtggtcactcagctgcatagtggagtttagattggagctcagatgtgtgtgacttagacatcaccctctgccttgagtcctccactccagggtcccagagctgctgagcattctggggttggtcagctctaaccttggtggcatgcattgagcaactctccatattttggagtcttaatgtattcttagccttagtgatggcaaggaccctgctttgggagacctgggttctagttccagttctgtcccaaacttgctgtgtgatctttgtctttctgagcccagtatttgcatctgcacaataggacacaagcactaattttcatagcctcatagggttgttgcagaggtcagagaagagaagagacatatgaatatttgtagattgtagagtgttttgtttaggtgaagggctgtcagatcctgataaccctctggaatgaagatgtcagaaattgtaaaccttcaatgcccagagaggtggagtgactcttccaaggtcacatagctagtcagagacagacctaggggaaaaaagaagagaaacatggattctaacttgggctctgtctctaactgcctgggatactgctcaagctccttccctctctgggcctcagttaccttgttagtacaatatgtgagacaggatgaggggatggaagatggagggagggacctgctagagctcacctctacggcccaggcttgggaatccccagaacccccatattgtcctttacacctgggtggctgtactcaagggctcagggaggggggactcctgtggccctggactccctagccattccccttctgtgggcccaccctaggctgtcagcgtgttaggtgctggaatggtctgagctggtttgtagtcatttccgaggcagtttatggtcgcctcacctctgtccatgccatgtcctgagcagaggccccagagagaagaagtcctgggggccagagccacccgtgtcaccactagccatggtagtcctcttccccgtgaggagggtgcaccctgggagatggcatcgggtggaacgaagcatctgtcctgacctccctgttaaccagaggtggctctggggctctgggcagggatacaggagtggcagtgggaagcaaagtggaggaggaaatattgctggatactaatgagtcacagttgatagattcatgtcttcatgtgctgtggaggcagtgtggtggggtgcagatggcgtatgttttggtgacctacaggcttacattcaaatagctgttacctcatgttccacatctgtgaccttggcaggggaagctcctcaaccccgaaccttgcatagctgagtgggagaaaccagaagggtcttgtgttgtcggggacctggcatcatgcctggcacagagagtttgcaaaatcttcattctcaagattggcatttgtagctctaggggatacacacagaggtctctgtatgtatgggcagttacatgtggataggtgtgggtcggtttgtgtgtgtgggagtgcatgtttcagggacacaggctattcaaaccagcacaagttgactctaataagggaagggaggaaagcgcatggtaaaccaggaagacgctctagagatgaggcttccggcacccctcatggcctcttggtgcctgtgccattgtagccttcggtgctcatgcatgtcctaccctcagggtcctcccttggacctcagtgcctggcctgtggaaagcttcagtaaatggggaaacataaatataagggaatataactagctaattagggtaattaagtgaggagtagccatttccaacatacattaagctgtccctgatttttaggggctggaggtctagtgagagagacaatttgctgcatgatggggaagaagtaggattcacagagaaggtgagtttggctttgtaggttaagtagaaattcaccaggcagagaagatgtaggaagacacttcaggaagaagagcaacaggatcaaagccatgtggtgaaaggagaaggcaagtgggtcagcaatgctactagagggggaggagaacaagtcaaggtggaaatggaggggccttagctcctcagtgcctggggtgtcatgctaagaaatttggatcttaccctttagttgataggacaagggaggggcatgaccaggtttgcagtttgagaaaattatcaggctgatatctggaaagaggaaggtctggggcagcgagaccaatgggaggcttctctgctcaggtgagagatggtggtcatctggattagggagaatttgaacccaaggctgtagaaactgagaagacagttccagtttaccatatgtggagtacctgctgtggctggcagggcaccagcacttctacccaggttatttcattaaaattctaaagtagacctggtcagctctggaagccacctgggcctcaggcatgagagaggagaaggaattggggcaaatctagtgggtgggtgcagctggagatgctgagcctgttaccaaagatgggacaggaaagtggggagcagggaaaggagtggaagggagagtgaggcctttccctgcctggctgaagcccttacccataagcctcccattcctcattcctgccagatctgctggacccaggaccaggaccctggttggtgttaaaggttctgtctcccctgtgggcctccctccctctgcttcttccttctgaggattgctcagtgttctgcctaaccataaatctgacggcatactctcctgctgataaatcttcaaggatgcctctgattctgggcaaagcctgagcttcttagttttatgttctgggggtctgcattctttgatatcccctccccagcttcaactctgccttttcctcctcatcaaagtacatgtattttaatatgctacctcctctccttttcctccaagattttcataattgtggttgtgatgatgatgatgatggtgaggatggtgatggtgaaggtggtgataatgatagtgatagttaagttgaggatgatggtgaggatggtgaaggtggtgataatgatagtgatagttaagttgaggatgatggtgaggatagtgatggtgataatgatggtgatggtgaggaagatgacggtgaaggtggtgataatgatagtgatagttatgctgaggatgatggtgatgatgatgatgatgctgagaatggtgaaggtgagtatggtgatggtgatgataaggatggtgatggtgaggtgataataatggtgatggtctggatggtgatggtgaaaatggtgacggtgataatgatgatgatggtgatggtgaggatggtgatggtggagttggggatgatagtgataattatggtgaggatgctgctgctgatgctggtgagaatggtgagggtgagactgatgatgataatgaggatggtgatggtgagtatggggatggtgatgatgcaccccttgatttggcaattcgacatctgagaattgttcatttcttctagggttttttttgagtcaagacttccctacgttacccaggcaggccatgaactactggccactagtgatcttcccactttggcctcctgagtagctgtgattacaggcatgaacagtggtgcctggttttatcttaggaatttatcctgaggatataatcagacaagtgtgccaagcggtacttagagaagggtatttattgttgcattgatgatagtaggtaagatgtgggaagaatgtaaatgtccagcaataagagattggccaaataattgtgctacagctaggcaaggggctggcttatggccattcaggacacagaccctcctgattgagtcaaacctcctgtcactgctctcacacacctccctccttttcagcacaaattaccatcataattttacatttctttgtgaacctctttgatgactttctgtatccctcattagttgccaagctccatggaggcaaggagtatactatgctcattattgtgtcttccgtaccaagttaagttcctggaacacagtacactctcaataatttgttgttaaatgaatgactgagtccatatttcttagtatggaaagatgtttgaaatatgcaattaagagaaagagcagattataaaacagcatgcatgctgtagtacacactgcaaattccctcctttcttgatcttctttgggggaccaaatgtgcactctcagtcaataaattatgattgccccttgcctagctgtagcacaaagtcaatcatgacaatgctattctctgatgctagggttggtcatgagatcaggttctggccaatctaaacacagatttccagacctaaagagaaatcctctggtggtcacctcagaagttcttgcttttctaataaaaatgtagaagtgactgcttttgctggccttggaaacacttgtagtggttggagctgcagcaaccatcttacagccatgagctaaattccaatagactcacaaagatgctgggcctaacattgttgaaccagtgcaccatagccagggaccatagatactctaactatgtaagaaaaatgaacctgtatttgtttaggtgactgaactttcagattaacgcactcccaacagatacagagcatgatcccatatatacctgtatgtgcaagtatgaatagaaaaataattaaagtgattatctctgtgtggtaggattctccttcatattttttattttataaagttttcccaaacggcgtgtaaataataatcaaacacatatttctgtacattcagaaaataaacaatggtactaattttattttttaaaaataaacaaaatattggggctccagaaggtagttcactaccatatgataagttaattagccacaaccgagaagaacacttgtgggtttcctggatgacaggttcggcagcagtgagaggtcccctccagaacagtatgtggttccaaactcctgagggcagcggggcagaccccagggaagtagatgagaagctgagtgaggctctgtggggagagaggatgttcctcagccctcacaaggacatgtcagtttcacttgagattaggccctggccttggctgggcagcatgctaggcaggttctcagcagcatggggtgataacaggacgaggggaagcctggcatgctggggcagctctggggtcctcaggtggggctgtctcgggcagcaactctgttggctgtaaacacagatttctaggaggcagagcattgcaatctctcccaccataaacctggaccatcagggacgtttccatagcagcatcaacaccagtgaggaatcgggacgcaatctgtaatcccctatcccacttttccttttctcttagaatgggacagagcagcctcgagcagctagtgtcctgtagtgactccagtttgctgctctcttccttatcttcttcctcctgccctctgcctcctctgcattcttcaccttctacatcaggaagctcaagtcaccaagctaagcctgggcttctcatctaaatcacggagtgccagtcaatgcctcccttcctcttcccagggagcaacttcaatcttccctgcttgcagtgaggagctagaccctactcctttttccctgtgggaccatccacagcctgtttcctcacccctgtaatgggactgcagtcctccctgcccatctggcagtgctaattccaggccaggggccctcctgggaaaatcaccagtgtgggtgatatggtgagtgtttgtgtgtgtggaggggtggggctgccctctgaccatttacagaccctgtccttcctctctccccatgcttgtcgcatgtcaggaatccctctcctttgtgccatgaaatagaaggcattttcagatccatcatctcattgagacttgcatctccttggtgaagttggagttattgtcaccattttactgatgagtaaaatgagtctcagaaaggggaaagtcgttgcccagggttccgctgtggacttatagtggagctgggattaggatgcgtgttctggattcctggcggggtcctggcccatttgcagctaaggcctgtctttctgctcccatgaggtcccttttccattcctttcctccccatgacaaccactgtcaccaccacccagagcctgtgctcactgtcacaccacccttcgctgacccctgcatcttggttggatcccaccatgtccatcagacagattttcctcaatggtggttgggctccaaatctaccctccccagactgacacaaattgcactacagggggccccaactgtaggcgtttctggtctagagagggagatggtcccgtagaaatgtcaacatcacttggtagaggagagtggaagcacaggagaaagttcaggaagtgacatcaggaggaggtggcccttgagttgggtcttgagggatgtgtaagagttaccaggtgaggaatgctgggaagggaattccaggaggaaagagcagcattctccaaggctcagactggtgtggtcactgcagggtagagctaggtgacctggaccccttgagacagtgctccccttttaggaggacatctgcagttcccatactttgggctgtctcagaatcccccagagatcttgggaaattcctgggtccagttcccagggattctggtccaggcagaggaatctgcacttctcacaggcaggggctgtgacctcgccccacagttctgatgcagttggtccccggatcactcttggagaaatacaagcaggactgagaggctttgacccaagcactgtgcagggggtgggatggggatagatgtggaatgggccagaggaatagtggttagatctataccctcctgtatgaccctgtctaaaatatggctctcccatccccctctcccactgacacattctatcctccttcacttttcctttattttattttactttttgtagatacagggtctccctatgttatccagacaggtctcaaattcctgacctcaaccatcctcacatctcggcctcccaaagcactaggattacaggcatgaagcatcatgctctcgtcaccaactcacatgctgaccatttgactagttcagttattacctgttttactctattagcatgagggctacatgaggaaagggactttatgtatgtcattcactgctgtagccaagcatctacaatgtgtgagttcatggaagctttttatgttttggtttgtaattttaattttgggaagcagaagatatctgattggactcagtggctgacaggaaaaggaagaacagtcctggtgtgcacaagagtgacagggagacctagatggagagatgtcagaggacagttcctggaagaggctgacggaaaggtaaggcaactggggagggtctctctggacatcaattcctttgaagctggcagggagggaggaagtgcatgggtggagaggaatgcctgaagaagacctccttggcttccatattcttcatgaagtgacaggtgaggggtttccttggaagagagggtaggaggggaacaagtgtaggctggtgatggtgggccaggagcagtgccccagggtgaaggggtgaatgcattactgaggctggactctggtcatgacccttgccttggcctcaagattcattaaaaaccagactcctccagtgagcttagatcatgccactgcactccagcctggagacagagtgagactccatctcaaaaacaaaaacaaaaaaccagcctccagtcccaatgtgcccagctggaccatgtgctgcttcctggatgtgccaccatcacaactggaacacaaatcctgagtcaccgcctctagaaagcctacctggattgagtgcccatctgagtgggctcctgcagcacctggtctgtccctactatgtgacttgcatctgcctgcctcttatcacaggtgcctgtggttttaccttcctcagtgtgggctgttgaggactgggccaggctgatccatcttaggggctacagcaggtgccagcaatggctgggctttgtcaggcctgggcaataggcaggcctgtttctcatgctaggcactgggtgccctttgtgggcccaactgggcatggccactgcttctgagtgtcccgaagattcctgggagaggcctggttatcttgggctgaccctcactccccagttccttcctccctctgtcccttgccgaaacccttttgcatgtcctcaaaatcctgctccagcaccagcagccccctggttttcagcagcctcagggaactcttccttttgttccttgctgtgagtaagaggcccaatcccctgaggacactgctcccttgctgtcctctgctgcagcccttccctgggcctgagcagggtagatcctccttgcttctcattgcctccctctttcagctcatcatacttctctcccatataaagacattcatgtgccacgaaatgatgtttcggtcaacatagaccacatgtgcaatggtggacccatgaaactataatggagctgaaagacacctactgcttagcccagtgacataacaagtgtaatattatggcagagttactttaaaaatatatttattaaaaaagatttataatactatagaaaaagaaatatatatctcgtagtgtagcctaagcttccagtgtttataaaatctataatagtgcacagtcatgccctatgacttcaccttcactcaccactcactgattcacccagagaagtttccagccctgcacgttgcatcaatcataagtgtcctagaccagtgcaccatgtctaggtaccatactatatttttatatagtgcaatactctgtttttactgtacctttcatgatatgtttagatgtacaagtactgacaattgtgctacaactgccaacagtattcactgcagtaaactgtgcccaggtgtgcagcctgagagcagtaggctgtgccatagagcctaggtgtgcggtaggtacaatattcagatgtgtgtaagcacactctgtgaagtttgcacaaagaaaatttaccaaaggagatggtgacacatgaagggaatcaatattgaagctcttgctctcagattgcacccaggaccacatccctattcactgaagacttagctcccagttcatgggcactttctcctgtggggaggatgccaacatgcacatacagagcccttctcatgctctggctcttggtccctccacctctagagacattgtctgcaccctccctgagtcacccactcctacctgtatattcttgaccatatcactgcagaaactgtagctactccagaccctgaatttaaaacaccatttttttgaccaaccactttcctttttccagctgcctcccaactccaacacacttcaatgactccaaattttcactttgtgtcttactcaccttctttcaaatttcccctcctcccagctgagactatatggtccagcctgtcatccatcctcttaacactctccactctcttgccccactattgattgtactcccagggcaaaaccacactcccctgaaacccagccacacactccctctgctcctgcactcaggtggctgagcacagccagagagaaacacacgtgccttctggtctcaattaatcatcaagcccaaacatccagtggaccatggatgctgtcctaaaaaactcactcatctcctgagtccttaagtctttatttgttattttaataaa

SEQ ID NO: 59 - DNA, 1976323 bp, Homo sapiens
aatagaaaaggagttaagacattctgcaatcattgaatttcctggtaaatgataaaggcatatgaaaatatgttgaaatcgaagtataatttaaggcaaaaaattattagatatagatacacttaatattcataaaatattaatccagcaggaaaatgtaacctttttatatgaatgcgtacataatggagtctcaatatataaagcaggaaattgacaggattcaaagacataaaaatcatgatgaaaaataacatctctcctagtaactgatgcaacaagtaagcatataatcagtaagtgtagagaagttttgaattaaaaattaacaaacatgctctaattgtcattattatatagaacatctcatttaataccttcagagaatttcttattttctggggaatctactacattttacaaactgattatattctgggccataatgcatgtctcaaaaattttaagtgatggaaatcaagctatgttctctgaccagcatagaattaagaaaaaaagttaacataaacaattctaaaacaaaccaaaacagaaaaatctcatgtgtttttcagattaaccaatttgattctgaataacctgaggataatggaaaaaaagatttgaataaaattatattcaattttgagctaatgataatgaaactattgacaaaattataaactatatagacatccgtgatttgagagaaacttatcatttaaatgcaaatatattttatacattttattttattttactttttgagacagagtctctctctgtcgcccaggctggagcacggtgctgagatctcagctcactgcaacctccacctcccaagtttaagtgattctcatgcctcagcctcccaagtagctgggattccaggcatgtgccaccatgcccggctaatttttgcatttacggtaaaaacagagcttcataatgttggcctggctggtctcgaacccctgacctcaagtgatcctcccaccttggcttcccaaagtgctgggattgcaggcatgagccaccatgcctggtctaaaatgcatacatattttaaagttataaaggtatatgatatatgcattcatctctaaaacttattcaacaacagcacattaaaataaactaattgaaatgatgaaataataaagataagttagaaatgaatatagtaggatcaaaggtcaaaaatcagtgtcataaattgattttttgaaaaaagctagggaaattgataaccccctggtaggactgtattaggccattcttgcattgctataaagaaatacctgagactgggcaatttgtaaagaaaagaggtttaattggctcatggttctgcaagttgtacaggaagcatgatgctggcatctgctccacctctggggaatttacaatcatggtggaaggtgaagtgggagccagcacttcacatggccagagtaggaggaaaagaggaggtggtggaggtgctatacatttttaaacaatcagatcgcacaataactcacccactatcatgagaacagcaccaaggagatggtgataaaccattcatgaagtattcacctccatgatccaatcaccacctcccaccaggctccacctccaaaaatggggaatacaattcgacatgagattacaatttgacacaaatccaaaccgtatcaaagaccaataaagaaaaaaaaaatcatgtagcagaaacaaccaatctctggaataggaaagaacattatagtttctataaacatcaaaatgataattaaaaggataatgaaaatttcttgtgaatacatttgaaaatcagatgaaataattttgtgcacaacaatagtatttaaaatctagtatttaaaatctaataactggttctgatacctggtggtgagttgctgccataacaaattcctataatatgtgtcactgttcttggtaccacatgacagtcagaagatggaatagctttgtggaggcatctggaggaagtctagtgagcctgaacaaagatggccatgagaacacagtgcaaaaacaatgttattggagggtggacaaaaggattcccttccagcgtagtcttggaaagattatcacaactgttacaggcagttgcataaaaaacagagactgtgactaaatgaatggatggatctggctaaggagaattccagggagaatgtgtcaacttattttattaaggttacaaggaccataaggtctgaatagaagaaaatcaagtaattaattattttttaagtagaatgcagaggaaatataaaggtgccagaaatttgtgtttttaacaacaaaactattctccatgtcctgttgttccagatggcaaatgactcatgcaaacataaatttgaaggtattacaagcgaaatatggtcttagggtaaaaatgaggcttttgctaagaccttagagagatccaagatgtacctaatggaatcctgaaaacaaataaaaagccttatagagatgttacgggcgtgactctagagttgtaaggacttctaacaatcttaatggcattttccttcagtagcctcattaggatcccaagatagagaggcaccctatatcaagggagttttgtttaatcaactgattctccagtaaaattgatagtagacccataaagacttttttttttttttttttagacggagtcttgctctgtagcccaggctggagtgcagtggtgcaatcttggcttacggcaagttctgcctcctgagttcatgccattctcctgcctcagcctcccgagtacctgggactacaggcactcgctaccatgcctggctaatttttttttttttagtagagacggggtttcactgtgttagccaggattgtctcgatctcctgacctcgtgatctgcccaccttggcctcccaaagtgctgagatgacaggcgtgagccaccgtgcccggccataaagaccttgttgatcattttgctagtggaaacatcaaaagcttgaaataaaagagacagagagtgcaaaatgaaaagagcctctggaccccaaacctttgtgagcaggaagtaggctaaaagaaccaaattatcacttacggaacagaggataattgtgagagggtagaatcagaggacagctcaagaacaacagagagcaaaatcccagagaataagaatgctctttaggaaaatgaatggattattattacagaaactgatatttatctgtctagattttagattatctatggaccaaagataactagattcctcctacctcaccctctttttgaatggaaacttctactgcagcttctgtatttccacttcccaccattatatgttgagcatggaagacatgtaatttggtcctttatttcacagatctactgatagaaactggacaagaactatgcctgaggaacctcaactaaacctggacctgatttagatgaagagatcctggacctcaaaattgaattttgtgccataatgggctgaggtcttttggaggtttttagatggagtgagcataatttggatgtggaacgaatagaaataacttgtggtcagaaggtgaaaggttaaaaaaaatggctgcaaaaattcaagtaaaaatttttaaaaaattgaaagaaagttgggttacagattccctcaccttgaatctgagtgagtttgtgattatatttttacaatatggtagaaatgatgctatgtaacatctgaggtgacacgtaaataagaaagacaaaaatatgcagtgttcatattgttcactggaacaccaaatgagatgtgtgactaccaggaggccatcatgctgtgagtaagcccaagacaaatggaaaggcaatgagcagaccatttggtctatggtctcagctgactccagcctttgcatctccccagctaagacactaaatatgtttgtgaaggaggttccagatgattccaactctcatctgtcaagttgaaaccaatttcacaaaacttctatactaagatttaatattttgaattttaagtaactgtttacctttaaaaaaattctaataaaattttgcccccatatgaaatgaatgtatttttatctatacaaactggcttcttcccttaggataatggcctcaggaagagaaacccatataccatgtgttctcccttataagtgggagctaaacatggagtacatatgacacagaagggaacaatagacactggcccacttgaggtgggaggcttggcagaaagtgaagatcatcaaattacctatcaggttctatgctcactgcctgggtgaaaaaataatttgtacacagaatgccagcaacacataatttacccatgtaacaaacctgcacatgtacctcttgaacctgaaaaataaaagttggtagggaaaaaaataacataacaaacctaatttaacataacataacataaaacataacatataacatagacataacataaaaaacaatataacaacataacataataacaacataacacaacgttttaaaaaagaaactggcatctatctagttgtgcttataaattttcttttatttttatttattttggctaaaactgtttaacaattttgaatggccatcttatttttgaacagtagattgagtcctagacttttctattgcttcttatattgtaaagaatctgaaatagtttttgagacaaagcagctccaagaaaacctgtctctggcctacatttttatcccacttcatggaaagataaggtaatcccaagaaaaagcagatatacaccattcgggcccaataaatagtcttaaacatatctagcccaaatttcagatttatcataatggatttgacgagaaagaaggagctagtacaaagtcgacacatacttcctttgtaccacattccttgtcatttatatgtgtctgattccattcctgttaatgataagcagctaactatgatagtctacgagcgcaggatctttaccttattaaatgctgtattctcagagactaagtgcgcagcgcatggtttattgatgaatactcaaaacatttatttatatttgaatataattccatcatgactcgtaaacattttttacgtaatatttttcaacaatttttacataaataatacttggcaagtattttaatattttttacataaataatacttggcaagtcactttaatgcttctgtgtcatttccttatttgaaaccaaaaaaagtgttcaacatttacctaagtttctttttagttttcatatgtaattattcggagatttttttcaactagatcctgagatacagtaattctgtatgtaaccgataagagaagaacataatatttatgtttatatgatgttttactctaggaaaaaataggcggaaaccaaaaatgtgcgttttcagcaggaatcaattgttcaaatgtagctagttctctgacagttacttgagaaactctgaatgttacatttattgttcagcttatttaccaccatatctaaggccctatagtcggattaaccaaaatcagtttttgctattatatgaacttcttcatctgcccttccttttcctgatgcatttttgtttagttttacccagtaaatcctacttccttgcccaggctggcatgttttcacacttaacactgtatgccctgttacccttatcaaaattcctatcctgttattgggcattagggggaacttagctttggttaaaagtaagtactgtgttactggaagctctaccttcatctactaatgtgcagttctaaaatgattaacagataatgcaatgagattcagaattagatggtgagaaatgtgaagatcctcaagcataaaaaagttttgaaaaatttaagatgtttttccccttagatcctgtaaatgggtttaatgttgactaactgttaaggcccactacccactctagctttacctcatattattttttctcaggggaaaataaaaagcctttcgctcttctccctgtgccaaagtctgtccaaccctttaaacattgtaaggcataacataagttactgtagaagtgggcacaaggacagtatatagagaaaactgggtttctctcaacttcatgtcatttgataagggttcagtaattttcttgtgacatttgactggcatttaatattggagaaggacagactttcatttccattttacatttaatactgttgtttacagagaagtttgtaataataaatatataatgcaaattaggctagtacgttttttgtccagaggttttacacaaatgctgtcttctaagtgaaatatgttttaaaacaagtagatggaataaaaattaaccactaagtcatatactgaaataaagtaacttgtgttgttttgcttcatacaaaatattatatagctgttttttaacactcactggaaatgactagaaatgtcatctgaagaatacaatatctcttcttctaatttttgtaatgagcttatcatttatttggtcatttattcagcaaaatattttgatattccactgtgcctgcaagatgaatatgacaaaattcatccactggaagagctctcagcttgatggcagaagataaatacataaatgaataatcataaaataaaatgatacacagactcatagactcagaaggaaatacaagagaaagattctcagtagtgatgacactttgaagaattagtagacactaaggggaaaagacactttcctaaagtggagaaacataaacaagcacacttatcaaacctctcaaacattctgctgttcttttaagatgaacggcctaatataaaagtgcaggtgagaggcgacttggaggaatggaaactcacatcaacactggaaactgaaggaaatagcaatctcccagaaattttgtctaatttttccatgatacagtgtgggaagaaatctctcagagtggactacaagacagcgggatatatctacatacagacaattgcagaggacaaaaaatactcaactcagatgctccagctgtagggatgataaagttgtgttgtctaccaacttctccctatgccattgggtagctaaagacattgttaaagaaaagacaaaaaagggacttacaactatttcatttttaagcatttctcattgtgtaatggaaagcctgtgtataatagacattgtgtaatgaaaagcctggtgtataatagatgataatagactaataaatgtgtactgttaatctcccaatttgtagcctgattgtccagcttgaaataaaaaagatcaagtttacttcgccattgagtccataggagacatataaacttcaagcttgtcagcagatctaggaattaccacttttccttccctgggcttatttctgccagcttatgtgtgaatgcataatccaacactgcgaatcccaattgccataaagtaatttataaaattgcttcatcgaagatttatatgttgattgccataatcctacttgatggtgtgtgaaaagatatacctaacaagtctcttaaagacatgtaagtgcccaaatgcaaaaggaatagataaaatgtagacagtagctttatttacatttcatgaggccaaccttgtcataactaacctctgtaaagtaggctgtcctttcccaggcagtctaggtgttgttaggggttgttcttacatcttacaccttaaaaatctctgaatcagaatgcccgttaatgagctacaggcactcagtgctaacatacatgctagctacaaggcctaatgttaccgacactcttattggatgagtagggttctcatgagattttaatttctataacatttagaaggaaaacatgacaatgaaaaaatgttaaaaaataatatgaggaagataataaatataaaaccattactcatttgaaagttcaattcattgaccaatattattattattttcaagatggttaatagcaatttgaaatgttagttttaactgatgaatgagcatcaattcaaagacttacagaaatttattgaagtgggtacaataaaacttttctacagactatatttacatatattattaataaatacccaatgtatttttattattttccttatcagcttaaaagtctggcacccaacaatgaccaaagtatataggactgggcctgtgcataatgaatccctagctgaaaatccatttagagcaggagttgcaccgatattacaaagtgcctggaatgcagactctcctatcatatacctatgaggtctctttgaaagatattccttccccacgctggcccaaggccacatatctctatctctattagcaaaatgagtcagaacatgtgcttctaaatccctgcttcacctcttagcagatatgtaatattgcatgaggaacatacccttctgtgcctctcttaacacacatttgtaaaacagaaataacaaagatagcattttcctagagttgtaaagatcgtataatttaatgtactatgactgtcaacttatacgtccaataagtgataactttttttttttttgagactgagtctcactctgtcgcccaggctggagtgcagtggtgcgatctcggatcaccgcaagctccgcctcccgagttcaccgccgttctcctgcctcagcctcctgagtagctgggactacaggcgcccgccacaaagccaggctaaatttttttttttcccagtagagacggggtttcacctgttagccaggatggtctcgatctcctgatctcatgatccgcctgcctcggcctcccaaagtgctgggattataggtgtgagccaccgcgcccgaccagtgatagctattgttatgagtggtgagttagcctactgaagaaccaaaactataattaacattgaagcagtagaacttgggggtcagaatggaaaagaaaggcaggacctgcaacactcatggacaaataacaaaaaagaccagtaaggggaggtactattccagaatatttcaaaaggtaggttatgcgtgtcgagtactcgtgagtggagagggaataaataagagaagccattggaacagggtaatcatggaagagatgatgtactgtaatagatgtgggtagatcaatacattgctgaaaactaataaatatgctatcagacttcagaattttgctggaatctctacccatgtattctgtttaaaggtgtggtatccacgaagccacctgaataaccaccttgctgccataagtgagatggttctaagtaccactttcaaagactcacctcttccccatcaaatacttagcaaatatttacaaaagaaaaaaaaaaaggaatgttttaaagctacagtatttactgttacaagtgagttcatcatcagctgtgagtctgttcttgtcaagacaataatgggtatggctcagaggttagtgtgattctttgtgtgagagaaggatcattcaaaaatcaattgattatttttagtaaaatatatgttcaattgcattattctcagcaaagaaagctcggcacttgatcaaatacccatcatatttttggcactttacctgtaaatctatcttcccgcaccacctaagtgatgtatctcagttggtaaataagcatgttattcaagttaattggattttggggtgcgattggtgagggtggaaagtatcctaattttaaaaatatctatgaaagtgaataaaaatagcaggtcaattccttaaaatgaaacaataggtagaaagagaaaaaaaaaaactagcagaatgtggttttgaagttttcacagaaaaagctcttcagctctttgtcacaccaactcaacattcacaattttatatgttttttgaaagtacttttttttaatggggagggaattactgtgattattagggacatttatataagaattttgtttagggtacataagtccaaggggataactaacaatgtgagatccagtaatatatttggaaatagaataggaatgcaaaaacagacaacaaacgtagcaaacttcacacagatgacaatattgaaaggcaccttgaagttagtcagaagcttctatatgaatatcagagtcgagccagaaaagcctcttaactccaaatttatctttacatcatttcagttatttgttttcagaaaacgtccaatgtgtataaactgaatctattttgtgaaatcctatcatcaacatttttaagtgcagattcctctctttagtgtttgtggtttcattctctgagttcctagcacaaaatcatgtgtgcctgattgctttataactggcagaccctctagatttaccagccctctagctgtcctgcagcctccagcccccacgacctagtgaactgcactttcttctgaagagtggaattcataatcttttccttccacccacaccagaaaggacacaaaactgtatatagtctctattttaatcgaagtggagctttcaaatgaaagaataacatcatgtccatttatctcttcatttgaatgtcctcattctggcattatagaggtgaaaactttgacatcagaaaagcctttagacatgtgcaaggtgggaagtctactttgacatgctcccttcaaaatgtcctgtctccctctggcaccaagaagtagcagggccattctggcatgaaaccctgagtctggaccagaacccacaggaacggagatcccatttctctctttcagggaacactcgagtctatcctaccactatatggggttgaccagatgcccccaaaaactctagaatgcagtgcacacccatgacagatttttcccatgggccagcatcacattgcttttgaagaatctcaggatattaggtatatagaatatataccaacagactaattaaagtgagtgaccaaagacttatgtgagtgattccaattatttacgtagataagagcgccaaaataaatacgttcttgaagcaccaccacacaacctagggaaggctctgcttgagataacatagacctaattcctttttttttttaatctaataaactatggcctgaggaaataaacatacccctcaaggtcatggagcaaatgtagaaatatagagcctggaataagactataggctctcaacaaaagttggtattcttcccagtaagccacactgaagcattgttgtgtctctcactattgtagatattaaagtcatatctctaaaaggatatttcagatgtattatgaatctaatttttatgactaaaataaaatttaggagaatatttgtttgactttgggataagggaaaccttctgaagcaaagacaaaaaattaagaggaaataaatatgtttaaaaattatgccttttacaattgcatggtcaaagggttcataaacaaaatcaaaatatacattgtacatcggaatcagtatttacaacacccatgacaatgatttagcattctcaatattatgtgtgtgtgtgtgtgtgtgtgtatatatatatatatatagtcgccatgtcgcccaggctggagtgcaatggagagatctcggctcactgcaacttccgcctcctaggttcaagcaactctcctgcctcagcgtcccgagtagctgggattataggtacacaccaccacacccagctaattttctgtatcttaagtagagatggggtttcaccatgttggccaggctggtctcaaactcctgaccttgtgatccacccgcatcggcctcccaaagtgctgggattacaggcatgagccaccatgccccacccaaaatatgtttttaataatagaacaaagaaacctaacataaattaggcaaagtatataaatagaaaaattacagatgcaaatagctagtgaggacatgaaaaaaaatgctcaacctcattaataaacaaggaaatataaaactaaaaccggctgggcgcggtggctcacacctgtaatcccagcactttgagaggccgaggcgggcggatcatgaggtcaagagatcaggaccatcctggctaacatggtgaaacccgtctctactaaaaatacaaaaaaattagccgggtgtggtggcgggcgcctgtagtcccagctacttgggaagctgaggcaggagaacggcgtgaacctgggaggcagagcttggcatctcagtggagctgagatcacgccactgcactccagcctgggcgacagaccaagactccgtctcagaacaaacaaacaataaaactaaaaccataagatattttcattttctcctattatactaacaaaactttaagaattttgataatattaaagttttggaggatatggggaattagaatattcagacactgctgatgagtacggggggatgagctaactaaataaattagtaaagttgctgcgagaataaatataaaatcatttctattttgttataggaaagaaaaccaagcttccaaaaacaaaagagttgtttacttatgcaaacatataaatgcaaatactcaaaaacagtaaaaatgttagcattgaatcaaagcatcttctatcatgaatacaatttctttcctaatcttattttattgttacttttgctagtgtgggaatgttgttttctttttagttaggctgccctgagatttttgtgcaaaatatgaatttgtgtcaattatttatgttttttctaagttattttttatgacttaaatgtccctgatggtatgtttagcaccttttaaattagtcatgctacctattttattaaaggccaggtttttctctcttccagatcattaattagaatattaaatatgttcatttccagagcaatgctccctgaggcacccattagcacctttgttctatgaaagtagaattataatgaataaaattataaacaataggcccaattttattttctattcaggagaaaaatgacaaaaatttaaaaatctagataattctgtctgctcactatgtttaccataaattatacatacataattatatataacattgagggggaaatttgatagctaaactatcatcacataaaggattctcaaaaaacttaggccttatttttaagctacattacaatttgttggctaggtcaattttttcagtgatattaacatatttaagcttctttgattatcaaaaacaatatcaactgttgtagaaatttgaaaagttactaaatatagaaatagcaaatgaaaagtgaaactactgcaaacctatgcagaaaattattaagttcctgtaaaaatgattactacttggttgaaaaagcatttagtagaaatacttcactattaattacttttcaacacaatccacatagcacacctgatattcatctttgggtggcatagcattttaaaacaaagatatcagaatcaagtttgacctcatgctggtgccatgataatcctattattatatacttcaagggatcagaataaggtggaattgactagtaaaaggtcaagaaaactccaacaaatataatagcagatgaaatttataatacaatagcagatatgttaaatgcatcacagtatataatagacactactcctagaggtgagacagaacacccaaggaagaccccccctcctcagtcctgagatccaggtcatgttgggtaaggcaggatcttggctccctaatgacgaagaacacatatgatggcacattgtcaatacctgctagagatttgcgatctgaaactcgctgtttaatcttccctctagggggcgctggcaaaagctattcacaaggaggcgtctcattggaagcactctgttttaaaataagtttagaggggacactggaggaatgcaaggtcctgatgactgttttcttgggccatttccaagggttggggtgcagggaacaattttgagggatgttcaggaactttggaggatttcctttctcaataatatattcctgtgccttcctagtgtgttcttggctgaaaacaaaaaccaaggattatgccactccactggccattctaattaatctgactgacagaggctaggactaaatatttctgatagcatttaattaaggctactctcaactgaattccatccatcatgatgaggccaacctgtagttttgcctgcaattacgcgccacccgcaaggaagctagacttagccaactgtgaataaatttcagaagggatcaggaggtctcatcttagatagcaaagacatcgtttaaacccagactatatcaatcgtgacctgtgcaaagaaatttaggttaacctgccaaactttggtgtcactgacaacaattaagaggacaataaatgggccacaaagaatccctgtttaagggagtgattctgtggctgccaattgacccacatagaaacacagaacaaaaaggagcacaagtaactgggatttgttgcaaaatgtgatttggaccaccatcacactggattggtgaaaaaacataggcagtatcaccaggaggttgcagacttcactgtcagttattgttttaggaagagcagaaaaatttaagaccagctatgttcacacacaattttctgtttttgtggcacatggacagactacaatcccagcagcaagtcacactggcagatggagttgcagtttgattaggcagtgatgtccatcccagtccccttttaaccccttggatctaatctcaggtactaaagttgttgctctccctgcaccatcacaaaattggtgtgttcctttttagtaccgataatttcacttttcctctagttacctcctatttgcaccgagatttttcatctgaaagagtcaggaacaagaaggacaagagcatttttaatccatatgaatgaattagaactaaattagaatcttccaggcttcttttgttcatgctgccatgcaaaatgtataaaaccaagctggcctgaggttgacaatccaagaattgtcaacacaaaattccaaaatttaaaatagatttatgtgtcccctaccacagctcttttgttctatttttcagaaaacagccaagagatgttgatactttttagggaggacagccatatttagtgaccaaactatcttattaaaatatatgaaccaagaggagatgaaagaggtagaattagaaatatttttgagttgacttttcatgaggttatcccaatgctcagcaattccagatgtctgtaggtgacatgcaccatgcactgtggcctcctttaccatgagacaaatggagtaactctggacaggagtcaggtataacatgtgtctgtatcaggagtgcaacttctcagaaaatgaatcataccatgaggatcttacattagttggccaggcaatctgatcagtggtaccattgcttccacaatttggggccccacagagggatgtcttttaccttctagcctataatcttcctgctgaaaagtcagcaaaaatagtataaccagtcttgtaaaggagagcattggctagagctatgagcgtgaaattaagttctgcccactgaattgagtgcttaccttaattttcaattctgcatagctgtcactgaatgtggacagtacaccagcccagtggacaaaattgggtttttaactcagccaaacttcagtaaaccatgtctgtccacatatttaggggaatctatgtgaactgagggcttaacacagccaggggcttcatttcctgtgggagaaggagataagatttcccacaaggaggtagttgacactcctttgtgtaaaactaagatggcactaggaccttgtaattgggtataccatgttcacttgactaagcaaggccgactgggccatttctttgctagtcatcaattctgtgtggagatattaagacagaaagcaacaaggcatttgcaaggcaggtgaaagaaagaagaaagaaaggaaggtaggaaggaaggaagggagaaagagagaaaggaaggaaggagggaaggaaggaaggagaagaaagagaaagaggaagaagaaagaaaggaaaaggaagaaagaaagaaaatgaaagagaaagaaggaaggaagaaaaggaaggaaagaagaaagggaggaaggaaggaaatggacagataacacatcgtacctacatcaggctggcagcactgctgtaactgaaaaataacctttgaaaactcaggagctaccaagtcttcaataaaagttgttctttcctttttcttgtgggattctctattgttttgttagactgcatgaaagagagcaaggatcacctctccacatgcacagtccctgaacagaactatctcctttgattctttatgaatatgtacagtagaatcacaataaggcacattaatatcaattatttgtttctgcacaataatgtattgaattgacctagaggcctccatccacccatcagttggactcaggcactatttctttttttctaatggggatttatatgccccttgtatcagggggctgaaatagttgccaagataatatgctatgccctggcttagcaagaagaatataagcagaggctactgaatgagggttggttggtggagggggagattagcctcagaaagatggctggggcttaaaaggcttttttggtccccctgggtggatgccacctcatgcctggtataccttcaaactctttcaagtgtcgtggcccagaggtctcttttttaacctccttttcccaatgtatattctcttccttgcaacctgcagtgccaaccctgagaacacagaggctgtggagattttttaattttgtcaaatgcaagtatgaaagtgaaggatgctttgatcattgcattatcaatttaataccactgagttatctatgatcctggcctacaggggtctttggcttaaatgaaatttttctgcttctacgcagcacgctaggcatgagaaacttcaattcttgatgagaatttgagactagaaatttctaaggcaaaatcttttttaattaatagaaattatgattgcccaactaaagactgagcaaaatctctcaaatgttctcctatcttacactctctggaaagatagtttctggtatttttggaggaaacctgtctatatattaatatatgtctagaaagataggttgagctatattttagaagttgttaaatactacaggatattgggttgtattcttaaaactatgagaaaaaaagaaagcctttaacaatgactttagatgatacatttatattccattaagattactctagcagcattagagctcattttttaataaataaaaaggctaggataaagaatctccattaaaaacccattagaataaccttgagcagatatgttgaagtcttaggccggggatgtaactgtagaaatggaaaaattactcctctggggggtaaattaaagaaagataaacagggcaagctgcctgttaatggcatgggaaaggaggtaaagcagaagaagcagtgtgagaaaagtgtggatgccttagaggagggtggagccattaaaaggactaggatacaagtgagcgacaacctacttgacaggatttgagagaaagggataaaatagactgcgctgaatttgaagtttctgtgcaactttaagaggaaatgccaattggtggagtgactacataatttatctaccattcaaatgagtatattttaaagtgaaatgaatgcttgtacgtagttattaatagcaattgacataaattcagactatcccaagtgagttgggatagattgccagcccacattgggcgctatatggcagttgatctcaggagagagattctagttgacatttttaacaatagcggtacatgttaataacaccccagaaaaatgtgtggcgatggatttgcgtttgtctttatttacagcaattggcatatcacttcacggtttattaagagttttattggatatcaccagatttgataactgaaacctaaaaagcagggagggaggtcccatcctgcactggtaaaatatatctgtttcttcttatatccttcaaaatatttaatactatttgaatactgcagtaaactataagctccatggaggtttttcttgttccagctaaagctatatataccccaagaagtaaatacaaaattcactgtgacaaatgtatcattttggaagttgttaggatgtaaattatctgactctcaggaaaacattttggttcatgttaattgtgtctttgagtctactttctgagatgtgttctctgaaggagaaagagaaaagattgtgggaataaaagcaggaagaaacctataattatattgtatcatgatatcaaatagaattaaaaatttgaacatgtataaggaccctcagataattataacacagtaatctaatctttgaaagtcttcaaatctatttctcagaaacaaatagaatgaaaagcagctatcctctctcccaagattgctatagcagacatgagaaagggacaagcgtctttatttttttttatagctgatttaaaccttgccaaaatccactatccagatgctcagagaaaagatgtaaacatttcagttaacaaggtatcaatattttctggtttaaacagtccaccttttagtaagtgcttagatattcagctcctccctccccaccttttgcaatccaagatggtgtctgaatatactgcagagctgctcactttttgcacataataatgtaggaataggatcttaaacgcaagtgtagttatttctgctcttcaggttcttgctggcttctgatgatactttctgtggtcctctgaccactgttctacctgcacacttatgatgttaaggtcttcagagagtgaacttgtgacatgttctttcagcttggtctagatactgtggtcttccctgttgacccaggatggcttcagctcctgctggcaatagttataccctggaagtctctctgaaacatttgtccattcccaatttctccttgtaacacttgagcctttccatacagacctaactcaaagcctactaaggtcgcaccttgcacgttctcatctcttccacattcatgcatagaatttgtgagaacatctgtacaacttccatataatgtgacattgagggtagactcccaggagctaaactctggcctctgtctgcctatctagctactgtttatacactgactagcttgtccaggttggcataaccacccccctcccaccccaccccaccccacacacaaagaaaatgtcctcaatgtcttaaacagggaatcagatgaaaaactcctgtgtttcaccattcagagactgggggacagggcgaaaaggagagggaaaataacattgcatacatgtcaccaccttctccttctcacaatctacccaaagatggaataagcaggttttctgtttcctattcctggctacatgagatttctcctaagtctatccccctttttttttttttttttcttttttctgagttggagtctcactctgtcacccaggctgaagtgcagtggcatgaacaagactcacagcagcctccaatttctgggctcaagggatcctctctcttcagcctccctggtatatgggattataagcctgatccactgcacccaaacccctttctttcttttttttaaatttattattattatactttaagttttagggtacatgtgcacaatgtggaggttagttacatacgtatacatgtgccatgctggtaagccgcacccactaactcgtcatctagcattaggtatatctcccagtgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactaagaatgatgatttccaatttcatccatgtccctacaaaggacatgaactcatcattttttgtggctgcatagtattccatggtgtatatgtgccacattttcttaatccagtctatcattgttggacatttgagttggttccaagtctttgctattgtgaatagtgccacagtaaacatacgtgtgcatgtgttttttagcagcatggtttctagtcctttgggtatatacccagtaatgggatggctgggtcaaatggtatttctagttctagatccctgaggaatcgccacactgacttccacaatggttgaactagtttacagtcccaccaacagtgtaaaagtgctcctatttctccacatcctctccagcacctgttgtttcctgactttttcatgattgctattctaactagtgtgagatggtatctcattatggttttgatttgcatttgtctgatggccagtgatggtgagcattttttcatgtgtttttttggctgcataaatgtcttcttttgagaagtgtctgttcatatcctttgcccactttttgatggggttgtttgtttttttcttgtaaatttgtttgagttcattgtagattctggatattagcctttgtcagatgagtaggttgcgaaaattttctcccattttgtaggttgcctgttcactctgatggtagtttcttttgctgtgcaaaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaaatctctaatccatcttgaattgatttttgtgtaaggtgtaaggaagggatccagtttcagctttctccatatggctagccagttttcccagccccatttattaaatagggaatcctttccccattgcttgtttttctcaggtttgtcaaagatcagatagttgtagatatgcggcgttatttctgagggctctgttctgttccattgatctatatctgttttggtaccagtaccatgctgttttggttaccgtagccttgtagtatagtttgaagtcagggagtgtgatgcctccagctttgttcttttggcttaggattgacttggcgatgtgggctctattttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagagttccttcacatcccttgtaagttggattcctaggtattttattctctttgaagcaattgtgaatgggagttcactcatgatttggctctctgtttgtctgttattggtgtataagaatgcttgtgagttttgtacattgattttgtatcctgagactttgctgaagttgcttatcagcttaaggagattttgggctgagacagtggggttttctagatatacaatcatgttatctgcaaacagggacaatttgacttcctcttttcctaattgaataccctttatttcctcctcctgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaatgccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcggtttgccagtattttattgaggatttttgcatcagtgttcatcaaggatattggtctaaaattctcttttttggttgtgtctctgccccgctttggtatcaggatgatgctggcctcatcaaatgagttagggaggattccctctttttctgttgattggaatagtttcagaaggaatggtaccagttcctccttgtacctctggtagaattcggctgtgaatccatctggtcctggactctttttgtctggtaagctattgattattgccacaatttcagctcctgttattggtctattcagagattcaacttcttcctggtttagtcttgggagagtgtatgtgtcgaggaatttatccatttattctagattttctagtttatttgcgtagaggtgtttgtcgtattctctgatggtagtttgtatttctgtgggatcggtggtgatatcccctttatcattttttattgtgtctatttgattcttctctctttttttctttattagtcttggtagtggtctatcaattttgttgatcctttcaaaaaaccagctcctggattcattaattttttgaagggttttttgtgtctctatttccttcagttctgctctgattttagttacttcttgccttctgctagcttttgaatgtgtttgctcttgcttttctagttcttttaattgtgatgttagggtgtcaattttggatctttcctgctttctcttgtgggcatttagtgctataaatttccccctacacactgctttgaatgcgtcccagagattctggtatgttgtgtctttgttctcgttggtttcaaagaacatctttgtttctgccttcatttcattatgtacccagtagtcattcaggagcaggttgttcagtttctatgtagttgagcggttttgagtgagattcttaatcctgagttctagtttgattgcactgtggtctgagagatagtttgttataatttctgttcttttacatttgctgaggagagctttacttccaattatgtgatcaattttggagtaggtgtggtgtggtgctgaaaaaaaatgtatattctgttgatgtggggtggagacttctgtagatgtctattaggtctgcttggtgcagagctgagttcaattcctgggtatccttgttgactttctgtctcattgatctgtcaaatgttgacagtggggtgttaaagtctcccattattaatgtgtgagagtctgagtctctttgtagttcactcaggacttgctttatgaatctgggtgctcctgtattgggtgcatatatatttaggatagttagctcttcttgttgaattgaaccctttaccattatgtaatgcccttctttgtctcttttgatctttgttggtttaaagtctgttttatcagagactaggattgcaaccactattttttttttccatttgcttggtagatcttcctccatacctttattttgagcctatctctgtctctgcatgtgagatgtgtctcctgaatacagctcactgatgggtcttgactctatccaatttgccagtctgtgtcttttaattggagcatttatcacatttacatttaaagttaatattgttatgtgtgaatttgatcctgtcattatgatgttagctggttattttgctcgttagttcatgcagtttcttcctagtctcgatggtttttacactttggcatgtttttgcagcagctggtaccggttgttcctttccatgtttagcgcttccttcaggagctcttttagggcaggcctggtggtgacaaaatctctcagcatttgcttgtctgtaaagtattttatttctccttcaattatgaagcttagtttggctggatatgaagttctgggttgaaaattcttttctttaagaatgtagaatattggcccccactctcttctggcttgtagagtttctgctgagagatccgctgttagtctgatgggcttccctttgtgggtaacccgacctttgtctctggctgtccttaacattttttccttcatttcaactttggtgaatctgacaattatgtgtcttggagttgctcttctcgaggagtatctttgtggcattctctgtatttcctgaatctgaatgttggcctgccttgctagattggggaagttcccctggataatatcctgcagagtgttttccaacttggttccattctccctgtcactttcaggtacaccagtcagacgtagatttggtcttttcacatagtcccatatttcttggaggctttgctcgtttctttttattcttttttctctaaacttcccttctcgcttcatttcattcacttcatcttccatcgctgataccctttcttccagttgatcgcatcggctcctgaggcttctgcattcttcacgtagttctcgagccttgtctttcagctccatcagctcctttaagcacttctctggattggttattctagttatacattcttctaaacttttttcaaagttttcaacttctttgcctttggtttgaatttcctcctgtagctcggagtaatttgatcgtctgaagccttcttctctcagctcgtcaaagtcattctccgtctagctttgttccattgctggtgaggaactgcgttcctttggaggaggagaggcactctcctttttagagtttccagtttttctgctctgttttttccccatctttgtggttttatctacttttggtgtttgatgatggtgatgtacagatgggtttttggtgtggatgtcctttctgtttgttagttttccttctaacagataggaccctcagctgcaggactgttggagtacccggccgtgtgaggtgtcagtctgctcctgctgaggggtgcctcccagttaggctgctcgggggtcaggggtcagggacccacttgaggaaacagtctgcccgttctcagatctccagctgcgtgctgggagaaccactgctctcttcgaagctcagatggaaatgcagaaatcacccgtcttctgcgtcgctcacgctaggagctgtagaccggagctgttcctcttgggccatcttggctcctccacccctttctttcgtgaagtgattttccccctgcacacttatgtagtgtctattatatgcaagagttgttctaaaagctttacaaaaattaactaatttaatcctcataatagcccataggataaatactattatttttctcattttacagataaaggatttagctagatagtagtaaagccaggatttggaccaatgcgatcttgctcaaatcaaagcttaatcactaggctgtgtttcttctttgttaggtggttaggtggcatgactgtgagaaaatatgaattacacattcattaatttaatattttcaaaatattatttaagctcatttttttcctaaggtatcaaaatgaacaagaggatatgggaagattgtgtaagtcctgaagatggtgagagatgaaaaagaggagaaatccacagtagaagaataggtggtgctaacttaaacacgaaaaagaagagtacataataacattaagaaatggtccttgggcttaacaatagaaaggtccattaatacattcattagtgaactaaagtttgaatccaggccttctatgctgaaattttctcctgcttcctattcttcatattcattatgaagtccgcttttcatcttatatataacatttaagtgctcttctctcttgtttagatttgtttgaagtgattgcaaattgtctatgtgataagacagaaataggtttattaatgatttagttcttgcctaaaacataggtttatttttctatttcctaaccccacaccatgcaattgcattttatgaaaatgtgaaactgaattattggtagttttctttaaatatgtcccttaattcccttacatttctggcctttgcacaaaatggcctttctgcttaatgagcatcttactgaattctcttggtctctcctcttttcccattgtatgcacaggcttgtctctttgaccactttctgtggtcctttaggcatcagccttcttgtgaagactttctttcttttttttttttttttttgagaaagaatctccctctgtcatccagactgagtgcagtggcatgagcatagctcactgtaacctcacaatcctcgtttccagtgatcctcctgcctcaccctcccaagtagctaagactataggcatgtaccaccatgccttgctaactttttttttttcttgtagagacaggttcttgctatattgcctaagctaatctcaaattcttgggttcaaacaattctccttccttgacctaccaaaatgcatgagccaccacatccagccaagatttttgatttccagagaaagtttctgcttccttttttgagaatgaaagtagttactattaacaattgcactagtacaacacatgtaagccaagtctatactggcttgcaagaaccaattttgaaattttcaagaattcagcaaactggctattaagcccatcagtggcttgaaattgactatggtgggtgtatttgtatcatggaaatctacaaacacaacaaatctgtttttgttattgttttgtattgttcttctggagagctggtttatcagcacatctatgaaaataatacatctatcatacaaatatataagtattaatataaaatgataatatggttaatgtaattaaggtaacttaggcaaacaattaaggtgatgctatattcttcatatttttacccactttataaaagacagtttcatttctctaaaaaaatttccctatagtcaggctagaacttcaagggaaaaaaatctgtattctgaagaattaggtctgcatttacatacgctatcatcagcaaacagcacagttatagaactatgaaaattgcagacctttacaacctggcctttgattaatgacttaattaaagtaggattaatataaatcttttggcaagaaagaatgctagtgaaagtggaaaatattctggcaatttacccttttagcaatcattgtaagaggcattgataacaggatgatagagtcaaacacttgaagaactcctggaggaaaggctgatgtttgcaagctatgcaaaaagaaacaagaagcaaagaaataaaatttgaatgaccactactaagccaatgtataatataacatacttttaataaagacccttagcaaaaatttctctcaggtcttggtagcgggcaaagctgactttccatcattaattgtttctaactttatgcacactatgaatcttgtaactaatcctgtttgttttccttttttgatctgatgtctgggagattagagctatatttgtagcctaaatatttaatgtatggaaccatgagggcataagtgtgaatgctaacccaagtcccacgtttactcttctctatctttattttccttttgtctaattcttttacctttatttcttcttttgtagtgtatgcatttttgtaaatcaccctaagacctttttattctgaaatggggtctaaataaatagcacaggcatgagatgggcacagcagctagttctgtaaaccacagttgcagtgctggtttcaagggactattgtgcccattatttcagcttctgctaaaaaaggccctagcatactgatatccaaactaattttgtagttatgaaaattaaataaaaaaggttgggatgtgatcaatgtaatatggtaacaaaggaattactagaggccaagatttatccttcaagcccccctgtagttactaacattggaaaatgactggttaatgacatgctggttgcttgggcaaattatgtcttccttgatgtcaaggacaatgattctttgggtaaacttttctcccagtaacaggaatacgatggtaacctaatgatgcagtatagatgcttatttttagcctatactattactccacaatctaagttatagttacgatagttcaactatacatgttagtgtaaataaggctttacatattaattttaacagtcatatagtatgtgtgatttacttttaaaaggcaaacatttgttccatcagaatatatacctttaggctatgtatttagccatcatcactcagaaagaccccaaaatgtcttaatattatgtgaatgagtgcttgtacctctggagaaaagctgtggcatctaatattgatgttaattcaacgggataaataaaatacgacatgtaagagtccataaaatcaatatgttgatattgatatactgttttatttctatgaatttaagtgtttttgtacctaaactaatttaaatataagtatgtattgatttatatcatttatatacactttagctagctaaaatgcccccttttcttctcattggactataactgatatttttacaaggttagaaaattcagaatcctttatagaagatggcaaggtaaagaaatttgatggggaataggaaacaaaggggatacatacagagttacagatattgatattttaaaatcagcttttgtccgtaggcttatttgtgtaaataattctgctgggattagagagaaataataggtaaacacggcctagattttgaaataaacctagcctgtttcacaacaaatccaaaagagccagtgttaattcagcaattactctacattaaaggcatatttagggtaagtacttaaattgaaatgtgacatattttaggacagacttctaagtatttctttgcattcacagacatgaagccgctgaagtcttcagtgtagcccagactttgtgtggtgctctttttaacagtgttcactttttaaaattttaaactatgcaataggccaattcaaaagacaaaaaaatactacagttttattttacttctctttaaaaacatatacatgtattagcatggggaagatattgtattttcttataacttaaaatatctactatgtaaggtaggtaaataaaatttacactggcatttagccggacaatactagaatctggctaaatctgtggagaagaacatgaaggcaattttgtaatctttaattctgtacatatacctttatagaaatcacaatatgttcagattaaatatctgattttagctcttaattgaagtggatgttattattgccattttacaatttttactatagggataaattataaaatgatgtgccaaaggttacatggtgatagggctagaagtaattcattctatttaatgcaatatttttctcagcagctgttgtttatgcaaatagtcatgctgggcactggaaatacatggtatacaaaattctgttctaacagttgtagagaaaaaaggcaatagaccaagaattctgtctatgtccaagttggctgttttagaaaatttatttctctcattcctgattatttgagataaaagacaactgaaattattatatcatcaactgcattagaaactcaggaagctgcatgtgaccagagaaataggagcatattttaacagagaaaaaagagacagagagagggtgggtgttgggggtagagagagataaattatgagtctctgaaacgtcagactcaaccatgttaaaatatgtaatttcacgttgactctgcttcttgccacatttatgctgccatttagcatttctataaacataataaactgatcatatgtgaaaaccttaatgtttatgtaattacaatttttttatatataaatgaataggtggtatgttaggaaacagtttccatttttcttagaactttgtggcatgagtacatgattgaaatgggaaaagaatgggtagaagttttaagatacacttctttcctccacattgttctaagataagaggttgcagagcaggcttttattatcaggctgaaatactcaacatgtaaatgtgaaaatagttactgatttttatccccacctgacagagtaatgagaaatcatcttttcaaatgaaaatttatttttgaaacattgtgtagtgaataacaatgcattttaacttaaaacttctaattcagattcttatacagtaacataatatttgttaaggaagaacaggtatttggataaagaaattgggaaagcagtgaaggtgttgatagatttttcaaactatagacaatgttcgaatcttccatacatgtgcttaactgaccataaatttaaagtagattgcaatgaaaaaaataccagtctataactaaagcttcttatgataaagatcaaaattaactattgaaaaccaataaaaaaaatagaacaaaaatttcacataccatttgggaatagaaagaaactatctataaaatgtgtaagtcctcaacattattttgaacctatccttcagccttatcgctgtgtaatttgcaggcaccaataggcatctgccctgagaatagattattagcactttttgcctattttgctaattaaattcaagtggtatataaatcccacttaaggtataaagtgcagaaggtgaagcagagaaagagaaaaatcaaagctcatgaaataaaagacagaaaatgtcttccctcgagagtcaatattcaattacttctggctctatgatataaaaatgtttttaaataatattttaatggtaactactgaatcacctttggaacaaccacttaagtaaataatagtctttaacatccctgtgaacaatgtggtaaaataacatgaatgacatatcacatataaaattcaaggcaaactttcttctgtattttaaaaagatggttttggccaacctacggttgcaattctatgacaactctcagagtctgtaattaatgagaaagacaaattgagagagggagattaacacctgtgattcgatggtcattaagtcacaaatgtcctatgtcactctgaccatattttctcattcttcctctgctttcccttaatgcccacaagaccttctaaaatcaacgggttgcaatattagtcattacatcattctgttctcacctcgattagccaagacctgctgtttcttctgcctgattgaagctagtgctgattgagaacaacaagaaaaccttcctacaccttcctaggaaaaataacaaccaatttctttataaatatttacattgaaacgttatttatatgaagtattcttaagattaaacatacctgggtatttcctctgggttccacagttttaatcctgagtcagggatttatagactagtgaaagttctatgaaagtaactatttaattgatccagatttatttagttagtaataattttgctgctctacgttacccaaaaatatactgaccaaatatttggtttggttgctctgtgtaaattctgcttctctttatactatctccattaagtaacagatgattgacctcatgattgtttttactgaaatgatcaagtttaaattactgaaatgtgtctgctaagtggcttgtaaaattttgcatattttctcataaaaaatgtagtttaaaatacagtgacatctcatatgtcaggccactagacttctgccaacatcatatttccaaatctactggtaaccaaagaaagcgtctaagagtcgcaaaacatttggttgaatccgtgtacctaattcccatcttaagcttcatgatttttcaacattaagaaaacaaacaaaaaacacaaactttcccatcaggatactagaagctataaactgaaagaaaaaaatgtgagaaaggcacaacaacagaataagttaaatgtcacagccagaaatcaaaggacaaaaacgcagccatgaagctgtatatagagagaatatcaagggatgctgactgagatgatctgggggtatcaagataatattaaattatattcgatgacctctgattgaattagtagggaaatatatgcttaatctaattcctatacaaagtatcctatactaaaaaccattgctttggtgcctgaaggaataagccccggacttcattgcttccaaaatttaatgtgcatataaaccaccttaggatcttttgaaaatgtggatgcttgtttggcaggccaggaggtgtggtcatgattctacgtttctaatctagctaatgccactaggtttttttttgtttgtttgttttgttttgtttttttggcaagggtatggaatgcattaattctcaataaaataaggtagatgagatgttactgtatttgatctcaaatattttcttggaaatctgaagtaaaaacatactactcttacaagtcggcaagtttatgtcagtacaattcattcactttggaaatgaggaaatagcataataataaacaatttttaagacgcgaaacatgtaagaggggaataaataatagtgcattattcagtccttcaaccatatattaagcatgcatgaggaaatttcattaaaacctgaacttggtcaatactgtgcaaaatttgaagtgagctacatctatatcatactaagtaatattcaatagaattctgaattctcttaatctatattgtttcattctttttacatcatctggaaaataagcaacacacaaggcaagttttttaaaggatattctgttttcatttctacttatgatgaaacactgtgctttgttcaatggtaaaaaatcaagaccatgttctttgattttaaaaaatgcccaggcaatgatttcctggttctggattttaggcacataaatatgtgcattaaaatattctataaataacctgaaaatggaagaagttaaacacaacatttgaagttatgaattcatagcctttataagctttatatattatatacatttcaaccctgccaaattcctttactctgatatgctgggtttacaaactattaaagtctagtgacattaatgtgagacttccctaacctcaccatgtcttccattatgaaattgtcgttctagatgcattactgcttactcgaacctttctcacttccctaaaagcttttgctaagggtgagatttccatgttgctccaaacaattatttaacctcaagtgattaaactaaactaaagtatctaccatatttgatatgagatgaagggacaagagaatattgtaaataatattgataaaaagacatacgacttcaagtggtttcctaaagggtcaagatataaatgtatttatggtaaaatgtgaaaacctttatacaggacaataaagaaagaaaacaagctcatgatttaaaataattaattatttacaggtgattccctcatttactttactttgcaattctagctttcattttaaaaattagggcagtatagacagcagctgtataaactcattgcctgtaaatatcctcttacttcttttttgcccttttggctatggaaaataaaattacatgtactaaaaatgttttgtggagctagaaataaagcataatctatgttaatcaataaaatataaatgattatttagtaattatttcttgtttattaaaatgaacaaaaattcaagacccaacaaaacagctaaatgtttaaacgataggttatttagtgaaagtatgtccaaaaggattttctgggaaaaacgattaattgataacaatgtgagtgcaaatctgtctcttaaaattttaaagcatattgttcaaagttttagcttgtgtgcatgatataaattccatacattgttttctcagtgacaataaaaagcacagtttattaaaaatgtaagtaaaaattaattaaaatatcttttaaaaaattggtcacagttttgtcattggtatatggaggttgttccaggggcccatccaaagctcttcatcatcagactgtgtgtggtcactatgaaattccaaagcctccttgatgttcttactgtcaatcatggactcctgttcaactgtgcttttcagcctgttccttagtggcttcaccgctgtattgtcagtccccacagggcaaggggcaaatgtaaccagagttggtcttgcattcattttttcagtagaaaatggcccctttgataatgtgttcagaggtacattctcctcatgtgtcactgccaacttgtctagtttcttaaagggccctcccagtcgaacaggggaagcaacttttaagttgtccgtgaggcaggcacggcgggttctcaccacagaaccattctgtgcaatatatatattgccgttgatattactgtggatactaggatggtgaagacggtttctctgacattcaggagcactgtcttctccagttgagctggtttcatactctcgatcaacaactaacttgatcattctttttcttgcccactgataaaataaacaaaaatatgtgagtcactatcaaataaattaaaaaggcaatgattacattgcctgtgaaatccaaaacaatgacatttagaaagctgtcaaaggtaaatcactcaagagagatagaaggaagccagtctttattaacatacatttcctttcatcaatcctttattggctttagatctttcttattaatgtttgaaaaatgtattgttgagttggaaagcagacatttcaggaaacacatgtattcttttagatcaaattactgatccacatggaaaaaaatgtattacttttatttaaggagctgatccactatttgacagctgctctactattcaggaaagttaaattgaaaggaatgaacagctttagtatattctgttcatattaacgcttctattcccaatatttaaaaaatatttttaaaccacatcattctaatttttaatgtattctctagttagcgaaaacttttgtataatttaatgcattttgtataatttaagcatttatttacttgactttacttatttacttgatgtataatttaatgcatttatttacttgacatatcctggttttctgggttgtcccatttagatatactaacttaaaaggaaatatcttctcagcctgcatcatttacctagtaatacacaaaactgaaagctaattattatactaaactttccttttgtaagcaactggacattttcacaaattcatttgacttttaccaatcaacattaaaaatagcaagaagcaagggttaagcaatactgtgtttttctcaaaatagtatcgcatttttggaatatgtgaactatcaacacattgcatgcattctcattttcagaactatatttcaaaattatagtttatttacctagaaaaaattttatgcctgttacatttatttttaaatccactgtagctaataataacagaaaataagctgtaataacttttaattaattgaaaaatgttatttcattgaattcctaatacttgaagttgcagatacaaacttacttatttgaacatgttcatgatagtttttataatacctttgccagttgaaacgtacatatatgcaaaagtagacgactgttaaagatataatttgttgaagcttgtcttagtatttattttgaaagatgatataaaaacatatatagtgtgtgtgtgtatatatatatatatatatatatgccatccattccaatagacagagtgtcactgataatacataatgccacattgcattaacaaaaatcctaccagtaaatattaaatattgattagctgattgcatgtgttctgatttactaatataggaaggattagtcagttttactctaatacagtctaatatacaaatggatttggacaacatatatattcacttttctggcatgcttctgatcataagtcatatcaaaatcttgatcaatttcctccctttcaagtgtcactttggagaacacacagaaggcactgcacacgagagcactcatcacagcaaaacttccacctactgtgatctctttcaaagtgctgtgttgtaaccttcagagtttgctcctggcgacttcttttggtttgcattcttgcttctgtcatacgctggtacctgatagccccatggacctccagactgactttcgctactactgctactactacctgattctgattcctcctcactttccacacctccttccaccgaagctgattctgcactgccctcttcagggatatcttgagcttcagggtctgtactttcttccacaggggctggtccactttcttcttcttctgagtgttcttcttcttccatcttaggttctttttgttcttcttgtggctcctctttcctacccttgacttccttgacctcctcaaccatgggccttcttcttgcaagcacaatgtttttccttgctttttctccttctgactctgtggattccgattcttctgattcaggggtggaactctcctcctcctcagagggtgtctctgactcagattcctcttctgtagtctcagactcactgaactcagactcttcttcactgtattcagtatagtcgctggaggattcctcctctgattctacagtgctttctgttgcttcctcttggtccagagtgagtttcaaataatctttatcttcttcctcaaggcgtctctgccactcttcaccctcaaggtcaacgattcctcttttatcagctaatcctctaactttcttaaaaatcatggggaatattctggctctcttccatgttgtgtatgtaggctcagctgctggtggtttttcgatagttacaactacttcttcctcctcactaggctctctaatttcaacctttggttttttaattttctttggctcttcctgaaaattgtgaaaatgcaattgaagtgtcagcttggagatagctatggtatgaccttgtcccacgaaagctacgcaggaatgaatctgtgggtgatagcttcatgcatgttatataactggcttaagaaaataatcacaaaaatttctactgcatatagacagaaggtgattaagagaaagtaaattattttattttagcttgtactttacaatacccaaatatattaatttccttcttgttactcaacgtttaattttcctcttagatcaaataaaaaagaaagaattattgtctcttccttccttccttcttctgtcactagacttaggttaatagctttctgtattcccttgaactaaattttcaagaattttcaataatcacgaaaatatgacgatttatctcattttatgagaaatctattttatgaaattttgcacatgttaaagccacagtgacatttatttcttgttagtgttgtttttgtataaatttgccaagtaaatagtgaagacaaagtataagaattttatagaaatgagtcatgctaatttaaacataaattacattattccttgaaaattatttgtggaaataatttacttttctctgataattgaaaggtggagactatattttttcatgacttttagttttgctagataatgtgggagcaaaagtaacctttgtattgcagaactttaaaatatatttgcttataatatctttatggagcaagatttagaattttagaaaacataattttcattgtgccctttccaaatgtttaacacttttagaaggaaataaattaaatgatcaagaattaattttcctccaaagacaaggcaatgaaacggtcagcactgtgaaatttctatgggaaatacgtactaagtgaaaggaatttctaaaagctgaaatgttctacagccgctagtcacgtagggttaaacaatatttttcttggaatattatcttacataataaaattacagtaattacctcttcctcctcatattcttcctcagcttcaccaaccacctcaccatattcctcctgtccagctggtggtaacaatcgacggcgactcccatattgaggcatttcatacctgtaatataaacttacatctttaaacagtttgtcatgtgatttctgtagaatctaccatgagtgatctgtttccttctttttcttccgccattcaatcgacagatatttacacagcacctatcaggctccttgtaaactagttacaaaactatagagtaagaactgctacctgatgaccagtgatttttgccataatggtaccctggaataacaataaagagagttgagttatttcagatactcgtttttggagaaactagaacgagaaaaaagccatattgtgtcttaactagctgaagaatccagaacacaaaatagatactttggaacagtgtaatggctcattcaccacattaaatctgtatgttggtagcaagaagttgcttcaaacatggtctgtaatggttttcacaatttcttcagtattttttttgaaagtggttaatttatatgtgtacaagtgacttttgagacacttatcagtggattctaaggtgtgttttctgtttcctaactgctcttgggcaaaactttaaactgattagataaaacattaacatcttatatgaaagaaatggtgaatttaggaattgagcaaatatgtttcacatctatttcccatataaataattttgaataattttaccgcatttctagaattgcaatcgatatcaatgtaaaatatcaatatggaactcaatatagaaaaatggttaaaacttggttaaaaataaagctagatatactattcattttcaagtattatactagtgagatcgacatgacattaaaaacaaattctagtaataataatcatttaataatttcctattaataaaatattaaaataagaatctgaattttaaaaatctgaagatgtacccatgctcataactgtaataatcttgtccatattcctggccaggatcaattccagactccatggataattcctattgttcaaaaagaaaaattgcatttgaaaacgaattcttatcacgtttcaggtcaaagtcagatttctacacctagaattccatgattctcaaaacattcctgccaaaataactttaaatacaagtgtcagttaaagcaattaaaattactctatttaaaagtgttagtcaaatctattcatttttttctggctgtaaccatttgatacaaaataaggttatataatttgacctgaagaggaaaaagtaatttttttctaatggcaaacctgttaaaacttgcagatgagcattttcacttgtttttggatgtcttttaaaattatcaatcaatagttaatatttaactcaattttaagttaaattattaagtgatgttggccttaagaaaaattataacactatctacagcattttttttcatctccccactaacagttttctagtacccagtattcttctattcattgaaactgttctgataaagtcatctgagaacaagaatttaagttaatgtgtaatgcttcccaaggatgtttatactttaaaacatactgctgattctaaatttaagggttttttgtttgtctgttttgtttttttgagacggagtctcgctgagtcgcccaggctggagtgcagtggcgtgatcttggctcactacaggctctgcctccagggttcatgccattctcctgcctcagcctcccgagtagctggggctacaggcgcccgccaccacgcccgtctaaatttttgtatttttttttttggtagagacggggtttcaccatgttagccaggatgttcttgatctcctgacctcgtgatcagccccaatcggcctcccaaagtgctgggattacaggcgtgagccactgtgcctggcctctaaatttaaggtttttaaaggaaaaaaagaatttgttagaatagaggtccttttaatatttccagttctaaactctaaacatactgattgatttctgtcaaactctacttatagaaagatgtttttcttgagatatacatgtgaaaacggtttctgataactatcaaatgcaatttctctacatttcccttttaaattctactttaacatgttaagcaggttaaatgacaaaggttaaccaaattcatttcgcaatggaatacgagaagagaggggggaaaaggataggtactcacatgaaaatagattggtacatatttctatcatctattatttataaaaatttaattttgttgatccaggaatagtaatgagtcaggaaataaaaagccctcctctgagggcacaaatatgtcatttgcgaagtgtggaaatttacagcctgcatgattgatatggataaagaccctcagttgtgcttggtgtggccaacatcattttaaaaaattgaattcattactaacagtgctaatcagaaaatgacaccaacactgtggatgttggtttctcttgaaaaataaaaagatggaaacactaggatcatatttttacattccaataatctagttggctagattaatttttacagcaagcatgtcctctcctgtttatgacagtatccccaacgacacttttctacattcataccctagtcactatgaaatctgtcatctgctattgctttgtgtctaataaactccattcacttacattactaccctagatcctgtaggtattgacgcttgcattacttcttctatcttataattttgccgtttacaaatactttgtgaacctactctaaaggaatccaattttgatgttaaaactagtatagtttattcaccagaataactaatatttagacaaacccacgatgaacaatactatgtatttgcagggacacagaagagctaaaactctcatctaagtctggagagattattacttggtaaaactttttagaatatgtttggcaatagtactaaattaaatataaccatttcttctttcacagaacttaaatttgtagttaaatacccaacagaaacatgtacacttgtgagaaaacacattattcgtaacagtcccaaattggaaacaatgcaaaagtccatgagataaacacgctaccacatcgcacaacaacataaatgaatctcccaaacagaatgttgagcaatataggtcaggtaccaacgaaatatattatatcattctatttatataaatttcaagaactgactaaagaatatgttacaggccagaaggaaaactgatatctaggtgttgacatagaagagcttgaggggcatgtgcactctgtaaaaattcatctagttatacagtatggtttatacttttcttatgggcgtaggttttatttcaacaaaaatatatttattataggaaggttgaagtgtgggggaaggaatgaggttaagaaagacctggaagaaactgagacaaaaagtctagatttaagttatttcaaactaagtactttgtaaaaacgtttcctggaggtaagctaagaattttagggtatgtaaaactcagtgtaatgacactggtttaaatgaagcaaataggtctcagaactaatattttcaaactgcttgaccaatgcacgtttaattaaatacatacagatactgagaaaataacttcaaacagttttgaagtagacttttaacaacattaggtaatagtaagaaacacgaaataaaaatttcaagtaaatatttatggagaaataatgcaactgagtggattttggattttagaagtcagcatcaaagaattttctttacataaatactttttcttcattaagggaaaataacgctcagctcttgctagctacaatgcatatggcatcaattgcattaaaaatgtaataagaagtatagaagggatgcggataggaacccaggaaactcagcaagatagcccttgattcaatcagtcactctgtatttctgagttgagtaaagagggataggaactagcagaaggaaatgatctaaaaggtccctcttggatgcttccaccacccatgaatgaagagcagagccatcagtcgttaaaaaaaaatttgaggaaagagcccgggtgcggtggctcacgcctgtactcccagcactttgggaggccgaggtgggcggatcacaaggtcgagagacagagaccatcctggccaatatggtgaaaccccgtctctactaaaaatacaaaaattagctgggcatggtggcacacgcctgtaatcccagctactcgggaggctgaggcaggagaatcgcttgaacccaggaggtggaggttgcagtaagccaagattatgccactgcactccagcctggcgatggaacaagaatctgtctcaaaaaaaaaaaaaaaaaaatcgagtaaggaactgctgaccagtcagatccatgagtcaacctcaaccaacaagggaatgctggccctttttgttgttccacacagtcccagtagactgtaacaaccccttagttgatgaattctagattttagaaaagtatgcaaagtaacacactagtgattttcttgggtagatcaaacacttaatgtaatttttaatattcatttttgctgtccacacagggaaaacatagaattaacttaatatttaattattataaacatttatactgatgcaaaacaaaaacaacaacaataattgtaatttactgaatttcttcctgttacattccagttgttgagctaggaacttacacatttattagatattactgctaacattttatagaagatgaaattgatgttcagcagatgtgtatcttgactaaggtcttgcataaagtcattggtgtttggatttcaaccctgagttttccaattcaaattttatggagccctctccatggaaatttttgctaaaaccttataaaagtttaatattcctgccacacaacctccagattttggagagtagattctaaccaagaaatgcctctttttagcaaagacagaattctgtactcaaggaaaaggaataaaatttttgtaagtggagcttatgaaatactaaatttgccgtaaaattaaaagtaggatgtctgtgtttttatttttaattacatatataaacataataagtaaatacaataatatatatttattatacaaaaaatatctttttcacattgcagaagaaaatgccataggcaattggtaatatatgtgtccaaaagaagtattttgaatcacataaaatgatatttaagtacagatatcagcattctgtctttaaactttgcataatctaaatctgatgtcaggaatggatagatgaattcagattgattaagacaagtaactgctgatcgggttcattaattgcttcattcaatgaatggcccgtatttattaggaataatgggcttgtctcattcccagagaatgaggctaaaaatttggaagttgagctaccagcaacttcaggaggtgatttcttggtttcttttttttgaagttattttgaaagactcttttcttttcctttaaaattatgccacattggcagacacccactctgcctacaagaattaatacaatagatcttaaagtcacagtgaaggctcagtgaggttgaaaagaaaatgaaaattgatacctctggtttaagaagagagggcctcagcagttgctgttgctgtcaaaggaaattaaaatagaaaaagatttagaaaataattcagatgggaaaggtagatcatgattgagaagagaggaaaaaaaggcgacagtttaaaacgtgtttccttgggattattcattattcatgtgttagctaccaaaagcattaaatattttaactaattctttatattggaacataaaataagaattcatttgttatgttttaatttcatcattcttctagttaatgacaaatttaatagccttaataaacaggaatctatacagatttttgttttgttaagctccacagtacaaagagttatttatgtttctaaaagtactgtgtgtcatataattacttttatcaagtttaaccttgttttaagttgcccttctttttttccttcccaatcacattaaatgtgataagattcattgggaagaagagcagaacacacaaaacgataaagttgtaatgtatctatcaacatattgaagacatgctctccatttcttcttcttaccaaagtgtggatttcttgcactaaaacattaagtgtgttttcagaatgattaggaaagtcattaattatcagatttggtaggaattgcttcctgcctcttccttctttcacttgtatttatttaaagctaatacagtcaccattgatctgtttcataataatacacactttaaccagataaaaacaagatacacaattcaaattttggggttagtaactctttggagggaaaacagcatattaaactaagtattggaaaagtgggtagtgaggttctgggaggtaattccatcattgaacccactgtttaaactggctagtagaacaaccatttgactgaagggatatcctttttataatacagttgttggtgagttagttattttacttataatgaattctaaactacaatccaattaggtcgtatacttctcttgattgagaagctgtatgctaaatcaaactaggttcgcagtgacttcattggtaacatcacctgcagtacagctggccaaatactactggccagaatgcccagtaagttctctgcagacagaatcaaatgaacacagtagaaaacccagagctttctaacattctgattatttttaaaatctttaggatctcaagctttaacctagtgataggatggcgccttgaactggtaaaaagatcaaaagttaagtagtcctatatatatattctttgttttttttttctttttcttttttttttcttttttttttttttgagacagagtctcacttttgcccaggctggagtgcagtggcctgatcttggctcactgcaatctccgccttgccggttcaagcaattctcctgtctcagcctcccaagtagctgggactacaggcagtaatcctagtttctaaattatatgtatagccttagacaaataaattttggggaaatgtcagaatactgagtaatagtaatgcagaacaaaatacatgtatccttaaaaaggtaagcaagtgatctttgaccattgaataagagatttaaaaccttaaaacagggaagcaacatatataaaagaaaataaatagcataacatactaatatgtttttgctgaaatcaaagaaaataaactagttcaaaagaatgtacattagtcttgcctattacacaagtattttcctagtatgcttgttacgacatcaacaccataaagcccttacctctgatccataacctctcctgcaaggcagaaataaataaatcagtattaaacatcttagattttcgttattaaacaaaatgactgacagataagggctttaaaaaatgtctgagtaaaactgagaagacaatttctactaaacactatctcagtgggaagtatattttgtggaattatcaaaacaggaagatcatggtttcacacctgaattactaaaataatgatcaacccagagcctcgttccatatgagcaacaaaacatgcaaaatctattttatttcaatagtgtataatgacaaactttgactctattattatcaatcaatttggataaaaaatattatacatgatctctgttatacacaagtcttgatatatatactaatccttaggggaagagatatgctttatacatgaagaatgtaataaacataggatgaaaattatgtctatgattgaatatattcttccaaatgattgtatgatattttctttatgttaattctaaaaataatacaaactattggctgtccttgcagggtcaattataatattagaaattaagtgaagaagtttttagagctttaatagccaaatattcaatattacataaagatttataaagttcacacatcacaagatggtgaaacgtttgactatacttgagggggagaaaagaatatagagttttcaaagttgaatgttactaataaataatgaaaatgttctatgtgttattttttaagcagttaaagtgttaaactgatgctgtcaaccatgttatgtagaattaatcaatcagtgtaatgaagaattattacaaagaggcacatattacaaagaggcacatgcataactttctaaaatccaacaaaagaatctctgtagaaaaatttttaaaaaatgttgaggccttcacaaagtaattctacttatcagaaagcatcttgtatggtttatgcattgtatattgaaactgtttgtaaaaaaaagtaaatacaatgcttacttaagcttctcaattgattctttaaaatggttctgcagtgaatttcgtagagtgcttacacggttctgccaatatttataagactgataattcttccagagcctttagaaattgtagacattttcaacttttaccaaatttatatttttcagaaataattcaggtagggaaagctcatatttaggtttaaacaatgacaactgagtcatataccttataaaatatccaaccaaagccaggctttattttttagacgatttcttctgactccttttattagcaatgttttccatcaatgtgaaaaataaaatatcaatagataaactataactcaatgttaatgtttccattcacatttttgttgccttttatttggttatttgtattgcttgtcttggctcaaaggcagaaagttacttgaaagaggtacataacagaactactactttacctgtgtgctttcaaaacatgactattgatacttataaagccagttcatataatatcgatgcacctctttatgcaattcataatcaattgtattatttattttatatcatgtatatgtatcactgtttacttttaacaataaggacaaatgtttggtcatctttcttaagtctttatttaaaaggtatctaataatttcttatgcattaatgagatcataataaatattgagaaaaaagtgttacttttctcctctctggttgtcaggttgtaagcagttagggtttgagaggaggaagaatatttaggcttgtgtactcaaataatactaaaaggtctcatatagaagatattttaactgacttttataatgtatcataatgacattaggaatctccaaatacaatgtgtcagaaaaagactggcttaaatataaaacacaggtatctatgtttcaattaaaaagtacagaataataacaaaactttcagattatgtaaatagtaaaatgttatagaaaaaggcaatataacaatttaatagggctgtaggtacctacacaaatatgttttttggacttctcttatttcttttgttactatttatagatttatcaagaaattataaattttacatttgcaaaaagctggtgtagatattagcttagaaaagacacactcacattaaaggcttacacaattgtgaataccttgtcagagtccgccaaatagcacaagttctcatgcatatgaccagctgccaacaaaaactccaactgaagtttttcagtgaaagaaagaaaaaaatcacgttcaagaaccccaagaaagtaattactcttgatttcgatgaaaagattttgaagcagatgggctaataaaaataatcagatttacagattgttttctgtctgatcttggtaactaggaatgccaggtcaaattattgaagaaatatgagggatgaagaaaacctctgaaataacgcattgaagggggctctcaacttatattcatatacttccaatagtaattatcaggtatgagttttgcctgtattttagaattgtacccttctccatgcaaacttatatcttctaaaatcttaaaactccagagtgttttataagtatttgttttaaacacttacatgtgcattcaaaatgtgaacttccagtaaataaaacctattccatgtgtttcatgggaaaaacaaagtaattacttgatggtcacatattatacattatatactaatattgaaagtatagtttccttaggaaggaagggacatagatagtatctagcttaagtgatgctgttcgaatttaacaattggagcgctaagaactattactacaactacagaaatctcttcccagagtatacagttttattttctttgtttaaaacaaagagcagaaacctaggtaaaagagtgattgatagttcagcaaatatcacttctcttggtttttctatttaagctttttatatttcatttattaaactgaagatcatactttctttaaaaaggaatcttatgaaaaaatttaaattagggagatgattaataatatgaacaaacaaaattaaacagcactttttaagcatctgttggaacaatgaaatgccttacaaaagtcaacgactcaagatttattttcattataaagaagggaagggaaagcacaatgagaaataaagagaataagacagcaactgaaaaagtataagatttatcaaatccataagcatactactaaatccataagcatactactaagataaaagcaagtcagagtaaaagatgttcttatcagaaaacagatgactacatgttatagcacctgagatttattttgaaataccttatgtctgtcatctcctacaatctaggtacattatattttacttcggtagtatttcttcttaccaaatacataggcttcaagaaaaaacagaacctatcaatcatatcagttttaacttatttgtaacagtctgcttttttcttggaacattcatataaaactacgatcaaaaactaaatgtaaatgttactgcatccacatgatagacatgcctttggtttaagttgggtatctaattttcatgcccacatattcccactaaaaaagagattaaaattacttacttttcaaataaatgtagaacaaattatgctactttgtagtttttaaaaagtaaggtaaatctattatatgagtgagttagtagtgatgaggttaatatctttttaaattaaaaacgagaaaaaaaactgcatttcattgaatttggggtaaaataatagagtcttctttgacgttcaaatttgatgttcaacttgaagactatgatcaacaagaggtttgcccgactaaaataagaaaagcaacattacagtgaagtagattgactgtgagattgtttttcagttccctcgacaatattgttcaaactccccttgttttgttcagatgtgatttccatatttgttacttctgaagggcacatagtttgaagttctgaaacatttgtgcgtagatagtttttttctatttgactgtacatgttagctactgatttttcaagttctgctaagtttttaacgtgtctgaggatgccttttggttctctctgagggtctgttttacacactgtcgttgttgatagctgtgtcatagaggacttaattttctcggcaggcatcaagttggtcgtgcatttaacacctgttatacagacacactctgtggacagaaatgaagctgaaggaggtggagggcaaggaatagaaggaggtggtggaggaagaggagttggaaatggaggtagaagaggtggtgttgggggaccagacgttgaaacggaaagtggaaaaaatgtaggaggaggaagaggaagagggatagaaggaggagagggaggaggacaaaaaagagaaaaaggagaaatgtcaggaggaggagcaagaggagcaggagcaggaggaggagaaggaggagaaataggaggaggagggggaaggggacaggcagaaggagagatgtttggtggatgggcaaaattttcaaaaatatttctttcggtttcaataggtaacatacaaataggtgtctctctcctagagagtgaagaatgtaaaacacaaggccttgaaggagaaagttccaaggaacactcagcaggagaactgatgacattaggttctgatttgagttccacagttcttgaaacagttggcaaagtggagaatgagaagtgaggcctgggaaagcaaaatgaagagtctgaagagagagatttcaactgttctgttccttctatcatcagtgtttcaccttgccttatttcctctttctctgtcaaatttgcctcttcagttgtaagcaatggattgctgctacctcttttgtttgtacagattccagtgttttcattttcagctttctgcctggtgccttgccactgctgcagatctatgatctctggtctatttggaactttcctcatcagcctcctgggtaagctgactgactgactccacagcctctgaatcttttctcttgggcccctcagagacttactcttggcttgtattttgggtgaaaatgggtctacaaaatctgttctctgtgaaatgtctgaatttgttgatacttgacttatgttttccttataaaggggattatgggcacttaagtcatcctcatcagatagaaatgtgaattttcttgcagacttcagtttgttgctcttaagtgatccgtctacatgagctgacttgtgagcctcaatagtattggaagaaaagggcatcacaacttgttgatgtttcctgtcttctgagactgagttatttcccctgctttgttgaaaatggtagagaaggaaaagacttgaaagaaaagaagataatgaaatgtaaggaaacaagttgtgacacagctttcatgagaaagatgtttttatggctctcattactattaaatacttaaaaacatcaaaggccaaacaacactaacctactaaagcaagacattattttaattccctgctcttagaaaggcagggcagaaaaatcttagagttgtgagaagaatgagaaatgtaaatgaaaaaaaaagtactcatctctagattattttggaagagagtattttttgtttttgttttttttcagctagtgtgatacagcaaagcatccatgtccacacgtaacagttcccttatgcacaaatcacagttcttcccattgcagaacaccatccttgcctgaggatgctcagggctgcctgttacgcatagaagattcttagctgtatctgattcagtacttctgtcctagagccaaaagtaatctcctctctgagccatcatgtggaatatcctgttctccaaattaagagaattaaaatcaccaaggacagatgggagtttgtctcacagcccaaaaatcacaattgagaaattgaatgtatgctagaattgtgacagaggagtttttcttctgtttaaattttgtgcttaattagttttaaaaccttatacataataccaatcaggaaaaattgttttaaaaccttataaatagtaccaatcagaaaagatgttgtcagtaatttcttagactgatctggatcaaattttacttaaaactcaccttaacaaaaagattgatgctaaaaaaaaaaatcactttttgatatcactgaaaggcttacttatgcacggaaactgaatcataggtagttgtgagtcataaataaagttgcatacatcaaagatcacaaattaaatggctctaaggaaagcatttggacccttctcccaggattgttggctgattgataggtggttccgaattctcattagcttttactctcaagccaaaacagaataacatttattttagttactgcttaatatttacccacttagcaggaatgaaataaaaaagaaatattctgaatagaaattaactagccatattgaaaaattagggtgatagtttaggcaacaaaataataaagccacagttgttaatgtgtcttttggcaaagatacgaactataagaaagagaaagaaacaattcacacaggtagacctggagcatcaagcctacttggacaacaaagaaaattcagacaatctggactaatcagagtgcaaacaaacacttttactcttcgaatcttgaaaagtatttttcaaatatggcacgaacaactgggattgatattatatactggttgtttttgtaaacaaacatttgttcgtggtttgatttctcttggtaaagcacccaatggatataacaatatcacatcactttgactaaaagaaatctataaataggtttctatttatagatttgtaaattttaagttcttaaaatttaagaatttttaaaaactaatttaaaaaaattaaaaacaaggagaattttgaaattcctttcagtaggcacaggtaccatcacagcgaacacatgttttaagctcatgccatcaaaaggaaattgggtgtggaagacaaaactttccttttaacagtaagtgagtctgtggcaaaagatgaagatcactgtatttacagtacaacagcattttaatctgttctattgtatctatttttctaacgctcttctattagagtgatattatttacttacttatgcctatgtatccacaggtgagaaacagaaaacatgtgatagaaaaaaagaagtttttactagagttaatttaaaacaattctgaaaatatgagcaggaacttgctttaaacaaacacttagtacgtatatcaaaaaaaaggcatgtttttatattttgttattattcatatgaatgacatttaatagtagatgaaatcaaatgacattatttgaatgtcttttcacagaaaattgtatctaataaagtctgtttactatacatagataaaaattcacttctattaaacctggatgatgccaatcctaaaataaaaattttaaatgagagtttaaaaattgcttctatgatgtcttaactctgtaaaactggttaatgcacactgacttttaaagtagatatattttgtttggaagaaagtaaatatacaactactatgatgacaattaattacaaagtaattatagcattcataggaagttatcatacgaagttattactttgtgaagtagtttttccaaaatgatctttgactttgttctttttaagataattgataataatcatttaaaactaattcattttctagtaacttaatgcttagaattcctgtaaaaagttcttgaatagatagataggttaaacatttactaaagataagataattaaatatgtagaacttacttaaactatttcaatgaatacatatattacaattgcaaaatctactgagtctactacaattgttcaagtaaaaataatcttaggtattgctatttgaaaattactgtcatcaaactatgctgattccagatgatgttatagtatacctgttcttattaatttaaaatgaatacataattcattaatttcatatataaacacacaactttacacataatccttttttttagtttctaaagatctttgcttgagagaggtcattaacatactcaaatagaatcaaatcatattggctcaattcctacattcaccaataattaattacaaaagaaacaatcatttttcaacttacaaaaaaggtgaaagcatatatctaaagcatgaaccctgtattatgtccttattttggaaatagaatgtcatgctttaacctattataaattcagattttgtgttaaaataatagcattaagatcaattttaacattaatacgactatcctaaacaaaaccttgtataacattattaatatggtaagtaacctgaacacatttgtttaaaaccagcttttccattaccaggtcaatttcatgattttttaggcttttcttattgctactagtaactgatacggatgtcacatgtaataacatgttatagtccttctactccatcaaattccagttaataaaaggttttctggatttaattgtcatattcaaaattgtaaaatattcttggttgttttacatatcatgtccaaaagcagttattcttgaatttttaaaatactgacaaactgaacatcaccataaggaatccaattatgagggtagcatcattatacaagcaactgtgaggtcttttaacagttaccagtgtctttcaaaaatgtatgattttttaaatagtgactacaagtttcaaatcgtgcaggagaaatattcggtaatcaccgcagtctgagagtaataaagtgaaaaaagcattttctaagtagttgggaatttaatatagaaattctgtaatttcattgagattttaatttctatatcatataacgtcctaaaagtagtatctcagaaaatactacgattttaaaccagagaatttggttttgattaccaaatagggatcggtttggatacctaatcaggattactattttatgattgtgctttatttctctcgtctcctatgcaaaaatatatttttcagaatctatttatatatttatacatatatacatatacattatatatatgtaaaaatgcatgaccctgaggattgagatattaaatattatactcaagctataaatgtgcaattgtctcctgaagttgaattctgcttttctcttagctttctttaatttctggtttggttttggctattatttttcaacttaacctttcttagattttcgtcttaacaaattttctcttgaaaataatagaataaaataaatagtccatgtaggcatttccacatcagattgaaattaaatactcaccacacagaattcagtaaaacccaactacttctcagagttcctgaacggtctacttacattgagctgtctccaagttcttcatagagatgcgcacctggcggaggcggcggcggcggcgggggcgctgccactggtgcaggagccggcactgctggtttagccgcgggtaatgcggcctgaattcgtgcagtctttgtacactcagcttgacgtcttggataaagtaaggatggcttgtaaaactcattttagaaatcataatgcttatcaataagccaccttttaataatggggtccagttatcaggggaacccactaaaattattttacacaaacatcaatttataaacagatgtaattacaaaagcatccccacagggtatcatttgcatataatccctgctttgttcttgaaaatagctatctcttgaataaggggtagaattcagcagacatatttgcaaattaaattaaatgataatcttagagaaagcaaaattttaattaaaatgggatggataattaattggtagtttaatgaatctctttcataagatgaggcatattaaagataagatagataatttttctttattatttgtcttttaaagttatttgaaatgatttgaaacatttttgacgttatttcacagaggctgtacacacatgtacaagggaaatttggttagcttgtatatcctttaagattcctaggaatgcctaggccgggcacggtggctcatgcctgtgatcccagctactggggaggctgaggcaggagaatcgcttgaacccgggaggcggaggttgcagtgagcccagatcacgccattgcactccatcctggccaacaagagcaaaaagtccgtctcaaaaaaaaaaaaaaaaaaaaaaaaaaaaaaaaaattcctaggaatgcctgtgattctcatgttacagctacactgctgtttttggatttcctggacactgattaatttcttcctcaaaaccaagatgttacaggatggaagctataggcaaactatctttttcacatttgtgcaagttacgtccaattgtctaaaatcagctcaattctatatatatcaaaccaagaaataaactattacaaacgcaaaacaagggaataagatgtggttctgagcaggctgacttgattgatataatctcgggtttctcttttcctattacatgaaaaggatgtgtaaaatgttaattatacttacactttaaacctgtttgggaaagcaagagtaagaaaaatagaaagctacattagaactattgcattaataacattttaacatctgatttattctaaatcatgaataatttatacgttaaattcataatgacagagttaatgacagactaagaaaactaaggatatcaattcaaaaggtgaaaatagtatcgttaccgttagagtcattcaagccattaaaatatccataacagaaaaataaagaaatgaactacatagaataagaaaactggattaaaatgtaaatgtgagaatttcaactctagtggaaaaatggaatattaaagatgacctgacctttataattggcttcttggtttaccctgcttgaagaatattacaggaatggagagaggtagcaagccctgattatactcttggcttcactttgaagctgaagctacaattggaaggtcctactcttgggtaataaatttatgacagtttttacatatttgctttttagtttccattcatagaaaagttcaaaggcatatcattatataaaaggatagctattcattcttaccttatttgcaagcaaatatcaaggtacaaatgttaggtctttaaatattagaattttactttgctatgtgagcagagaaaaactcattttgtttaattatgttaatctataaaaagcagtaactaaattcatatggtattgagctgattatcaaactaaaggagaattaaataatgcgtctataaattatttaaatattaaacatctcaagtatttgttgtatttcagactaccttgtataacatccagagcgcttcagttttgatcattgcatactgtgccaaatacaagaatttttctcactgatttgcttgctagcaggatataataaagctcctttggaaaatagttaagtgtaaaaagataactggtaatacggaatggatttaacattataattaataatgggttgatggcttaataatttaaaacaatttgttcagtatcaattttgttcatcagctttagatttagcatatcaattgattggttaaggacacattaagctccagtatatcaaccttaatgctgtatttgcaacttcacattgcttttgaggtagaaaatatttctgtagtttcaggttggaattacttgaaaagtaatgacctgcttgaaaaatattaaaggaatggagtcatgcagcaagccctagttatactcttggcctcactttgaaaacggagctagaattggaaggtcctacttctgtgtaacgaattcatgatactttttttcatatttgctttttagtttccattcatagcaaagttcattcagagcatacatttggattttcaggttggaattaccttaccttattcaattcacaagaaaattttaagtatttgagaacaaagatgacagtttaagaatacataaggactattggctgggcgcggtggctcacacctgtaatcccagcactttgggaggctgaggtgggcggatcacgaagttaggagtttgagaccagcctgaccaacatggtgaaaccccgtctctactaaaaatacaaaaattagccaggtgtggtggcgcatgcctgtaatcccagctactcaggaggctgacacaggagaacagcttgaaccttggaggcagaggttgcagtgagctgagatcacaccactgcactccagcctgggcgacagagccagactccgtctccaggaaaaaaaaaaaaaaagtaaagaatacataagaactattttagtatttcctctgtaggtagtttaaatgatgaatagcagttctaccattatttcttattgtttattacataaagtaatttacatgatttattattactgtctgctatttattttctttttgtggcacactcagggctacttctcttcttaatcagctccccaattttttcaagtcattgtctatagaaatatacttaaaatgtgtggctctctatcacaaagcttccccagacctagtgtcaaagaatatattactaacctacttcaaatatggatgtttaaattagtgataattacttgactactctagataagttaaatacaattttaaaatatggatattgtcaatggatgcacttgactgcaggaaccagaaaaattaagagcctgcacagccagaacatgctgtcaaatagtacactaaaaactctggcaaagcacccaggaaggaagaaaccacatagaaaattacatcttacatgctatgattttacaatgcttttgctaacactgtgatcatttgcacaaaggcaaatttaacagtttggataaaaacctatcatgacaatgtcgcgaagttattgaccttcctttggagctgggcagagtgggtatccgcatatgacattccattgcttttaccccaggatacctgttaccttctctcccaagttggctcttaaacaaaagaagagcataaacaaagccacaggaactaaggtgatatttctattgaaagagaccgaattagaatcacaggaatattgggccatcagtgaaaaatgtactgggagtttgtactgttttccttttgaagaaaatcatttggtacgagatagacagacagataaagcaatctcagagtagttgcaccatcaatattttacaacgcaaagccatgttaccagagatggttttctgcaatgacttctgaggaactatccaggtttaccatccttgaatacttactgtctgtagctgaccaaaaccaccaagatggcaggaatgcagcagaggatgatgatgaaggccagagccaacaaggccccttctgtgtatcctagactttctcctctctttttaatgctggtcactgcctctggagtccggatctccagaatgcgtcctccttccccataatacggctgaaagtctttattgatatcaagtagtttgccatccaaaaatctttattgttagataaatagtaaaattaatgatgctagcagagaaagagcattttaaaaataaaatctttttgtaagatctttcaatattttctctaattgaaacacaagctgagtcagaagtctcatgaataataagaaaagcatatataaaaagcataagcaataaagaagaggagtaattacacatctgtatagaaatatcaaaaatattttaaaacacagctcttgatctgcttatagacttaaaaaatctaattatcagtatcattaagcttaatattactgtgtcaaaataatttaacaacattttagatggaataaaatataatatcctaaattatataccatagtttatatttatgcattttatctccttgggtcctgtaaccttcaggataaccctgtaaagatcaaacattacaatactgatttattgcaggccaaaaagctatacagttataaaaacaaatctgaggcaccaaactaagatttcagactcaaactctgtatttgtttgccataacaccatcttaaaagtaaacattctcaagtttcaaaccaaaagaatgttttatggtcaaatggtgaagacatttaaaagacccttctgcctaggaaaaaaagactaaataaatgatgcgagtagtatatcagtgttgtaagaatgacaggaagtggtagtcaatgtaattccttcctctaaataatgcaattccaactatgagtcttgaattttggaagagaatcaaggaataattattcctaatcttatgagattgaaaaaatttgttatgtatttaatatcataattagcaggtgattttttaaacaattccttgggaacttttgaacagtcccttataagctctacatattgatgcagcaactgtgttcttaatacaacaacaccataaaggtcaaacgtcttactatagaatattggaaaacaaaaatagttcaagaaaaacacaattactcatagtcccatgatctacagacagtcataatcacttctaacatcttggtatatttaagtctaatatttttttggaggggtgatattaaatattttatatacttgagtatactgcatatataaagtgcttatgttgaaaaatacagaaaacacaaaaaaatgcaaaagaaaaaattaaaatggccctaaatttcattatcaaaatataatcaatgccatgcttgtgtacttttttcagtctattttatgcccttttgagacatttaattttaatattcagagtgaccatgctgattttaaatcccgttaacacactgttcattgcttaaaaatagaagtgcctggtatcacatatgaattccatcacatatgtaactcataaactaattcatatcacacatgtggcaattagaatgcttttttgctttttttaaacagatacgcttttatagattaaaaatgtactttttatagcaattttccaagctcattgttacacgttaaaagaaaataaaaatttagccatttttatgattactagaaatagaatagtgaaacttcttgtttgaattgtttattagataaaggaagagattctaaatgatgcatagatcaagaattgcttcacaggaactatattattagaacaaggaagaatcagatccagaagaggatcattaatttaagggaagaatatacccctacaatgtggagttcagttgacagatcaaaattctattggattcctggatttcatatccaaactctctaaagtaagatttgttagtctttttacactgcaagagccctattacttagatacttattttcacttatcaatgtgatgtcataaacaattttttactagaaggatggatcacttttgaacccacacctgatctagactatctttctttactttgtgtatttaaaacaacttgtctgggtaaaaattcttgagtcataacattatcccttacaaaacagcaaaattgcttccattgccttttgtcattttatcatgcaaatgagatatgcagggcttacctaatttttgttcctttatgagtaagatatttttatttctgtttcagtgatttttaaacatattcagatactattcaaagaaacatggctaccttttcattgatttttgcctgtaatataataaactcttgaattcttttttcgattttttgcttctgttataaatactacaattttaacctcagaaataactgtcattatcaggttgtattttaatcgtcctataaatatattttgatctcttttattatttatatgttttttcctttttcttaatattgcataaattttcaatggatacacttcatgttgtcaatttaattttcacatgccttctcatttcaggaaaggttgaatccaggtgctcaattgattttaggagataaaatttaatttataaattaggcacagtaagatattaacaacaataactaataacaaaatagaacaattatagaactatagtgtaataaaagttatgcaaatgtggtttctctctgtctctgtcaatatcttattgtattgtaccattggtaactgaaactgaagaaagcaaaaccacagaagagggttgactgctatactccagttggactgaggggaaggcactttagattaaagactaccaccgtgtaggaaagggacaattctcacgagagaaagtggaattcttttaccagaaacaggagaaggactcaagccatgtaaaacacacacaccatttcaccaatccataccattctgttttctactaaaaatgttaaactgttttccaatggtttctgtaggagaaaatttccagagttatatattctccctctgggtcatcaggttattatctcctgattttccatatttattttgttttttagtatttattgctgatcccgtttttccactgcttacttatcctaaaaaagagatagatctgcccaaatccagcatcaacacagaaatgtgttttttttttttttctcgtcattttcatctacagtgtactcagttactatatgcaaaccttttgtaattctaagggaagggtatacaggtcccttcccaggatgtagccaacatgaattgattactgctatgttatcctgaaatgagataagttgctaaaccaatgtcatgtcttattattttctcaagcacatgcaaacatgtatttctgcctccattgatggatatggggcctaatgttgtgttattcagcatataattaataaatacataatcaacaatctaccctgcatctcaccttcgtgactgattaccttgatgatgatgattttgatactgcaatgtacatatgaatgtagaaataagtaaagggtgagcaggagattgtactctagacagtagagggacaactgtctatttcctttgtaggtacacaatttaggcgtacagagtgggcagtggttaacatatctacctacattcattacactgtataagatttttctgcttaatcaagcaaatcatggttagatcatcaactattttcttttcacagtttcataactgtttaactagattctaataattagtattccattgatttggattttcagtattttgaatttatatgtatagttttttacttagaacattgaaagaggctttatcagagcctgttaatcagataccgtttaaggtctaagtgtgtttttaaacattgtggtttaaaggcagtgtataaagtctttttctgccttctccatctttctcttacgatttggacatactgtttttaaataggctggatataagacagataaacaagctaaaatgtatttgcttatttttaaattttaattaaactatattttaaagtagtgtgttctgttttgtgtagaatgcagaaagccacaagagaatatggctattaacagcaacaacaaaatgacaaaaaagtgccaggttatactaaaatcataaatttccttgagctgaagtcacaatgtgagcaaaaaaaaccaaattccattgagtgacaattaggataatttcatggtgagatgtgaccatacattgtttcacctttggcagaaaaggttaaaagtggctgccataggctgggcacggtggcttatgcctgtaatctcaacacattgggaggctgaggtgggatgattacttgagctcaggagtttgacagcagcctgggcaataaagtgagaccatgtctctacaaaaaacaaaacaaaacaaaacagctaaaattgtaataaataaggttagaattatagacacccacaaacacaaggggagtctcccctcatttgaaaacttctttgcgtagatttctgtaagatagattgggggacaaggcaggacacaagagaatattccttcatggtgtaagaataggaacaaatcagcaaggctggtgcacaggcagcaacccttgtgcaattccccagacctttatctcagatgaaacaagggccgtaagtattagagggaggaggaggaagtgtgcccatccctggtgctcaggcaaaggtctactgcttctggaaaagaggtataagcaaaaatcccctacccctgggggaggagcaggaagtcctctcaggtgtaagatcttgcaccaatacaaagtagaggtctactatggattgagaaggggcagaaaattctcttgcacccaagaccccctgtaaatgtgaagcagaggatggctgccatgatgccataagaaagagggggaaaaaatcttgagaaagcccataccaaggcttacacatgcaggctgtacaaggagaacagaggaacccctattccatgacccacctcttccttataagagtggaacccagcagcaaggaggagcagtctaacactgtgggacagatcagagtgtgggcagaaacctcttctgtggcacaagcatatagagagcactgagagctgaggactgagtaagaagactgagaaaaccctacagcacgcaggcctctattctaagactgagttgacaccattccaccaataaaagaatttttgaagcttttggcacagtggaagtaataattgcaacagcaaaatccaaataattcctgaatagctttacttaacagagtaaatgtctgtaatgtccatttacaggcataaactctatttacctcacttcttactgttcttccacaccatgtctggcattcaatcaagtaggacacaaaaagcctacaaaatataaaacaaccattttcaagaaatgaagtaacagagccagatagagataacccagatattggaactgtcagacaggaactctgattcaactctgattaatacattgcaaaatagcagaaagcacaaacatgcctgaagcgatggagaaattcagtagagtggtggaaataagaaataatctaatagaaatgctagaaatatctttctaaaaagataaaaagatgaagaatttcttcagtgagttcatcaataggctaacacagatgaatcagtgaattcaaaaatagggcagtaaatattattcacactaaaatacaaagaaaaaactgtgtgtctatgtgggcgggggaggggagcagagtcagaacggaacaaaattatgagaaaaatcaaattgtaattggaatcccagaaaaggaataaagagaaaatgggcataagaaatattagaaaaaatgtctgagaatattccagaaataaaaaaagaaaaaactcaaaatcaaactcacaaaaaaatgcagctccaaagagttgagaactacaaggataaaaaagcaggataagagtaatatataattattgcataaaatctaagcaattcaggtaaccaaaaataaaaaaattaaaataccgataagctggccaaacaaaataagttattaacatatcactaaaagtcattccagtcctgtctatgcatttatgagcttttttatttttgattgccaaaatatattttttcaaatcaaagtaagttcccaggacaaattattattatgatgatttctaatcctttgacctgagcattccaacatcctcagaagcttagattttaaggtgaaaggaaattgaaagaacacttccattgacctggaccggcatcttaatgttctagtacatttatgcagtgttaaaaactaaataaccaataactctcacaactacagaatagataccaatacttgggcactggcattatcagccttggaaaacacacacacacacacacatacacacatatacacatgtatatgtatgtgtatacaattttattataaaatctttcaagaaacaattctagagtttcaaatagaccagtgactctaagcttactataatacttcaaggtgaagactgctaaggcaaaattttcatatttcatggctattctatcttttcttcaatataaacatatattatttatttatttatttatttatttatttatttatttagaggcagagtcttgctctcttgcccaggatggagtgcagtggcatgatcttgctcactgcatgctcggcctcctgggttcacgccattctcctgcctcagcctcccaagtggctgggactacaggtgcccgccaccatgcccggctaattttttgtatttttagtagagacggggtttcaccgtgttagccaggatggtctcgatctcctgacctcgtgatccacccacctcggcctcccaaagtgctgggattacaggcgtgagctaccgcgcccggccaaaaatttattttatgatttatatatattctgttttttccttgcctgctggctatgatagttattttattgaatttagatgtttactgtccataatataatttaggtttggaaaaacttatttagaattaattaaagatgttcatcttgtatttcatggtgtcacttaaaacccaagtggcttttttttccccaaatatttaatctctagaaggtttgctagttaaattcaaattctaatcaccattattttactctttaaagttagcccaaatataatacatatttttatattcaggtaaaaacaccctaaactcaatcaatcgtgaaatttaaaaacaaaactaatgtatgcaaaaaacacagaatgcaggtagattcacataaaaaagaaatgtgttgattttctgacaatcgaaagaatatatatgaattactttggaagtttattcctaaactttttaaattaataaactttttaaattaataaaacttacaaaaaattggcttggtagatctaaatgttgcttcattttggtggtgactataaaatcagagtgcgagctattacttcattcatctatatttcctccacggttagtatcctgttttgcacatggcccaaatatctattaaaaatgaattgatgagccaggcacggtggctcacacctgtaatcccagcactttgggatgccaaggcgggcggatcaccaggtaaggagatcgagaccatcctggctaacatggtaaaaccccgtctctactaaaaatacaaaaaattagctgggcgtggtggcgggcgcctgtagtcctagcttctcaggaggctgaggcaggagaatggcgtgaacccgggaggtggagcttgcagtgagcgagattgcgccactgcactccagcctggggcacagagtgagtctccgtctcaaaaaaaaaaaaaaaaaaaaagaattgatgagtaacatgttaaataattatggcttttaaaaaattttagctgatattaaatcattattttattattgccaaaatagaagtgatgaaattttgtcgatgaacacatttaaaataaaactaaattcagaatttattaatttgaataaaaattgaatagatatttacaaaataaataaatttacatacacataatatagatatatttgtaaatgtgtatatggatatgtttatatgctgtttaaaaagtatagacaaagaaaaactaaattatgatgtttcacatatagagttcggcatgactatatatacaggcacatataaactattatgattgtatatcaatatatatttttaactaaaaatgtttcattgagatagaatttcattacaagacccagttggacactaggtgtcaccagagtaaagaaaattctgttaacaatttttttttttttaagtatttaagtgtgctcgaataacatccaaagaaagtaagtagcaggattttctttaagattctgcactttatttatttttaggatttataactcaaatttttaagttcctgctaggatgaaatttcacatagagcatgaacttaaatgggaatgattatcccacctgctctccacctgtaagttaaagaaaaaagcagatattgatttttgctgatttagtagacctgtaagaaaggtggatttcttcttaaaatgcaagcatatgaaaatcattgcagaaaaactgcctctttaagaatctgtgctttcctcattaatagccagtgcccttgagcaagagtgaggagctggcagcaggtgatttcaaggagctgttccttgttcttaagtacaaaaggtcatctgatgcccataaagaaaatgggccctctgaagtcactgtagcccacacttagacctgaaaactttaaggcatgagaatcctaggtatttcaggttctttgcttacacttcactttcagtaactatttggtgggttttaaactttaagtacttatagcctcaagtcagaatcatctatggttgctattgtaaccaaagagctgttacagataacaaaaagcacttacttaaaaagctcatttctatcgatggctctgttggtttgggggtcaattgcatagacagtcaagtcacatttggtgtaatcttctagggaaaaggcatctccatgccggcgagctccaatggactccactacgaccttggcaccaggaatttgttcctgaacatagcgatccaagatcctataaatcaaacaaagtacaaacatgacagtccaatgggctttctgggagtaaaaaattactcttaacttgaaaagacatttagtaaatgaaaaatgatgacagcctagttttttgttaatgtttactgaatataaacccttgaaaaacattctctatattttttcagcatttagctcccaatgatgctagaagctgaatacggtagaaaaggtcaccaaccatgtcctatttaactttaggctttttgaatttatgatactatttgagcttttacatgagaaatgccaaatatgctgtacaaataaagctgtctatgctttataggaggcatggggtcttagaacccttgacttcacatggttggtgtcataaattacatctcccactaaagtctgtgacacatgacacgtagctatatgctaagaagcaggactaggatgcctgttttcccaaaggtataaaaatccttgcagaatcacagcaacgggagaatgtggagatattttgcaatggcaggattaccacgttaagataaaaatatggcatgcaaatctcagacactatttaggtgaataaaaacaacatataccatctggtataaattagtgatatttaatttaaaaagcagagacaatattaatcaataagtaattttcccatctcatgactggattttaattgaaagtatgaattattaccatttcccaaatgtctcattccttattaaaaactttatattattaacccaagtatataaatattaagagcatataattcagtatttacagatgtttaaatttaaataattttaattactatatatgataaatattctaaaattcgtagactcaatgctcttttctgagtctatattttgaggtttttttagggggagaagggcaatatattctaaagtcctttgatacatcagaaaataacttttgcttctaatgccacaattgacatatttcttgctcgactgaaagtatattcccttaagagtcttgtatgtgcttggtttgccttgttattagaacaatgaggttactaaactttggaggaaatggctctaccagtgcatgccaggagacactaccaatcatagtgaaatgtttgcttgcttgtttttaaatgtttgtaacccagtactgttgaagtctgtcttattgaagtactattcattattttccttttctgtcaccactccacgcccactggtctctcggcttcgcaatttcttttctgatgacatccttgaagtagactaagaaaagatgatgtgtaaaaaaggaggaggagcaaattcacttggaaaatatcagttaatagttgaatgcctgcaattccagctagtcgggagatgaaacagaagaatcgcttgaacccgggaggtggaggttgcagtgactccagcctgggcgacagagcaagattttatctccaaagggaaaaaaaaaaaaaaaaaacaaccccgggaacctgaagataatggatgtactgagagacacagactagtctaacatcatttggactgtgtttttcagattttttttcctgagagatttatgctcatttaacaaaaataagagaggcctcggagtcaaaccatattatactcttgacattttgtaggaggcacaaacaataatgatataatgttgaggagtacagatgtctggctggcttcaattttaatttcctttgcctttcaattgcataaccttagacaagtaatcttaagctctcaaagtctcaggtttgtttgtttgctttttgagatggagtctcattctgtcgcccaggctggagtgcaatggggcaatctcggctcactgcaacctccacctcccgggttcaagggattctcctgtctcacgcctggattacaggcatgcaccaccacacctggctaatttttgtattttttagtagagacagtgtttcaccatgttggtcaggctggtctcaaattcctgacctcaagtgatccgcccgcctcggcctttcaaagtgctgggattacaggcatgagcatcacatctggccatgtttccttaaatagaaaacaaggaaataatgtaccacatggggctgaatgtgcattcggtgaaataaagcttttacacagttcctagcacatagtaactattcaacaaaatgaatcttatttttattaatttgactgaaatatttccattaataagcttcttccttgtctcaaattcattcaaggcctttaattaatttgtggaataggaaagtatacttctcactagtataatcaatcagttcacaaatcaaaacgcaaacaggagtacctagttaaatacaatgcaatagatggctctctgtcccaatactttggtctaacaatttatgccttctccagtgcattttggcattgatttgacatgttccaaggaaatccttcatataagcatagattaattgtgtgtgatcctacagtgaagaaacatatctattgtgcttgggttcttttctattttcagtgcaatactgcagaatcatttcactaaaaaaaatagatgtggaataaaatataactgtaccaattccttcatggtagcagggaatcatgaataaaagaagtctaaaaacaaattatgtcatttaaaacatgcaataatgtcttcactttgagcatttttttgttaaacttttaaagatcttttgggacaaagtatatcttatgataaaaagagatatagcctaatcttaactgcttctgtatctttttcttataaatgtaagtaaaactaaataccttttaattgagaacacatttcataaaaatctatcttttcatttatcatctatatctatatactaagtattttctacatctatattcattacctatatgtatataaatttcctcacatatatacatatacccccacacacacaaagaaaaagagatttgcaatgatgtttatctaacccataatatttgtatcatacacacacatatcaagaaagatgtccataatgatgtttatgtaatgttaataatgcttagagctggatggtatgattttgagtttaccttttataactttcttcttcatatattatattgcttatatttctttataatgggaataaaagaacaatatagttatatttttaaaaaatctccttaactccctatttcctctccccaacttcgtgataaaaaaagtcttcatataaatctatattttctagtttaaaaatgaaaaaaattaaattggattcagggcttttcataaaattatagcaaaactcactcagggaagtgttaagtaggaaaattttcatttattcattccttcaacagatgtttattcaatgcctatcctgggccagaagccattccagacacatggaatacatcagtgaacaaaatacaatctttgatgtcaaagaagaatttacattcaaattgaacaagacaagtaacagatcatggattgataaaattggtaaaagtgttcagaataaatatcattgagactttgatatttgagcaaaaactttagggaacaatgtgtgctgtggctattctaggaatgagtgttctaagaaaagagaattgctaactgcttgtataaatgtgctgatgtagtagtgtgtggccagagcagatcacgtggggactttgaggattgtaagagcattgttttttgttctgagtgagataagaatctgttgctggttttgaatactaaagtaatatgatctaccttacatttaaaggaggcacactggttgctgtgttgagactaggctgagtagaatcaggaaaactagttagtaaagaacttaagtacatgaaggttcattaaatgctcagcctactcaataatttagaagaaaagacacaacccaatccatgactattagccatatgaaataaaatataaatatcagagcagatataagcaaaactttgaccaaaaagaaaacacaaaaaatcaagaaacagaaaatttgcttttttggaaaaaacatgatatgaccataaaaacagacacgtacaccaatgaaacagaagagaaaactccaaaataaatccacactcttacagccaatcatttttgaccaagatgtgaagaacatacactggggaaaggacaatttttaatgtatgatgataagaaactggatatccatattcagaaaaataaaaatagattcccatctttttctatgtacaaaaatccactcaaaatggattaaaagcttaaacataagacataaaactgtaaaactactagtagaaaatattgggaagagacttcaggacattggtgtgagcaaagattttgtaagactccaaagaaatataaattttccaatgaaagcaaaaataggcaaatgggattacattaggcagaaaagcttttacacagcaaatgaaacaattgtcaaagagacaacctatagaataagagaaaatatttgcaaactatccaatcaacaagagattaataaccagaatatataaggaactcaacagataaaaaccaaataatccaatttaaaaatgggccaaggatctgaatagacaattctcaaaagaagatatacaaagagtcaataggcatatgaaaaaatgctcgacatcactaatcatcaaggcaatgaaaatcaaaatcacaatgaaatattatctcatcccaactgtaattgctattgtcaaaaaacaaacaaacaaaaaataacaaatgctgtaaggatatggagaaggaggaacatttatacattcttggggggaatgtaaaatagtacagccattatggaaaacagtatggaggttcctcaaaaaactaaaaatagaactataacatgattcagtaatcccactgctaggtatacatccaaaagaaagaaaatcaatatattgaagagttatctgcatgcctatgtttatcacagcactattcacagtagtcaagatatggaatcaaccaaaatgtttatcaacagatgagtggataaagcaaatacagtatatatatacaatcaaatattatttagccataaaaagaacaaaatcctgtcatttgcagaaacatggaagaaactgaaggttattatgtaaagtggaataagccaggcaaagaagaaatatcacatattctcattcatatgtgggagctaaaaaatggatctcatggaggtagagagtagaatggtgcttaccagaggctgagaggggaagaaagatggggataatgataaaatggttaatggatacaaaaatacagatagagaaaataaataagttatagtattcaacagtacggtagggaatttatagttaaaaataatgtgttgtatatttcaaaacagctagataagaagaattgtaatggtcccaatacaaagaaaaatattggagttgatggatattccaattatgctgatttatcagtacacattatatatatatgaatccaaatatcacatatatcccaaaaatatgtacaactaggttatatcaatagtgtatgtgtatacacacacacacacacacacacacacaaacaaaaaaagaattaaaaaatgaatgccaaaaatttccctgaatctgacttcttggtagcaatatacgtatttaaaatgcaaatagtacaatcaagtatgaagcaaaacagtatctgattatgtcgagcattctcaaaacagagaactggctgtgattggtcttctaaaaagtgaaaaatatgttaataaatttggatgataattacaattattgaataaaaattacattttaaggctatattgttccactttactttgaatgctctctaacatactcctgttaatgtctatttaattatgtcacctttaggaaaagttttaaaaacagaaaacttctaaagaaatacgttaatatagctaatacaaacattttatgtaacatatgttagtatagtaccacatactaattaatgtccaatacaaaacagtttatctaaataaccttcttagaataaatgctgaaaggtttatttaactgattttttttcctatgcagatagcattattttaaaatcacaaactaagggtgtcaataaacaattggttcgcttaacttacttattcttgaaccaagttatttttggtagatgctctaaatttcaatttacagcattaccttatccagttacctgtatatacatcttcaattagtttcaactagaaattgcattatgaaaaactgtagtgtaaggtgtttactgatagttttatagctgggacaggtatttactcatggttgatttagctttttatttatttttttacactaaaattattacagcagccataatctcaattacccatttgtctgtgtgaatgagttgagttaaaattaccatgtgatgagaatttctggttttgcatgctcagtttactcccaagaaaagatgggttgggtttttaattaggtttgcctcctaagaggcagtgtaacagaggaaactccatctgctggtggctggtagacgtagattaaaattaaacctccattattgtgtctttgtggaaattacttaacttttcaaagtttcagggaatttatctgtacagtgggaaaagtagtcaaacctacctcaaaggtcctctgtgataggttaaggagactacacccattaaatgcacaaaaatctaaccaatatgaagcgtgtcataaatgttggctacctgttgtgatggttacaagaactcttcagatttcatgattataaaccctacttaggcttttgttgaggtaaatggcttatatttatctagcatcatagagagttccaccccaagtgcttatcaatatttttacacaagcttagctaaattaatcaataggcattgcagctggctggagggataaaaatacaggcatacagttcctactgttctgaacttctttcctccattaatacagacccacagggactctacccagaccatatcctaagtagtgctctagatgccatggagcattttgttcattacattacatggtaacctctctgtggtatcccacaagataaaaatattttcctctaatctggaattagactttgaaagagttcttttgtcccagaagagatatggttttgttaattttgtaactgagtctgttctttttgtttagcttgtttgcttctttcactttggccctaacaaggtgacagtcaagtttgtgactactctatatggactatacaggcctttgcagcatctctgtaattacttactcttactctgatcctttctttaacttctttctcatctgtttgctttatttttctacactcatttttaatgtattttacctttttttctgtgtgaatcattgtaaactacttctgtttttctttggaataaggtagaaaattaaaacaaaattaaatttagcctttaatatttattagacatatatggaagcatctaaaatataatttatgactttctgatacaaacggaattctcttgcataaacattttgtggagtttatgtctcacattaaaaaacagcagtacagactgcggtaaattgtgaataaattgaagaaagtatagaaaagaataataaataggattaagagaacagaggaattgactcttgatgattaaagtggcctctaaaggaagtgatatatctaccttgtaccatgagttggggtgaattacaaaaataacaagctgttcaatttgacaaaacttctaggttataaaaaaaaaaagaggaggaagagaggaaataattttaaaagaaataaatgtccactatgtattttagagatctccataaagcaactgtgattcaaatgttttgataaaataatatataatgatgtccttatttttacactacaactattttctagttattttctacttggtacaagcaaaagatcttaaaaataaactgaactgaatgatatttgaggggagaaaaacagattataatacaagttaagattaaccgctcaatctttctttgcttttcttcctaatttctagatcttaaaataaaaacataaataaagttgtctggaaatgtttttttccttagtgttttataagtgaatttcacttttgaacatgaataaccccttaccttcaaatctcaggaaaaaatatacctgtatcaattattttttctccatcataagttgataagaacattttaaacactttaaaattttgaagcacaattcaaagattcagttaatatacgggtaccttcattacgatgattcattgtgcattaattaattttatttctttaatgtatctttcgatcatgctattttcttaaacaaaatagtttccccaaaattttgtttgtattattttcatagtgcaaataaaggcaacataaacatatttatctttgatttaaaactaaacacatagtgtttttaattgatcttccaataaaatatatttttaatctgggaagatctcatttatctctttttgaaaacaacaatagctcaaagattttaaacttttttcacctaaaagcaaaatgaaaatgtcctcaatgttcatttatttgtttgtttgttttggctttccattgtctccaaaagtttgaatactaaaaaagtaaaaaagataaaaagtagaaagaatattgattctgacaaaatacaccacctaaatgtagcagccctgcctcattctttagtttttaatctttttttttctatgttgctgagaaggcatggagaaagtgtgcaaatatgatttcttttttttatattacatctctcagatggcaagtgttaactaagaaagttgatttattttgtatatgtatatatattttttccaaacagaagctgttataatagactataagcattcagaaatgtgttaatgaatgaatgaatgacgaccattaaaataagaaacatatctatctgaagcaaacatgtcagcatacaggaccctttacggaatcaatatgcaatggaatcttaagaaaaaaagtaaaacctacttgataagtgatttgcttttggttaactttgcttatagaaaaatatgtacaaattggccggacgcggtggctcatgcctgtaatcccagcactttgggaggctgaggcaggcggatcacaaggtcaggagatctagaccattgtggctaacacggtgaaacctcgtctctactaaaaatataaaaaattagccgggcatggtggcgggcacctgtagtcccagcaattcaggaggctgaggcagaatgacatgaacccgggagacggagcttgcagtgagccgagatcgcgccactgcactccagcctgtgcgacagaggaaggctccgtctcaaaaaaaaaaaaaaaaaaaaaaagaaagaaagaaaaatttgtacaaatttggaaaatccaagtcatacaaaataaaaaaaagcttaccttaatatacgtgaaatatattatcagagacaaaacactaattattgtgactttgagccatgtgacagatgattaatccttaaagtaaacaatttactcatattgggctaagataacattcctccaaataataactaagaatccacgtaaaataaaaccttttaactctcaaaaatagaacagaactgaaaatcatggagcaccttagtttataatcatctttgttccatgtgattatttcaatactaaagttttggaaacaattaaaaatcctgccatatttaactaaaaacagaattttaaatctgtgctttttctacatttcaaagagttaagcattaaagatgctactgcaatgtgcacaaggattattataaaatagtagcttttaattgtataattgcatattggggtatcttcagttctgtaaagaactatgatttctttaatcataattaacctaatgagttaaagacaagtcattcttcttgtaaacagaggttacttctctactaaataatgctccaaatgaatatttcaaaaagtagcaaataaattttctttctgtcaaaacaatgaatttccaaggctttgaataaagcttagtcacacttaacctttttttaaagaatagtaaattataccttgaataataaatggtaggatttattattatatttctggtttgtattttatttttatgattgcttttagtttattttatagctattacattcctattacagaaacattattttcaaaaattgtactattaaaatgggtgtgctgcattatctgataaaaattaaatcattcatggcaattctctgttgataatatcttcaactccaactatatctttatgctaagtatgctgagagaaaattggcatgtaatagacaatacagcaatttaattgtagaatatggcagctagggagaagactacataacaaaagaaactcttaaggtatctagtggctaccatattgaacagatgggtctaactaaggactttccatctcacacagaataaaacttgaaatcgtccaagtgatctatcaggtcctagaactgattttctaccatgatatctatattttaataagccaagcatggctctttctctgggttttcataactgcagttctctatcaggaattgtgcctcttcctctctcatagtcaaacgactttttccatcacttaatatagatgtcttctcagatttcaacttatcagaaaggctttctttaaccatcctatttaaaacagcacctctcttccaaaattttctacttgatacttgtatttatctgtctttattacagttatcactacataacttaatattacatatttattaatattgttattttatatgccatttttatgcaatcgaatagaagctccatggcagcagggacttcacactgttcactgataatctccagtgcttacaatctgtaactatttattttttaactaataaatccccagctctaagatacaaatgcaaaaactcaaagagtttgatagactggcccaagacttcctagctagtctttggtggtctgggaaatgagcctaggttctctgaaacaaaaaggagctcaaactttccccttaaaaccaagtttttattacattgatttaagaaaatgtgctagcagttagcgtttcataggtatgcttcccgagagaccttctaattatcctcctagaaatatatatatatatatatatatatatatatatatatatatatatatatatatttacacacacacatatatacatatatactatacaaataaataaattctatatacgtaatatatatcctggctacatttctaatgtaggttttgtaaccttaattctaggaactatagattgattacacagcacatttcaggtgctacataaatatttcataaagttgaggctcttcctcatcaagtcagtaactacttcagtaaagctctactataattgaattttcatattttattcagaaggtaagagatgggtttgagcaactctgagaaataagttgtcagttccgattcatacaaaaatactctaactcagtgtttctaaactcgagtttataattttcaaaatatctcttttatagatgcttaaggatttaaattttagaaccacagattcctcttatttgagtttcatggtgaactgggagtagaaagaagttataaaatgcaaacatttcatagtttcttctttagacaattatttgccaattatttgtccattgtagttacgtgtccctactgttattctcacagctgtttctcctataccttaatttaaaaaaaagtaatttaaaaaaccacaagccttacaaagaggtgaattctaagatcaacttaaaatacgtcagagcacagatattcaagggtatctgtagtggatgcagatcctcactggaatttgttgaatatattaatctaattaaaaaggtatatgtttccttacttaggggaattggtcaattttataagcttaaaatctaaaaagtagtaaaaaattttcagtatagtcatttcagctgattcagtgaggtgaggagtaatcattacagcagctaagatttattacaagcattccattttccaggtactgcggtcttagctatcaaagtgtactgatctttgtaaaatctgctccattgtaaaatggatatgtcaggtcattatttttcctttcatcaagtgtcctcatttgtactgattacatacttaccaaggaaactttatatttttgcctaaaatattggtctaccaaaaaaaaaaatgatcacatgacattccagttttccacttcatcggatagggatgtctcaagggaaatatagaaatggctttgatgataactaacttgtcacctaagaatgtcacagggaattaatgtgtttactggtctcgtcactagaacaataaattcttctatttaattaactatttggcaccccgatggctacctgagttatgtgtgtattttcatcactcatcccagacatggatagggggagcactggggcttcacagtgctgactcaggtcttacagttcttatcactaccacttccatctactaatgtaggtttcaaaaagagatcagaaatatttctgcttaagaaaactctaaatttacataggttttaaaaaaaatctacaaaatgaaatcagacatggaagggacaatttcttaaacaactagtattgaaaaaatggaatatccatatgtaaaaaaaaaaaggctggacccttatcttacaccatatacaaaaattaactcaaaatggattaaagatctaaatataagacctccaaaccataaaatgcctagaataaaacgtatgagaggtgttttgtaacactggatttgacaacgatttattgaatatgacaccaatagcacaggaaacaaaagcaaaaatagacagatggactacctctgactttaaaactttttgcccaattagtgacacaatcatcagggtgaaaaggcaacctatggaataggagaaaatatttgcaaatcttacatctgataagggattagtatctaatatctaaacaactcctacaactaaacaactaaaataaatcaagtaacccaattaaaaatgtgcaaaggacttgaatagacatgttttaaaagatgatatacaatggccaatagcacctgaaaagatgctcatcatcaataaccatcagagaaatcaaatcaaatgacaatgatatatcatctcacacattagtatggctactacgtataaaaaaggaaaaagaaccagaaaataaaaagtgttgataggaggttgagaagttggaaagcttatgcactggtggtgaaattgtaaaatggtgcaactgctatagaaaacaattttctttaaattagaactaccatatgatttagcaatcccacttctgagaatgcactcaaaagaatgaaagcaggatataaaagatatattttaatatttatgttcatagcagtattattcacaatatccaagagggggaaacaacccaaatgtctattgagaggtgaacagatgaacagaatgtggtatgtattgagaactattcagctctataaaggaatgaaattctatcacatgctaagctgtaacatggatgaatcatgggaatatcatgctaagtgaaataatccaatcacaaaatgagaaatactgcaaatttccacttttatgatgtatttaaagtagtaaaatttatacatgtaggaagacaaaaggttgttacccagagtctaggggtaaggctggaatggaaacttgtttaatgggtaccaaatttcagttgtgcaaaatgaagaagttctgaaaatctattttgaaacaatgtcaatatacttaaaactaccaaactgtacacttaaaaatgtttaagatggtaatgtttatactatgttttttaatcacaacaaaaggaatggggcatgtatgtgctgcttaataaactcgcagatttatatttaattcttttaaaatcaacatgagatagaggtctttattccaattttcatgaagaataaaagtggctctaggtgctaagtagcttgtccagaggttacagagctgtaataggatctaaatctctgtgtctgaaaccataatctgcattccattaccaaatgcttaataaataaaatgtacaaaactcctagccactctccacctaagtctactgactttgagctgctagctccatttatatggaatatttaccattcaccgaatagtcatactttctattgtcctagatacattatataattcagttttcaaaataattctatatgttttattagctcttaacagtgaaactgaggttgaaaagattaaattatttgcccaatttcatgttttaaatccaaagttttatgaagtcagagcttccttcacaatgatacgattctctcaagacctgaaagttacctgatttttcctatttatatcatcctatctacttaagaagcattaaaatcttataaattcctgcaaaactatacttttgctattttctttttcagtttgataaattttgtctcaaaataaagaaaatggcatcatgatttgcttgtaaaacatcctttcaataaaatgtatcaagtgtctactatataactggagttatagaaataaaacacaagtctcatacattcgtagagataatattctagtggaaattgactataataataacattagataatgctttgtagaaaaataaactagaataaagggttaaaatttgaagctgggtatcatttcttacataatagacaacggaatcagagaaagcctgtctcaataggcttttattaaagcagctaaaagttaggcacaattctaattatttttaaagtataatcagctattattttgaaaaggctcagtgtatataaactacttctgcagaaataaacaagacactgtacaattgatattccatgcataaatgttgataaccatcaccctcataaaacaatttacatgacaccaaaaggttaaatttgtgaactatcctgaaataattgttatgaatcatatatgcttttcttatgggaaaatcacatatgctttaatccgtgcctactgtattttatttggcatataattactaaaagtttagttatctgactctttaaagcttcttctggcaagctgaagtgatgatattttgctaaagaggcaaattgacagtgacgataattgacctctgtcaaactgaaatcaacagaagacacagaagaacaacctaatgcaggcagagcttaaaacctagacaacgggttgataggtgcagcaaaccaccatggcacatgtatacctatgtaacaagcatgcatgttctgcacatgtatcccggaacttaaaagttaaaaaaaaaggtgatatgtatatatatatatatatgtatgtgtgtgtgtgtaatgaaatagtattcagccataaaaaggaacaaaataatggcatttgccattattggagaccattactctaagtgaagtaactcaggaatgaaaaaacaaacatcatatgttttcactcataagtggaaactaagctatgaggactcaaatgcataaagatgatacaatggagtttggggactcaggggaaagggtgggatggaggtgagggataaagactgtacgttgggtacagtgtacactgcttgtgtgcaccaaaatctcagaattcaccattaaagaattattcatgtaaccaaaaaaagaaaaaaaaatttaaaataatggcagctaaattagggtaattaagggtaaaatagtaaagatattttaaacatcttttacagtatcaaaatataagaactgcagtttaataaataatcacaactagattggagttaactataacatactcagccatggtgagtctacactgttaaggaggcagagggacatgccacatattttacaataatttaaaacatatatattgcttaatattagtcaacttggttttaaaagactaagctctaggcatttagacacattgctttgagaaatgacatatttcctggactggccagactgctttttgagtaaattggagccacaaaatcaaggtatatattcaatccatgaatgttatgatttctcatatgcagcattttgaggttctgatacatcaaagcattctgaataataaaatctcacatctaatttttatccttatttgaagacactctcaaaatcttcacatatttccaattagactttgagaaaacagtaagctaaattattattaaaacactcttaaactatatgtttaatctgaacattgtaatgattaaaatgacccactcagattaaaattgtggttgttcaaatactgcatgttattatttataaatgagagtcaacaatgggtacatgcagacataaagaaagaaaataatagacactgagggctccaaaaggagggaggatgggaggggcatgagggctgacaaattagctattggctacagtgctcactatttgggtggttggcacactcgaagcctaaacctcaccaatatgcaatatatccatgtaacacacctgcacatgtatcccctgaatctaaaataaaatttaaaaaatacagttaaaaatcatggtcatataaaaataaatatataaggagacaaaatcaattactctgtaagatcttctatctttttttccactagagtaggaggcacattggaaacaatgacttgcatatccagctgattgaccacggagacctgaaagaagaaaaaacagaattcatttaatttttactcactgaaatttccataatcagaaaacccccacattacctcttccctactatgcatagacacagtggtttctgattttcaaattcaggaacaaatatatatacatttttaattatatgatctacacaaggggttggagactaactggggcagactgagcatgagaaactatttgttgtttacctagaaattaagaatcctgagtgatttcaattgtttttggttatgtgtttgttttattggttatttactgagacatgaagggtggcatttttttttaatttgattgttaaggaacacccaagataatgaaaaatacgttttatattttacaagtcttgagaaatcatttattcattataactaagaatctgagatatgactggttagaataattcattctatgaggtcatcacatatagttttcttgtctatttaaccaactttaaatttgtgtaggtagaggtatatatttagaactttacatatgggttaaatgagctaatttaatggctgttgataactatgtatcattcatttaaaatctactgaatttcttctatgttcttatatttgaaaaatagaagaaaaataaaaatatttattctgtgcttacaacatggcatttcatcttttcctcaatattctacaggtttaactcattgaaatctatcaacagaatcaggttgttattaatatcatttcgattttaaaacaaaaaaaataaattgaggatatatttaataacttaatcctaattaaatgcagtctgccttacaccagagcttgtgctctttactattatccaatactgatataaaaattctaaaaagccatatattatcatgcacatacatttatacactattaaaatataaatgcatttgtaccagaatcataaattgaacactctgagttaggcatatttagcaccgtatctcaatacaatctacagtagggagtaatttcacattgccacacatgtttttataggctccagattctttacatatagagaccccattaggggtcacaaactcaaatgccttcaggaaccaggcaggtaacttaaatgagaaaagtagccaaaagtatgaaatgatagaaagaagtgtaagtaacaaatccaagagcacataactctgctgaagaggtcagctactactcacctctaaggaatattgcagtgtgggaaacaaaatccagatttcctagatatttcagtttttcaggaaaaaaagaaatccaaaatattttgtaaaatgtttgcaactagttagaaatctatcaaaccattgtgtgagcatgatcaatcatgtctgaagactgtattaagacaggagtaggtctgattattacttctgagcaagcagtttatgctggcagttctaaccttgtacccctaacccgtcataggtgtctgggaccaaatgactaaatttcccttcaacatgtaaatgagtcttgattatctttttacaaaacactagctacttcactagcgaactagcgaaagggatcattacagtttttgtatcactttgtcttttcttattggtcttgagttaaagaggatatagaagttgaatagaaatattttttgttttattgtttttgagtttttagcagtaaaattacatgataaaaatttctagaagtatgtatatgaaacttgcataactgttccctccctccctcccctccttccttccttctttcttccttccctctcctcctttttttctttcttttaacattgggccagaaacggttaaaaaaaagttttgataaaaatcaaaccacccggaacaagtagtaactatagggtgttatcccaacgagaagtataatcactaggcctcattctctgttccctgaagctcccatcatctcctctaactgctggactcagaagtactggagtcctggcctcaggacagaggagcttttgcagtgggactagtgctgaagcacttcctaattccaccatctgttgggagaaagctcctggaccatgatgtgggttatggatagggtgagtagtagggaacattagcaggatactggaaaagagaagaaaatgagtaggagaaataactctttattactggttctttcagtggagaattgttaggactgtctgccctgtcaaactgtcctcttctcacatgtctgtctcctggtctggtaagcatgtgcttcaacccaccttttctggctgacagactgttacagatccgtactattagtatcccttgaattttccactgtctcttatttccctacattcatcctgcccaggccttcaaaaatagacccttcattaaactgtcttcaaattatctgactcttgcagcggagacttaaaattaaaaaaaaaaatgtttcacatgtgcatgaattttctgccaggtccttactgatatagatccgaaaaaccatacaatcaggtgtcaggctgtatataccagaaatcggtcacactttacaaatatgatatatgatgtgaacaaaaacaaaagtgggaaaggaactaagtagtaactagtggaggatagattcagcagcctcagaggaagaccaaacataagccttcctatcttagggtagaaacaggatttaatcaaggaaatctcctgctcccgggatggggatctacattatatatacccaacaggatttcagaattggcctggacaattccatatgtctaccattactgtcctcttcaaataggaatttctagtggatattctgtatttttccatcatctatactgggtgaatgtgtttgctggatcactaaaacatcagaagttccctctagacctgataaaaagaacagcatgacatctgagatccaggtgttaactttgataagactttgttctatttgtgtggaaaataatgaaataaatatttggtaatcagaagtatagactggttagctgttcatccagctctttctgtcttcccactgggaacacacagtcgatttctcagccttctttgtagtttagtggagccatatgatggagttctgaccaacgtaaacttagtggaagggaaggaatgaatgttcttaaatttgaaggatagtcactgctttctcttcatcagaaagataggttacttattcaaaatactttaagccaggcgtagtgcctcacacctgtaatcacagcattttgggagactgaggcaggctgatcaattgaggccaagagtttgagagcagcctggccaacatggtgaaaccctgtctctactaaaaatacaaaaaatagccaggcatggtggtgcatgcctgtaattccagctactctggaggttgaggcacgagaattgcttgaacctgggaggcagaggttgcagagagtcaatatcacgccactgcactccagtctgggcgagagactctgtctcaaaaaaaaaaaaaaaaaaaaaagtgagattttgtgcaaaattctgactgaaatagtaggagctaacatttaaggtatctagaatatatccattttaaggttacattttattaacaagattttatgatgttaatacattttgaaaatatacttttatattttattttaaggatataaaaataaaaaacatttaattctgataaattaacagaagtcgcactaccgggagtagttgtcccacacttacctctaaatcattactttaaaatttttaaatctcctgaatgtgctaatgtctggtttatgtagaacacacacattttgactatgcaaatgaagaaataagatattacagtttacatttggtctttgacagaaattctacatcctaactctggtttgttttatcatctataacaaggatatttagctgtttaagattagtagattttatttatgctacttttccagtatagcttctgcaaatatgcaaatatttccagaaatttgcatgtcagtttattacaccaaatatttaataattctctgtgaaattatttaattctgtagcttaataactaatgaaagctttataaatatgtttccatcatcattgagattgatatttgtaatggattcaaattactaggtattgttaaaaagaagagaaataacatttgtgaagcacaaaattaaaaaagcaatggttggaaatttacatgttactatttctatgtcctttccatttattctcataagtttcttttctttcttcctctatactctcataaattttaaatagtgctgtccaatagaaatacaatgtgagccacgaatacaaatcacatatgtaattttaaattttctggcacccacattagaaagataaaaataataagattaattcaataacacatttaacccaatatgtttaatatatgtttagtaaaatatcattttaacatgtaaagaacattttacatatttttatcaaagtctttgaaatctggtgtgtattttatacttatagtacatctccgtgtgacctagccatgttgcaaatattcaatagctacatttggctgatagctagcatattggacaacccaactttagagatattcatcatctcctgcttgaactgtctttcctaactaactaactggtctctgctgcaaactcacattttattaaataaaagaggtgttttaatagtccatttagataattatgtattttcttttttaaatactataccaaaatttagtttccacatgaaatctgaaaccatgttcagttatactacaatctatttgtctgtcttgtactttttttttcttttttgcgatggagttttgctcttgttgcccaggctagaatgcaaatggcgtgatctcagctcacagaaacctctgcctcctgggttcaagcaattctcctgcctcattctcccgagtatctgggattacaggtgcccatcaccacacctggctaattttgaatttttaatagagacgaggtttcaccatgttggccaggctggtcttgaactggtgacttcaggtgatttgcctgcctgagcctcccaaagtgctgggattacaggctgagccaacacacccggccattgtactttgaattgattttttacacgtgcataattttttaacatcctgcattggccacttggaaaatacaagtttactgaacactgcagatattgtaaatatcaacacacttcattacacaatatcaataaataaatcacattatttaatacaaccactgactcatcaagaaagtctaaatattcggaagctagtcaagtttacagtgacaggtacatttttttaatattctaatttgtgcttcaaagcttcagtattatcattagttggttgttttcaatgaaatgacaggctcccttcatccattttgtgtaaatgcctaccaaatatttaagtttgaataaccatattttgtctctaagttgctctttcatataaaaatgttagtccataaaaaaagcagcttgttcagcttgcatagtgcttttccttgaggcaaccatcttccacatacagcagatgtactctatgcatacttctcatttcatcaacaaaataatgaaaaggtgtttaggacactttcgttgataggttagctagctgcctagatagatatacagtatttactaagggaatgaatgtgaggtttaggagagaaaggagtcaagaaattttttgcctaaggaactcaaagtgatttggtcatcaaataaaatgaggaagactacaggtggaagaaatgtgatgaagaagagaaatccattaggaaacactaaataaacaccttttaaaaatattcgggtggaattgctacatgtacagataaatatgcaaatctggtgttcaggaatgatctttagtgtaaagatgtaagtatgagcgcttttactatgtagatgatattttaaagttatgggactaagtgagcttaacaagtcagtgagtgcagatagaaaagagatttaatgtctgagccctgagaaacctcaatactacaaggtcaggagaagaaaatgaaccagtgaaggagactgagaaggagtaaacagtgagatagtaggacaagggagtatggtgggtggtctgaaagcatagtgagggtaatagtcaagcattgctgatggttcaagtaagataaggactggcatcatcagtacatttcctaacatggaagtcattggtagcatcgacaagaatagtttggaagagtgtttggagagaaaacactcttatgattagagggtttaagagagggtttaagagagggttcaatagtgagaaataagtcaaatctaacatagaattttgctaaaaagaagaatagaaaaatggatggcagctagaaggtgatatagatcaagggatgttttataatttttggaagatagaaaaaaagcattgttgtgagaataatctgatataaggaggaaatttatattaataatgtagaaaagaaatgggagagctgctgaggcaatctcctagagctggcgagtgggaattgaatctactgcataagtagaggtacaggctttagataaaaacagaattcatctaaaggagccagaaagaaggcaaagaatgttggtctagatcctggagggtaggtaaatttagtggcaggagtcatagaagtgtccttctaaatgctttagtattatttttctgtgaaatagcatgccagttaatcaggccatagtgagaatgaggacaaggtattggagattcaggagcagagaagattttctaggacatcgaggcaaaatagagtgattactgaccaaagcaaaagctcatttggagggtttgttttagtcattaatttaaattgatactgatgcaggagaacagggtctggaggcagggaacctaaggccaatttgtgctgacttcctaaagctaaatcaaagggaaaacaccaaggtctggggtcagggaatctaaggccaattcatgatagttttctaatggtggattaaacaggaaactcctgggtctgggggcagggaacataaaccaattaatgccaacttcctaaagctaaacaaacaaacaaacaaaaataccatctccccacaccccacctgagtaacaaaggatcaaaggctactctccctaaaaccttcccccttcccccatgtctcagatggaaagggaaagtgccttggagtggctgtgggccaagcaggggccatcctttcatttgcttagggcatcaatccactcaggccttgggtcaattcagctcagcctttagcctcaggccaaatccttcatccagataaggggtagcccacagggacctcaaaaggagtattaaaacccagaaaactttgtaaccaggcccttgagtcacttgcttgagtccactcccaacttgtggagagctttcttgctttaataaatccctgctttccgaggttgcagtgttgcagtgagccaggatcgcaccactgcactccagcctgggagtcagagggagagtccgtctcaaaaataataataataaaataataaataaataaataaataaatgcccactttccttgctttgttcctttgtttcgttcctgtgttaatttgtgtgttttgttcaattctttgttcaaaacaccaacgacatggacaattcacactcaaagccgtcatgtaacaatactatagctaggcatggtggtgagtgcttgcagtcctaggtgctagggtggctgaggtgggaggattgcttgagcccaggattttgaggttgcaataagctttgattacaccactgcactttgacctgggtgatagaaccagaccttgtttcttagcaacaacaacaacgatactaattatagaattttgtatgtttttgcagacataatcagcatggatataggtctggagaaaggagacagttggaattaaccaaagtggaggttttgctaagtgaatatgacatagagaaagaaagcaagaaagttaaattttatatgatgtactgcttattataattggtaatgcattataaatccagtaaacaagaaagagaacatgagaggttctcatgagagaacacaatggaagttaaaattattcggctaattggactggacatcctggtaggaacaaaagaatgatgggtttagctgcaatgttaattaaatgttatggacaaagagtgggaggtttgaaatggaggttataaaggtaatggcaaggtaagccaagaacagaaagttaaacaccacatgttcttattcatatgtggaatctaataaaaagtgtttaccgatcttaatttgatcaaaaatttatgtcaaacttaatatctcctatgtcaaaagcttcttggcttagagtggccttcatttactctattgcagctttactgttaaaaatgagaatgctcctggaggactgttttggccacaatcatggtgattgttcttcaccattatctaagaagaaaaataaagcattgatgtctgcatgtatatgaaggttacgcttgtccagggaactaaatgagaagaactgcgaaaaaatgaaaatttatgatgtaaagaacaaaagacaacttattcttgatctgtttttatgtgacaaatatttctaatgaatatactttgtattagattcatcagacaaaactccaaataacccatgctttcaagttggtaaagagtccacaggatatatgcactggtgttaaatattttcaatacaagctaatatcaaacttccctttcaaatgatctatcactaaacttctgcactgcctaagtgaaaattagaacagtgatattattgactatagccaaatataacttagtcaaggctaaacaatgtcatcattgggaattttgatagaacaaagaaataaatactattggaacaaaatttgtccccaaacattttctttgttttctcaattacaaaatgctgaaagtaatttaaacaaataatttcatagtttaatttctatagtataactctgtgaagcatttaaaatttttatgtagcactggacaccctatattaaacatgagctttgaagacaaaatagaaatccagtgcttatacctttgctgttacaatcatattttttcaaatattataatgtttttctcaaaggtcaagaaaaataaacaccttacggtgtttttgtaaatatatatatatatatatatatgaacaatatatttacatattcctaaactatagtgactaacaatctgagtgaaaataataattatgtttttgaaaacccgttttaaattaatcttagaagttctataaactgaaaacactgacctatggctagtatcgtagctacttccctttcctgaagttttatctacttacgagtacatcggctttgccgctcagtcccttcccatagtcgtcagttgcaataacttgaaacttgaagtaggatctcctcatattatggaagagcatagcagttttgataagccctgtatatgtttccactacaaatccttcttttccctctttaattggtggtattatgagtctgtaggccatgacactataattgccagtatctttatcagtagcctagacggaggggaaaaaaaaagagattataattaagcaggaaaagataacccttatgaaatggcttacttttgtttgtaagaatgaggtttcttatgtaataataacacaataaagccctcctaaatgtctgttttttctggatatagttatgtagattaatagactttgtgtccacagtttcgaatggttgctattagaatgataataactgctgaagtatgaataaaagggacataggtataattctgtaccctttaacaaatttctccctacccctcctttccttttacccttaccagcctccagtatcttgtattctacactttatttttatgagatcaccttttttttagattccacatatgaataagaacatgtatgtggcatttaactttctgttcctggcttatttcatgtaacataatgtcctagatagggagaatatgttctagtgctctataccactgtagaataactacagttaacaatagtatatagttccaaatagctagaagaaggatatcgaattttcccaacacaaagaagtgataactgtttgagatgacagatatgctaattaccctgatttgattgctatgcattatacatatagaaacatctatgtacccaataagtaagtactattattatttgtcaattttaaaaatagattttaaaaaataaacagacatagacactaacagagtcaatgaatcaagacttttggtttacaggtttgttgagttcaactgtgtgtgctgatccaaattggttgaaagatgggattggttgtttacctaatgtttgtcttgctgtaataggcatacagtgtgatggtatttttgatgtagtatatagcctaaggaggataaatataaaagaacgtagtaaaatatctcgaatgaaataaaataaagttgagttataacaaatttagagatgcataaaaatattctaattaattaatgccataacataattctctaattagagttagaatactatccgacttcctttttaatcatcctgtatcccgattaaacatatttgttcctggtgataggtacttatgatccacatattaaagtttcctaccatttagaattaaaaaggactaacacattgtttagatttttttcatttgtttttaaatacagctatgagaatcatatattgggctggctttatggtgtctaattaggggtaattttttagaatgtctatttcagaaccatttcatagtgaaatacttggaaaataaatggtagataggagagttttagaggcttgataaaagactatatataccttattcatgatactagatatgtaagttatacattttcatttgttataacaatgattattatttttattatccgattattcttatttttacctatgctattattattaagtatgagtatgcatttatgatctgccattactaagaattgctaagaatcatacaaaatacaaaatacaatcacacaaaataacatcatacaaaaatagtcttatctaataacaatataaaaaactgaggaatatattgttttacttatataaattagtgatattcaataaaattttctgaaatgatagaaatgttcttaaccagctctgtcttatgcagtaggtactagccaaatatgacaaatgaaaagtggttgatgtgacaaagaaactgaaatttcaattcaatctaattttaatttaagttacataatgaaagactacataataagtagtaaagttgagacacaaatgattaaaatagtaaatcatagcaaatgtgtattaaatacagcatcaacttgatttagcttcaaattctatatatattgtgaaccatttaaaacgtttccagataatcatatctacttgttagaaaaggtaatttaaactactcaacacagataatttcacttcaggatcagctgtttcatgaattttctagggagttaatattctcttttctttatttttttctctgtcacccaggctggagtgccatggcataaactcggctcactgaaccttagtctcccaggttcaagctagcctcacatgtcagcctctgagtagctgggactataggcactccactacgcctggctaattctttgtagacacagggtctcgctatgttgcctgggctggtctcgaactccttgactgaagcaatcctcccatcttggcctaccaaagtgctgggattacagacatgagccactgtgccaaacctaaaattatctttagaagaggacaagctcaaactaccggctaatcactttagatagtttatatggcttacagcatggcagagctcagttttggtattagagtaatagtaattagttatcaatgttaggtcacattctcacttaaaggaaaaagaaaatgaacaaagaaagaaaaacagtatcaaaattttttgtacttaaactttgaaccacaggtttataatcactcaacaaaggatagcataagatagaaaaaggcatattcccagctaaaataagtcaaagtctgagtcaaggtatccaagacatttcttccacatagaatgagcaaatttgggcctaatgtcagatcagtcagatttggttacatattattctctatcttcttattaacatggatatttctatgaaacaaactttttattattaatgtaaactttataaaggaataacaaacatgcaaaaagtgtacaaattataaatgtaaagctcattaaaattttgcaaaatacacacatctacatgaccagcatttacatcaagaaacaaaacaagccaggcatggtgactcatgcctgtaataccaacactttgggaggctaaggctggaggatcacctgagcccaggagcttgaaaccagcctgcacaatatagtgaaactcttatctcttgaaaaaaaaaaattacccatattccagaatgcacttcatgcacttggagtcacaatctgagaccttcttaaggaaaaccactttcctaatctaacattgttgattagttatgcctatttttaaaactttacattgactgaatcataaaatatgttctattttctgtctgacttctttcattcaattttgcactgtaagattctaagcccttatatttaaaataaatactgtataacaacactatcacatttggaaaagaaaaggtggttaccataaaatcaccacagtgattgcttggtatattaagctactttacacagttctgactgattaacttccaatttcagtaagcaggtaatttcactttgcaatattcctaatatattaaattatgataactacaaaatagtcatattccatcttaaaatattaaagtgttctgttaaatgtgcctttcctgaaacaaattatcacttaatgcaaaagtttgggtgtggaactagacaatttaactcagaaataactattttcttttatgatttttcatataaatgccttaatatttgcagaaaatagtcaagaatgagataaaagtttttttaaaaatcttgtctactggaattaaaaaaaataaaaccctattgtcatatgtatgttatacagtaaggactctaatttttatttctttgaatgaatatgatagtctttgggatcttagagatcttatttcaggagatattcatcaaagatgattgccaggatcattagcatatttttcaaatctcccctcttcctcaagtatgttcagttgaatactagtaatttaaacagtgactgatgaaaattccaatgggtgccatacttaagagcaattgcatggatttttaatttttagtctccccaatttataacaaatacatattttaaaatccgaaacctctcctctaagatgtgactctgattgatgtggagcatatgcaataccatcatacatagataacaaccaaatgttctttctataaaatcaataacaggatacgatatctttaaatacacactgagtcacaccagagataccaataataaaattcagagcgcagttttaaatctgggtcaatatgtgaaaaataagtgagagtttcagcacagagtatattgtctctatttgttgttaaataattttaaacttacttttttgcttgttttttgcattatgttttggagtgaggtggactccaatgtcaggtgtgactttgaaaaattaataactcaaggccgggcgcggtggctcacacctgtaatctcagcactttaggaggctgaggcgggcgggtcacaaggtcaggagatggagaccatcctggctaacgcagtgaaaccccgtctctactaaaaattaaaaaaaaaaaaaaattagctgggcgtcgtggcaggcacctgtagtcccagctactcgggaggctaaggcaggagaatggtatgaacccgggaggcggagcttgcagtgagccaagatcgcgccacagcactccagcctgggtgacagagcgagacgtcgtctcaaaaaaacaaaacaacaaaactaataactcaaaatttcagatttctttattcataagataaaaataaggatgcccaaaaatagtattttaaaattttatatatattcatacgtgtgtgtgtgtgtgtgtgtgtgtgtgtgtatatacacaaaaatataaatatgaccaagtccagtgtaactattatagttacctaagttgtcataatggtgattcaaaaggtttaacattttttcatattatgtttatccatgaatatgtaaatttatgcaatcaatttagacccttattacttcagacatattatcacacaattgtaactcccttataactctacttttcttaattttcttttccagctctcctttattgcttccagttcttgttttgttttgttttgttttgttttgttttgttttgttttgtttttgagatggagtttcactcttgttgcccaggctggagtgcaatggctcgatcttggctcaccgcaacctccacctccctggttcaagcaattctcctgccttagcctccccagcagctgggattacaggcactttgggaggctgaggcgggcggatcacctgaggtcacaagttcgagaccagcctgaccaatatggagaaaccccgtctctactaaaaatataaaattagccaggcatggcttccccctcatttttgaagcaattttgcaaaacctcttcctcagttgaaatccatgaacttttgtacagtacacactctacccctccttgttgccaaacataatgaggatgttggtatcttgctctcagtctaccccttctacttcaacttcctccctctttacaaatttcagtattcattgagatgacacatccagcaacttatttttaaagtattaggcatgaataacattcatcagtctttgaacgacctcactgcatcgatttaattctacagtcacactttagtcttttgccttagggagatattccgcttaaagaaacactccatatttaatttatatattaaactttcatgtctaaattctgaccacaactttaatcatcatacttagttaagacctcttctttgatatcagtgaattttcagttctgcaaactgccttttgctcccattacttcagggtttatgtccctttctgctttatcatagaagtcagagttgatcacattgttctcatttctctctccttccacaacacctggatctttctcctcttggaccaaactaaccatcagtttactcctggtgactgaagagggcgcagagaaattaaataatcagtcagactagtgttactgtaagtccatggtctctgagtttcactgtgcctttgtctatttaggaaatccttgctatatgtaataagttctctttctcactccagaagtttgcctttttctttagttcacagattctttcagtcttctccagagataaggaagctctaattcccataaaatttgaggatatcaaatgtgagatctctcagcttttcatcacataactaaaaaagtacctatatctgtacttactttgactactttcttcaaatctcagaggagcagctgacacgtatctctcactgaaggtacttatgccttaatctgaatcactcccatcccttctgcatttaatgcttcatcagctctattgatctctgtccttttcacctctcctctacagactataaaacacgttatgtctctctcattaaaatgaaatgaaacttttcttttactgagtccacactcgtgacactagcccccaaacttccatacctatttttcacagttaagttcctcagaaaatttttatagaatcaccatctgtaattccttactttacaatcatgccttaaccgcagccagatctctgcccctgccatgccatttaatttgctaacatcagtgactgaggctggactccatctcagatcaacaatcagtctggtgttctttaaattaccaagtccatttatgttgtttgtataatgctgttgctgcttccgctgtttgctaacatttattgaacacttacaatttgccagatgctatgtaaatacatatattattacattatctcatgacatcctttccattgagtagattccattattattttataggccaagaaatggaggcacagagagattagtaacttgttcataatcacacatatggttgttagcacagtgggataagtctcactttaaagccactacattccacatgtgagactaaataccagggataaaactgcagtttaaaaataaaacaacaaatgttcgataaaatattctaagaaatcttcctagatccatcaagaagatggaaagacaataaatatgccagtcaaaaacaaagtgctatggactgattatttctccccaaatttatatgttgaaacataatactcaatgtgatgtcatttgaaggatgggcctttgcaaagcagttaagttcatgatggcagagcccccatgaaacggattggttcctttttgaaaagaggccccagagacttcctttgttccgttttgccatgagaggacacactagaaacgcagccatccatgaaccaggacggcctcgctaggcacttaatctattagcaccttgatcttgggcttccctgcctccagaactatgaggaaaaataaatttgtcttgtatataagcttccaagtctatggtattctgctatagaagtctgaatgcaaaagtaaaggtaagaatataaaaaccatagtactgatgggagctttcatttagaatttttttgttttttttactgacctgggtaaaattaaaatttaacttgtctggttttcagtagctcagacaataggaggcaaggccccaagcctactcatgaaagtgagtctattaagatttccctccccagaaagttaaattctcaccgtaagagtaaaggagaaatttacttttccccctgctaccactgctactatcaccccaaactgcaacgaaaactgtaaacttaaactttgctattgaggggagtgaagagaaaacttctttgagaatctaggacgaaatacagcccctcattttagtttgcagccattatttgccggccaccagtttgcccaactcaaggagaaatcataatattccattggtaaagtctaataggcctgatctccacctgaatggacagaaaaaccacaacctgagaatttaagagaaatcatctatgactgaaaatggcctggtctcctgcctgacagaagcaggtgctttttcaaaaacccctcctgcaagccatgcctaaaataattctaacaaataaagttccaagaaagatgaaaagttataataattatcaaaacaaacaagaaacaatcataaaaaagtccgttgagataaaaaaatcaaattcataacaacatagactttaaatatttgaattagtagacactgaatataaagcaaatatggttaatacatttcaataataaagagctttaaaatgcggaataaaaaatgagactcgttgaaaagaaatgaaaaagtatcttttagaaataaaaaaaaattagaattaaataccccaagatgggattgttagcaggttaagcgcagctgaccagggaattagtaaatgaaatgatagggcaaaggaaatgacacagaatgtttcacagagctacgaagatgaacaacctcaaaaaaaaaaagtttgagatatggagtttagaatgaaaattttggcaaatatctaatcagagtttcagaaagagagaaagcgagaatagaacagaattttccagaactgataaaagattgttatccacagatattaagaagcccaataaactgcaaacaggataaataacaagtaactcacacctagaacccacatgtcatatagaaactacagaaccacgtactgtaaatataataagtattgttttcttaatattttgggaaaattcatagagatattttagtaatggcataaataattcataaatatattctataatttattaatagtaataaggagatgtctaacaagttgggttaaattaatgcataaaaattaaaactgactcactgtggaaacgctaaatgaatacaatttactaaagaattaatatgatattactttttccaccaatttctctataatcaaacatttatgctcagttcacaacaaagtcattaatatctgggagaggtgactctggaagatttgattcactgacttttatgagtttcccttagtgaacaaaataaaaaaaaaagttagtctagagttcttttaaaagaataaaagtcagaaatgaatattataattatacttgctataattatattttaagtgaaagcttagatacaggaaaccacttacccatttctaagacctcatctggaaattttaatggatacagatgtacaacattaaaagaaaatcaccaaataattgcctctatcatacaggggagtaggggagaccattaattttctaatagcctaaataactgttcccctctgttgcctaaatgaataccatggatgcagaaatattagtgaaataattagtgatgtcctaagaactttcaaacccattaaagttcagtaatgccaagtttaactttagcttctcaattagacccattttaacatttaacggtattgaaggctcacttaccctgaaatagagtgaaagtgttttagactgtctggataaaaatactcaaatctcacatttccacctaccaaggtcactatgtcaagtttgcaaaaagcaaaaataacagagctttggcaggttagaaccactttaacttgagtcttgtttttttttttgtttttttgttttttttttgacacagtcttgctctgtcaccaggatggagtgcagtggcatgatctcagctcactgcaacctccgcctcacgggttcaagcgattcccctgcctcagccacctgagtagctgggactacgggcacccaccaccagatccggctaattttttgtattttaggagagacgaagtttcgccatgttggccacgatggtcttgatctcctgacctcgtgatccacccggctcggcctcccaaagtgctgggattacaggcatgagccaccgcgcccggccaactcttgtatttttagaaaccagaaagaaatctttattttaaagtccttaaagacaatatacccagaacatgataaaatatgaataagaaaaatgtcaggtagattgatctacttttagggctattcaaaacttttgcaaaaaaaaaaaagaagaaacaaggagagaaagagaaaagaaacattttaaatatgcaagctcaagtgtttgattttgcataagaatgtcaaacagtgactacaatgcaatattaataatttctaagttcaacatacctatttactttttgtagagttaagtaaaagtctaatataattctgagagattctaaagagtaaaatacaactcattgtagaaacagcaatgtaataatggaaacacgccagtgcaacaataatagagacatgccatcatagtttgaattacaaagacctttacagggctgggtttcggttagaatttatcaaaatttactcttaatttaaatcatggtgcaaaaaattacaggataacatctatttagaaaattaaagaaagaaactaaagaaaagccaaatgttccttttattattttaaaaaattatatggtaaattctgaaccatagaaggcttgagagtacaaaacaagcaggacttgcatgtatgttataattgaagtttccttttttattttttcctttcttttaaaaatgttttgtaaaataaatattaccctataaatggttttgctttttccgtcattattgctaataataaaatgattatacctccctcagagatgctttaaaataaactctgagctaattgttctaacttttcaaccatgtgaaaaagaaaaaaattgtgctctattatatagacaagttaacaaaagaaaacacacatgtaatttatgctttttacttgagaggaaacactagtttaaatgttggtttggttttgaatcacaaaatgctattaatttttaccgaaaatatccactcttaaacagcttatcttttacaataattctgtagttatacatcctaaatccttcagcattcaaagcaaattaaataacatacttgttatttttgaacttcctgatttttccttagttacattaggttcaatcagtccaaaccaaattcagctgctgcttcttggctcccaccttgctgtccctcttctgactatcatatgtggttctccttctgttttttctttttgcataggaagggcaacaccatctatgaactgaactgttctaaaaaatttcagcatcctccccctcggtttaatctcacctcctggctcctccctacttccagtccatcagcaagcattctgatttctacctatacaatatttctcagttctgtataatactttaggccaagcttacactggccaatttcaggctctcatcagatctcacttttaactctagcgatagcttaaaaattactgatagctcccacttgccagagatgaatgttaaaacaagtcctttaaatattctcaatctgattaaagttcatgattccaactttttgctttacatttattctacttcccagaaccatattattttgtttttctgaagaatgtgttctttcaggtttctatttctttgtatacattgtttcttctaccttaaatgaaatgtcttttgtctgctaggccaaatgatgttcacttcttggctatactatggcacacacacacacacacacacacacacactttgaatatatatatatatatatatatatatattctacatatacatacagtaaactatggcatacacacacacactttgaatatatatatagactatatatattctatatatatagtctatatagtctatatataatagactatatatactcatataatatattctatatatagtctatatatatactatactatggcgtacacacacgttgaatatatatatatatctccatatatataaaatgtgtgtgtatgccatagtatagtatatatataaatatataatatattatatatatacgtgtgtgtgtgtatatatatatatataataaaacactgaataaagcaatcaaacctcagcttaaatgaccccttttctgaaggtgttcttatctctactagggagtgctgcttctacttacatattttcattgttatgttacataaatgtgtgtgtatatattagcatttattatgacacgttttaattttgtgtgtccattatacgtcaaatttgtttcagttcatatttttcactgtggtaccacgtgcagtcagtggtcaaataatatttggcttaaatgtctatagaagactatcatagtggttgagacatcaataattagaattgaaagatttgagtttagttctaccacttattagatacatgagcttgggcaagtgattctctaaggctttgctcctcatttgtaaaatgaggaaaataggacatgctgaataagttggctgtgaatattcactcgggtgtaaaatgcagtgcctggtacaaagtaaacctaaatcaaggttagctgttgttttactattgcatttactactgagatctttgaatactttgtagctatcttcctgatctcttctatttgttctttttttttttaaatcactttttgtacacttaaacgtacctttcactttctgcatcgtgtcactggctataaattctttggaagcaggaccattttctgaatcgtctttggatctcataagtctcatggccagtagaatgtaattagaaaatatttgctaaagaataaatctgccactgaggaaagtatagttattgatgtctctttactgaatgctatataatttattgatagcaaagcaaaagcacttaaatagaaaatatttataatgatacagatataataagatgcttataaggagggtgggagccaagaagcagtagctgaatttggtttggattaatgaagactaatgtaactaaggaataatatagaagtttggaagtttgaaataacaagcatgttatttaatttgatttgaatgctgaaggatttacgatgtatacctacagaattattgtaaaaggtataccattcataaataatttaagtataggcatttttggtaaaaattaatagcattttgtgattcaaaaccaacattcaaactaatttttttctctcaaatagaaagatcaaattatacatgtgttttcttttgttaatatgtctatgtgcctcagcctctcgagtaccagggactacaggcgcgcaccaccacgcctggctaatttttgtatttttagtagagacaaggttttgccatgttggccaggctggtctttaactcctggcctcatgtggttttgccatgttggccaggctggtctttaactcctggcctcatgtgttccgcctgccttggcctcccaaagtgctggtatcacaggcttgagccatcgcggctagccgtaactttatattctatacttaaaatttgcttcatgataagctgataaatcctgtttgtaatttctgcattttgtatttgtactttttcattcattttaaatcttcttcatgtaaaacaaatattttgtactccaatgcagtgttcaatattaacttgtaatttctgaaaattttactgagaaaccactggaatatttagaaattcaaataaaataggtgttatgcatattacatataatgaagacttcacagttcataataaacatctattttaaaattacatggccacagattcaacccatgggcccaaaatttgcaacagagcaggaagacttgtattttaatatgctaacagtacaagtcatttgacctagagataaaacaatttaatattttaagaacacagggttcacgaagcaaacttgaacttactgtaaaatgaacttactgtaacatgatttcaaatatgaatagtgtataagaagtctattcatcttttaatttctaaatttaatggaaagtcaaaggaaagtaatagcagggcaattgaaaattaaatctgaatgtcgaatcctctgtaaattctgacaattttactgcctacctaataaatttacaaacagaaacaaaaagctctattacaaaaatttttaaaaaaacctttcttattgctttcatagtaaaagagtatgtcgaggcaaatataattcaatttataaatgttttaccttggaaaataaatttataattttcaaaatagactggatatatagggctatgatgaaagtaattattaccaaacaaaatgcctttagtattgttataatgacactaattgtaaagaagactgtatttatggactagaatggtactatttgtacatgggacaataagatctgtctcctcgaatttatataattgtaacatgttaatataaacaaccctcaaaaaaacagtgtctgtcctcagtgtccttcatttaaattgatggtattttggagctctccctcgtgctctctctctctctgtatgtgtatgtgtgtgtgtttaaaaacacacatatgtatatatcacatatgtatacacatgcacacatatatagttatttttatattttataacatgatgtattttgtgtcatgagtaccaacttacaagtttgctaaaaagaaatggctccaacaccagtaaaatttcagtgaaatagtcttgctgcatgcagctatactacctaaaatttcaggatttgttagccagactcaaatactgcatgttcttacttatacgtgggagctaaataatgtgtacacctggacatagagagtggaataacagtcactggagactcagaaaggtgggagggtgggagagggtgaaggatgagaaattacctaatgggtacactattagggcgatggttacagtaaaattgggaatttaccactacacaatacatccatataacaaatccacttgtaacccctaaatgtataaaaataaaaaaagtaaaaataatcattgataaaattttcttagcttaggcagcagaaagtaattgagcatgaccaaaaacgtttatgccaatagagcaaagagaaaaactgagtacacataataaaatttatcttttgaagttcacacctggactaaattattagacatacataatttttaatcattgaaaaaaaccaagccaccatgtatttatattcttaagaataatatttctaaaatgtgtatgctagattacttttgtctacataaaattatacatatttttaacccttgcgatgttttgatgtgaattgtggttcacaaaatatactgggaactaagtaaaaaaattacaacaggtaaatgacacagatctgatcaggactgagatgaaatattgtggaagcatccatggtcagagattgcagtgatttttatctgaagagttggccccaaaacaatttactatacaggatgattaacattacaattccattttgagataatttggtaaaatgttaatattatgaattgcccacttgcttttttttttttttttttaacatggagtttgtttctgttgcccaggctagagtgcaatggcacaacctcagctcactgcaacctccgccttctgagttgaagcaattctcctctgttgggagaaaagctgagtgttgggagaaaagctgagtgttggcagagaagctgaggcagggcttgcatgtctgtgagacttgctggctccttgcttctagcactccccttatctcaagcagacatatgtttctcattcacttgatacactgtttcctttcaacccccacatccacatcaccttttttgtttgtttgggcaccaataaatagcatgggctcccagagctcggggcctttgcagcttccacactcgtgatggccccctagtcccactttctctctcaaatgtctttttctcattcctttgactctgctggacttcgtcgcccccactacctggtgttgggtctgatcaccccaacattcctgcctcagcctctcaaatagctaggattacaggcacgcgccaccacgcatggctaatttttgtatttttagtggagatgggggtttcatcatgttggccagtctggtctcgaactcctgacctcaagtgatctgcccacctcagcctcccaaagtgctgggattacaggtgtgagccaccgtgcctgaccccaactgctattttttaaaaatatggttatttttcatgaaccactgatggaattgtaatacacgcatatctctttgcaaagttattagaatgtatttgtttttccctctgtttttcttttaaaatattcccaaatcatttacatctaattattaatgttctgtattatgtgtaaagatgaaaaattgtaaaaatgtaaatggccaatagtcttttataatgtgtttaatatataaaatgctttgtgcttcttgctttttagaaaaataccattaaatgcaaatggaccaaggaatacaaaaactttataattttatccatttacaggcatcattaacacattggtgtttgttcctttatgtttttttgatgtacatatgtatatacatatatgtacatacacacatatacatataggatattatgatcctagtttactgaaagaatacacatatgtatacatataaaaatacataagaatacacacacatatatacacacatatgcatacacatacatatgtgtgtgtattctatgtattcatatatgtatatgtgtgtgtgtattcttccagcaaactaggatcatgccatcctatagctttgtaatccatttttttgtcattagccagccattaagaatttttttgttttaaccattttctattttaaacatcatacaacagaaagagtaggataaaaatatcataatgatcaggtaaaattatttaaagagatatatttttttctttgcatcatcatctcctttttctcttttcttattcgttaaatctttgtttttacaaatccctgtgctaagggctgatactcggtagactgcagggaggaaactgctctgccacttaaaaaacactgaccaagaagcaggtcatctacactagttcctcacaaatgtcctttgtatggcaggaaggaagatatgtatgtttttaagtgaatacatacacatctataaattgttgtaaaataacccccagagaacaccaacattaccaaagcttgaaagatagtttctaaataacattcacatttaaaaggcttttgttttgtttgagatggagtctcactctcttgcccaggctggagcgcaatggtgtgatcttggctcaccaccacctccgcctcccaggttcaagcgattctcctgcctcagcctcccgagtagctgggattacaggtgtgtgtcactgcacccggctaatttttgtatttttagtagagacgggctttcaccatgttggccaggctggtcttgaactcctgacctcaggtgatctgccctcctcggcatcccaaagttctgggattacaggcgtgagccactgtgcctggcctgtttttgtaaaaaaacaaaacaaaacaaaacaaaacaaactggtttgtttttatttgatttggccaaaaaatagcactgctcaatctgtctttaacttacttgcctttggccaacttgctctaaaccaaattgttcttcagccaaatctgcaggggctgacactgacaactactggggcgattaaatgcaggttgagttttgtactgaaaaggagtaagagacagaagactatatttgaggaagatctgggaaatgtaagaaatcatctgaaagttgactcagtgccctgctctgttttacaccctttaacaaagagggtatcataaaaatttcttaattctggtagttagaaagaataaaagtcattccgtgggtgccatttctaaaccatggaagattaaattaatgaccccaaatcacacagttggtgagcagaacatatagtctttaactccaagcccccatgcagagttcgccaaaaaactgactgtactgagaaaagtatgtggtgggctgaagattattatcaggttccttggttcagaaacagataatacctgtactgaacagatagctttcattaaaaattacaatctaatatttctcacatttttccctctgtgtagatactgttaagtccagtaggaattagattaagacaagcagctttatctctacacctctttttcaggacaaagcagaagacaaaactggcaggacacagagttgcttgtatccttattagtgatgctacttcattaaatttcatgttgaaagataattcaatgatttaattgcatttaatgctaatcagacccttataaatgtaggtgagatacacattctcattgtattatttttcatttctcattagttacccctaattttcatgatgattactaacataatataccattaatactctcaggaggtggcagaaaagattatgtgtcatgctgtgattcattaatgccagagaaagagctgcttcgtttttcaatattttataggtaattcattctttaataatgaaaaataaattttctgccattcagaactttctatcaatacatttactttgaaaaatggcaatgttgaccatacctatatacaatggggtacttatggtctctctataaacattcttaacttgctggcctttcccaggctgggcttattttttatatagattgtgccccctccttctaaagaaaacttatttaataaatttcactgccttttcccttttttcctactttaattaagagaacttcaagatttatttccacttagcagatgtacattaattagtataatataatttcactccattttatgatatactgtggtataaggaccaaaaaaccttcaatatgccttttaaaaaaaagaaatattattttaaaaactgttctctggataaatttatactgatactgcttgaagactgtttgaagtgtttccagctgtgctgttagggtttgtttctcaggacttcatgcctgtacatatagagataattatttattttttcttaagcttaccatactcccagaaagaaaaatatcaagctacagataaccattgacaacaagaaaattctatgcaaaaatactttataacatggtgctaagataatactactcatttaaaacatataaatatgcctcacacattttaatctggtcagtattcatataagagaaccaactatctcatttaacatatacaaggatttagaaaagttatattgagtattcctcagtggaataatattttcatgtaaataatacactaaggtgtatctcaaagagaactcatctggtgacttaatggaggaatctattatgttgtattcagcttcttataattattccttattctactattaagaagacaaattagcattctatactaatgctgaaggtgaattctggaaagagaggcccagtattcagttttaagggcaaagaaaaatggctgtgtgttcaataaaactgtgtttttaataacatgtatgcactgtgcatgctgtttgaaacattttgattttgagattactatcatcttacagggaaaaagaacaactcaggtaacaggtaacaatgactattgagagatctattgagagaatgtctatttagagaatgtctaagttcagagagaggaacgaaccgtgctcagtgctttatgtgcattttctcatttatattcagataaaattcattagctagtgttgtcatcactctgcagacctgttgcttacagaaattaagaaacctgtccactcctggttacacagcccactcatggttaaataaaacctcacatttgtccttattatgcttttggaaaacggttagacttaaatatatcaaaactttatttttataatgtcctttatatattatattcattaacctttctttcacagtcttccgatttagcatacccataacatttggttaaactttaatcaacattgacttaaataaaatgttcttgtagtaattcctatcatgacttcatgtttttggggcaggagctgctagtcgtttcctgcccacatgtatgcctcttttttttttttttttttttttttttggcacctttgggctcagccgcatcttacactcatatcttagctctgaaccagaatattgagcccaaaaagagcccattcctcaaaagaggttgtttcagtatcaactggtcttgttctattcaaatgttacttaatctcaaagtgaatatgttcagagctcactgccttctgggtctggaagccacactgtttactttttcctatgatgtttgttctctgctgagtgtcgaaatccctccaactgccttttctaagatgcaggctgttccctttcacttatttttattgcccattttgggctctttatcaacgccctatattataaaacatcagcaaggactgtgtctgtgcttacgtttttgaaggatttatgaatctgtttttgacatgttggcatgattatgcaattttttcaggtccaaatgatactatactagctcatgatcctggattctgaaaccaagaaccaaagtaaacacatatgctagttcatactgactttcattctccctaccaccctgtctttcagatccaacctaaggtatttgattactggcacctctcagctactaccacctgtaatatagtatttcgtcttcctaaaacatgcattcttgctataaatgacaagaacactatgtggcattgttttaccaagcattaaatatcgagaattccttaacattaagtaaagagaagactaatatttagatggaataaactatgctaaccaataagaaaaatactagcttatccccttttgtcagaattattttatcttccatgaagaataacttaaaattaacagaaagttgaataatctttttccttttccttttaatttcaagcttgttaaacatttttagaaatgtaatatacatttctaaaattgtgtctctacagcttcacgtttcttctttgtttctacagtactctcatgaaaattcaattctcttccctgtatttttaaaaactcattaaacaggtcgggcacggtggctcacgcctgtaatcccagcactttgggaggccgaggcgggcggatcacgaggtcaggagatccagaccatcctgactaacacgggtgaaaccccgtctctactaaaaatacgaaaaattagccgggcgtggtggcacatgcctgtagtcccagatactcgggaggccaaggcaggagaatggcgtgaacccgggaggcgtagcttgcagtgagccaagatcgcgccaccgcactccagcctgggcgacagagcaagactccatctccaaaaaataaaaataaaaaacaaaaaacaaaaaaacaaaaactaactcctaaaacataggtaataaaagaatacaggatcttcaaaaaaagaaaacagtcattaaaaactacagaaatactataataatttgacatctactccttaatttggcagtgccatacaccatgggttgtaagaaagaagagaatatatagtttaaaaaatgctattaatacttttctccagcccctaacccaacccactcatgcagtttttcttcatagaagaagagattttgctggtttgtttaaacacagaccaaaaatatgttcacctctgctcaatattgtatagctgacattctctttaaatatatctgtagaccaattggatacaaataaacattccaacactatatatacatatatatatatatatatgtatatatgtacgtatatatatgtacgtatatatatatacgtatatatacatatatatatatattccatatcagttgtttggggtttcttaatattacaaatttgtcttacaaattacataggagtagaaattctaggtaaggagatatgcataagttcagatgtaatagatagataatatcaaactttttccaaaatgtcttactaatttttatcccctcagcaatatctgagaacttcagtcgcttcacaatttgattttgtctgttttttttttttttttttttttagtcattgtgatgaacatgtgttggtttcttatggtttgttttcaattccctagcagttaagtttgatatatatatatatatatatatatatatatatatatatatctcctgtggaaattgataagctgattctaaaccttatttggtaatgagcacacagagagagccaagagaagccaacaaaccttgaagacaaaaaaataagcagaagacttacactatcagatattataaaactatagtaattcagatagcagaatgatgcaaagacaaacaggtcaatgaaatagaataaagtattcagaaataagcctttacatccatgaccatttgacttagaacagagagaacacgtcaagtagagtggagaaaaaaaatggtctctttagaaaatgatgctggtcaattaaatatccacatgggaaataaaaaaaaaaaaatcttgacctcctacatcactccaaacacacaaaaaaatcccatatggactgtaaatctaaacataaaatatgaaataaaatttttggaaataaacttaaaaaagtcatgtttttgtgttactcaaagagcttttaaacaagacaaaaagttgctcaacatgaaaaaataataaattgtattaaaagtttctgctcatgaaaaagcataaaaaatagggtgaaaatgcaagccataccttgggagacgatatatccaatacatatattgaataaagatatgcaatccagagtatataaagaattctaaagacttaatgagaaaacaaaacaaacaacagaatgtccagagaaaaatgttagaaagagaccaaaatagtcgccacataaagaggatacaaatactggcaaaaaatatataaagagacatttgactatcttaactactagggaatggtaaacgaagcacaagaaaccatcacatgttcatcacagtgactaaaaaaaaaaatcagacaaaatcaaattgtgaagcaactgaagttctcagatactgctgaggggatataaattagtaaaacatttttgaaaacagtttgatattatctatctattaagtctgaacttatgaatatccccttacctagaatttctactcctaagtatatttgtaatattaagaaaccccaaacaacttatatggacagtatataggatatattaactgtaatatatttgtacaatgaaattctctagagcaatgaaaatgaatcaattattactacatgcaataataacatagatgaatctcacaaatatagtgtgagaaaatgaatctaaacaaaaaatacaattttcctaagtctataaaaatatcgtaaacaagaaaaacaaatttatggttggaagtcatactagttattcttacggggatgtggagcaggaactggtaatgctctgtttcttgacctgggcactggttacactaccgtgttcactttgtaaatatttatctagctgcacacttagaatctgtgtgattttgcatatgcaggttgcattatgtatgcagcttgtaataaaaattatacatcaaaaatattcttttaggctgggcacagtggctcatgcctgtaatcccagcactttggaaggccgatgcaggcggatcacaaggtcaggagatcgagaccatcctggctaatacggtgaaacaccatctctactaaaaatacaaaaaattagctagacttggtggcacatgcctgtagtcccagctactcgggaggctgaggcaggagaatcgcttgaacctggaggcggaggttgcagtgagctgagatggtgccactgcatgtccagcctgggcgacagagtgagacactgtctcaaaaaaaagaacaaaaaaattcttttgatatcagcattcaacatatcttggggtctattggcttcaggtgttgatagtctttcaaattactatgagcctcactgacttttgtccttttctagattactgggtttctaagagaccataaatgtctagggggagaaatcctggaaatgagtaaaatgaaacattattaaagagagaattatctttataaaaactagtgtagctaccacataaagtttctggatcaacttgatggagatgcctagtttagatgttatttttgttcactagaatgcatttttgtgaatccaggcatttcattgcctgtttttgaaaaaaaaggaaaaataaaaaaattttaaagtctctgcaattctcagattttcagtgaattacaactaaccagtgcaaattgtattctctttatgcataaaatctctctccaggcctgcgggtttcccttaaggtaaattaattgaaactaataggaagaatcatttatttcttatggcttatttggaactaaactttcttcataacgcattttaaggaactcttgtactttaccgttcttattggaaatattgatagacaattcaaaattaagatacatttatagaagtatgaataaacaatttttaaaagctcattttcctcattttttccccttatattcgtgttatagatctcctgtgtcaggtcagtacagcacaaagttaatggaggttcaagacattacaggacatcttcagacaaaagtaatttttatttgcccaatttatcttctgaattgtgccttgcaatgcagccttcactttcagaaaaattctgagattttcaaagggagaaccaaatgtcagtattcttgctctacagatgatggaggatgtggcctttgaaacataatataggagagtacacacaatcatcactactctaaaacttataaaacctcctaaaagtaaatgcaagcttacctccaaaaatagtattccatacctataccttggattgttacacatttaatcatctgagagatacaaagacatttaataaatttctaatactgctagagtgcactcaaactttaaaatatatgagccaccagcaagtttaggaaaggcaaaattatttggccatttaccaaataaactactttattttcatgtatcatgtccaatggctcttcaaattcataaaaagtccttaaactctctactttaaaaataaagtatccaggctggtcgttgtggctcatgcctgtaatcccagcattttgggaggccaaggtaggcagactgcctgaggtcagggtttcgagaccagtctggccaacatggtgaaaccctgtctttactaaaaataaaaaaaaaaaaaaaatacaaaaaagttagctgggtgtggctttcacctgtaatcccagctacttgggatgctgaggcaggggaattgcttgaaccagggaggtgaaggttgcagtgagccgagatcatgccaatgcactccaccctgggtgacagagcaacactccatatcaaaacaaacaaacaaaaaagtttccagttatcagagcagctttacatctatgttttttttttttttttttttttttccaagacagagtctctgtcgcccaggccggagtgccgtggtggcatcttggctcactgcaacctcagacgcctggattcaagcaattctcctgcctcagcctcttgagtagctgggattacaggcgcctgccactgcacccggctaattttttgtagtttttagtagagactgggtttcaccatcttggccaggctggtcttgaactcctgacctcgtgatccacccgccccggcctcccaaagttctgggattacaggcgtgagccactgggaccggcctcatcgattttgaaacatccaagcttccctcattcttcagataattatagtctgggaaaagtagtccgatttctattataagtaatacgaattaaagcaatttttaattaaattacattcaaattaataggcataaattgtttgctaggagaatgatattttttggtgtcccttctacaataacaaacaaactgatttgtgtggagagggggaagaagagtaaaacatatgcagaattatttcattgtatactcaactgacatctaaaatagacttcatcttgtccacttatattaaaagaacataacaagaatgttttacttgttcagactaataaggagaaatgctatgtatcagcaactggtaatgttttttatggttctcaactagtacaggagaaaatgcaggattagactatttgaaacggaatatcaagtttcagttatataggaggaataaggtaaagggatatattgtacaacatggtgactatagtaacagcgatatattctttaaaaataaaatacagaatacagtgtagaaacagaatagatttttttgtaatcatctgtctgcatttgtgccacagaatttcaaaatgaatgtgaagtattttctaaaaatatatgatataatctaaaaataattgaaagaaaagatgatagagagtaaacgtaaaatatataaaggaaatcagagaaagtcagtataccacaatttgtattgcattcatcttctaaaattgccaaagatggatcaaatatttgactttgagtgtcggtggaaaaaaacaaaaggaaaatattaagtacagtatagcctgtgatcatataacaaaaatagcccagttgttcaggaaaaaaaaaatcttcacatttgatgtcaccagtgaggctaaataaatgtaaaactatgatacatggataacattcataaagctgtcatcaagtctgagtttctaatttggcaagaagtgaaacccacagggaagtccagggtgatgttattctgtgttgtaatcagcccaaaagagtttaatgtaaaatgtattttactaatttgaaatgatcattcatgcaacatatgttaaacaggttaaaagacatgagtatatgtaaaaataaataaataaaattttaagaagtcattatatgaaaaaggtacttgcacacacgtttatagcagcacaatttgcaattgcaaaaaatctggaactagcctaaatgcccatcaaccaatgagtggataaagaaaatgtggtatatatacaccattgaatactagtcagccataaaaaggattgaaataatggcatttacagcaacctggatggagttggaggccattattctaagtgaagtaactcaggaatggaaaaccaaatactgtatgttctcatctgcaagtgggagctaagctatgaggacgcaaaggcataagaataatacaatgaattttggggactcgggggacagagtgggaggaaggtgaggggtaaaagactacacaatgggtacagtgtatgctgcttagatgacaggtgcaccaaaatctcagaaatcatcactaaagaacttatccatgtagccaaaaaccacttgttctccccaaaatacttttttgctaaactttttttaaaacccaggggtacaagtgcaggtttgctatatgggtaaacttgtgtcaggggggtttgttgtacccaaaaattattgaaataaaataaactaaattaaaatcaataaataaaattttaaacaaacaccaatttgaaatgttaagcccaatatataatgtctttaagttgatgggaaaacataatgtctgcttagatgaaatttaaattctagtaggaaaatcatgcacacagataaacgataacagtataattggtttaagtgctaaactagacatatagtgattcagttacagggtcatagtcaagaaggcaatgcaccctcagacacctacatatgtttgctttgttcaaagtacaaaccacacaaggtcaaacaccgtgccaaaacatgaaggaaaccagacgagatcgggcgcattcagggtggtatggccatagatggaaggaaaccagtgattagtaagaccttgtgaaaacacctctcccttgaaaccatgagagagtttcctcatacttggcaatggggaaccaaaattagtgttttattggacctttacttcaggctggttcttgtttgcatctgttctatatgtaactaggaagaaaattgtcacaaaataactcactagctttcaagtaacataaaccacaaatactgtaaaacataaatggtgattttgatttcagaactaagtaatctacgctatttgacctctaaaatgtggttctcaagtataacagttgtcacaggacacttgacattgtaacagtaaataacacataaataagcaaaccatcagcttaaagattttaaagggcacctgcttctacagcaatatttatgtgagaagatatctgtggcacagagtgatggagcataaagtctcacagagagataagagcatgcccagaactaaatccaggtgattagaatgtcagtccagtgctcttccactggaaacgtggttgagcttggtctcggaagcagaatgccaggctgtaaattgtagcctcactcccaattagctgcacatgttgggaaggttacttattgctcctgtgatgcactgttctctgtaaattaaagagatgctacttggggaaaatacattaaaaattcagaaatgtgctggagatgttttacctaagacccaggtgagcaggtatagggctagagaccaggagcccccaggagcccccaggagccctaacctctgtctagaaacattatgtattaccctacattgttaaccttgtacatttctataccttttgctactaaggaaatttgcatcctctgaccatgactgtggcttttttctatctacggcatcactctgctgaaacctctcatcaccagtttgtgcttttgaaaatgtaataaacaatcagccattaagtgttaagtcttttttcttgctgctttttcacaatattattttcttttagtccataaatttcttaaatttggcatctttaataattcaaaaatagaatattcaaaatctttttaactttcagtagagatcaaatcaacattataactcaattcttctgacactgtttttccatatgtgcaacttgtaaagaatgagattaatcctcactgcattaacttctggaaaatatcttcataattcagagttttttaaaattaatcttgatcacatttaacatctccctgtatttgcaataaatgctatttttgcagttaagacaacatgcaataaactggaaaaattagttaacaatttgaaaagtgtttttaaaatcaaatcttacttgttaccttaacagggggtgtcacaatttacacagttcatctcaagttgaaaagaaatcggttgcctttttacttgtctcctaatttttcacagaaagttagtatgttctcttattttctagcaggattctacgcctcatttctcctgggaagcaatgtaagaggttacaagaaaagttcttgaactgaggtagacctaactttaaattccaacttcactgggtatttggctgagtaatactaggaaagttatccagacttactgagcttcaattttcccaaaagtgcaataagaaataattgcatctactgcataaatcaatgtttaaatttacttgttttattttaattgatattattttatttattcattttatttatttatttaaagagtgtaggctaaaataagtaaatgacatttcacagttctcagaaaaataataatgacaaataaaccacagttattattatgaattagggaatatttatccattaacatttcttcaaagcccagcagaaacaaaaagttaatgttcaaaggcctagcttcaactttccttcttcacacaaaaaattacaaatattacaagtattcatcactttttctatttcttttttgttgactacatagttgcttttttacagttctttctatattctggatactgctcctttgagatatatattttttaatagatgtcgtgagtatttgcttttaacatattgcttcactcagtcatttatagcacccttgttgcaggagtctgctattctgatgtaaccatattcatcagtcatttttcattagtgtaggacaggggtccccaaccctcaggccatggacaactaccagtcggtgacctgttaagaactgggccacacagcaggaagtgagtggtgggtgactgagtgaagcttcatttgtattaatagctactcttcatggctcacataacctcctgagctctgcctcctgtaagatcagtggcagcatcaggttcttataggaacataaaccctatcgtgacctgcgcatgaaagggttccaggttgcacaaaccttatgagaacctaatgcctgatgatctgtcactgtctctcatcacacccagatgggaccatctagtttcagaaaaacaagatcagggcttccactgattctacattatggcgagttttatcattatttcattatatattacgatgtaataataatagaaataaagtgcataataaatgtgatgcacttcagtcatccccaaaccatccccctctgcactcctgtctgtgaaaaaattgttttccacaaaaccaggccctggtgccaaaaaggttggggaccgctggtgtaggacatttcagttaatgatgttcaactaatggcctgccctagagaaggaggactcagaattgtggggaggctttttcaacatacaaggtaatgcagattctatatggcctcctgacaggctgagaggattagcatgttcccacaatgcacatcactcccatattgttgcaactggtgttttatgaaataaaatgtttaaaaacgcagtacatagtcaagaaaaataaattgactaatataaatctttacttctgaatttgaacataagcttcacattcataagagcttcaaaggaatgaattaaattaaatatagtttaaaaaattttaaagtttaaaacattttataaattaaaaatagtttaaaaaaggtgttcacattctttcaataaaagtgatgccctctctcctctttttctttactgtggtaaaatgtacgtaacacaaaagttagcatttcaaccacttttcagtgtacagttcattgacattaagtgtattcacattgttctgcaaataccactgccattcatgctcaaaacgtcttcttcttcccaaacggtaacagagtagccattaaacaacagcttcccatttacctcctcccacttcacccctaaaccctggcagccaatattctgctttctgtctttatgaatttgcctactctaggtaagtagagtcatacaatatttgcccatgtctaggttatttcacagagcatgatgtcctcattaatccatgatgtaacatgtattagaatttatttccctttaggactaaataatattccattgtatgtgtatatcacattttgtttattcattcatctatagatgaacatatgtgttgtttcttttccctttttttttttttttttttttttttgagacagagtctcgctctgtcgcccaggctggagtgcagtggcgtgatttcggctcactgcaagctccgcctcctgggttcatgccaatctcctgcctcagcctcccgagtagctgggactacaggtgcccaccaccacgcctggctaattttttgtatttttagtagagacgggggtttcaccgtgttagccaggatggtctggatctcctgacctcgtgatccgcccgcctcggcctcccaaagtgctgggattacaggcatgagccaccgcacccggccccatatgggttgtttctaatttttagttgttgtaaatagcacttctatgaacatgggtgtacaaatacatgatcaagtctttggtttcaattattttaagtatatagtaagagttatattttaactgatattaactaattgttttaaagactaaagaaaaacgaattaccattggattttcttttcgcactcctcataattaaaatgactgattacttgtcactaacggaaatcaacttcgtagaaccagttgtgacacagatacccagcatgaaaccatagtaaatatagatcttctcagataactttttgttctgtgcacttttgatacaattcatgtacttaaatgtgacatgagccttcaaattattgagccagaaatcaagtatctacatgtctgtatatatctttgtcctagaaaatcctcaggagacctcccttaacaatcactgctcaaaaatgactcacatatccacgtgcaaaccaatcatttgcaaaggtaacaggacaggcatgattggctctgaccagccatttttcaccactttggaataggcttcacttcccctgaagcacatgatccccaaaaataatacctaaataaaactgaaattctgttaaagtgtgaggtaggagaaatagccaactaatggtgtctactatactcagacaatgtgagtatattaaaaccagagacttcacctaaattaactcagtggtacaaacagaataatttaaaactcaccttcacctaaatttcagataattatattattttccactcactatagtataaacatgaactgaaactaaattaggtattttgtccatctagatttaattataacatatgtttttatttatttactttttttcgggggggggtggtctagtttactagaatgtggcttctgtaagggtagagagagcctatttttgttgcttccatattttcagtacagagtaagaacacagtatatattttctttaaaaaaatgaacttagaacctaagtttttaagtatattaggtataccacttcagagcagatatacaattgtctttattatgttattacttatattggataattcacttcaacaatgtttttattgtgtcactttacctgtagcatattttaaaaataatgccccaaattcactactcatcttttaagctaatatagccttattcactgctatttcaaagtcttatcttactttgtcaatcttattctatgtcacatttcttctttcccttcttacacaaagcacatatttacatttaacttttatcattctgcgttatatcatggaccaaaaaaaattaacttgtatgcatggtagatgatctaccattacctaatattgtatagcaattggtagaaacacctctttcacaatcatgggctacttcccatttttaaaatcatctttccttccttcaaacaccacagctgaactggtcctgattcagtgctgtttgcattaatatttttgttgctctaagtataaaatgagaagaactgcttaactcatgctctgattaaattctggaaaggagatttcaggcttcaaggctaaaggcagcaactggaattgttaaacattaagtatttattactcccttccgctcgtaaatcccttgcctcctatcactcagatacgctctgcactttgtttcttctgagttttggcttacttagtttgtttcctctacttagactgtgtcttcctcacatatgtttcactttggaaaaaaaaatctaaccacccttcagtgctagtcttaaattcttcatcctccaggaaacctttatgttcattcaccaactgaaatgttttcttcctttgaatccacaagacaatttgcgctctgctacttgactttattattatagcatacacttgcataaacacattctttctctctctctctaaactttctctctctctctctctctctctccccccctctctctgtctgtctctctctcccctctttctctcactattgtataaagtacctagtatattatattgcatgaagttggtttcctagaaaggacccctttccctagtctgaattacccactgatagtttgaagggggagggttccttagagttctcagtagtctggagacacaatcaatcccaacactgtatacttcatctgaagaagtccatgcattctgtccagggcatatgtcctcaccctgatgcttctttcaatgcaatgtctttacacaccttattaagactcagtttctcacctgacttttacactactaccaaactttcgccagaatcccttggaaatcacagaccatcatcaacaaaatcccctaaatgttcaactttccctctgagtattacctatactttttgattccttctttctccctctaaccatcctcgacaaaagatgctgctttctgtagatctcccagtagtggctaccataatttacatagcacagagcccaggagtacagggcaagcatccttctgtctcctttgacactctgtcccaattcctctgaagtaaatcccatcagataatgccacccactaaatttccttgttatagtcatcacatgccttttgagtaatctcctttattaatggactagtttaacatttggcttatctttttttcctacatcacactataggattagtaacataagtggtgatgtaaaaatccacaagggcattctaatcacagtagcatctgacagtcaacgatcctcttttatcaatcttgttctttccatggttcagggaccttgcattttccctgtattcctgtcacctcatggcagcaacatctcagtatccccaaacccttcttctcctgatctctaagtgctgaaattcccaaagcttagtcttcgtattttttttgtcaaacccattttcagggtgatttcatcttggccccttatttctctctcaagtctagatcagcatttgcaaatgccttgccaagaattaggtttctgtattgaaaaagcctcccaaaccttgattactgccatcacaataggcagtggaggaggtatggggatctgttcaggacaaaaaccaccaagtcattcttgatttttcctaatgtcccatgtatgattcatcggcaaatcctatatgttctatcctttaacccccttctcaaggtctccatagcctatcaacgtcgttcaagctaccgtcaaatttttcctggactcgtcatgcattaaactctacttgtccaaaacactgtgttacccattcccaacatcccccatgcagcatctacaataatctttttatattggatgatgtcataactgtttaaatcattcaaaggctttctttccaacacacctagaacgaatcccatattctagccccaggtacatttctgatctcatttcctaccagactttttcattcacactagcctccagctccctgtctacctttagggctttacagagaaatcccagaatgctgctcacttaagaatccatgtcttgatcttttcctttattcaggtcactgtttcagttttatccaaaaagaactatcttaactttcttatctaaaattgcaccactctcattcttcccttatcaaacttttttgtttccttagaatttatcactacataacttactcatctattcatttcttcaactagtttgtctgcattactcgggtggaaactttgtttgtttgtttgctttgtcaattgctctatatcaaacttctagaacagtgtttagcacattataggtactcaaacatatttgactaaatgatagaactaaatcaattaagagttaatgagactaaaatataaaataagataaaaatcagctacaaaggattcctacttgtggataacaacataaattaaatgtaatgaatgacagatttgtggactacttttagttaaactggtgattcaggtcaggggtctgtacttagcatagtggaagagctattttgcaagcccaacccaattaggttgaattttttttcttactgagagtgtttgataggtgataaaactacacgtaagaagagctctaatcatggtgctcctggtaataggaaaagaaaggcaattactcatgtgcaaaactagaagcaatcaaaagctagatttgccagagatgtttaggttttatgtgcaatttacagctatttacaagttaaccattgaaatgctgtccaaaattaactccgcaattgagaatccaaaatgtttagcatctaaactttttcctcagtaaaattcaatctttaaaattttttcttagtaataaaacattagtaatacacagttgattagaaatagtcataaacatttgattataaactattataagagtaattagtaataaacatttgatgataaataaagaaaaaaattgaaaacttacaactttggtcttagatactgcatttttgaaattccaagtaagccaacattctctgagacatcaaggtttttgtaacttttagtaaagtactaaaactggtagtgttatttttttactttcattcaatcagcatttaaaattcacaatttcagaaaaaaatggttaatttattccactatttcttctattagaagtggtaattttatatttgtcattagagatttcattttgagaatcttttgagttatcctactggaggaatacaaaccattaagaaaagatatacatttcaacatcttattcaatgtaaaacatcgtaagtattttgttaccattttcatagtaaaatgaaactcaagaagttgcttagtgtttacctgatataatctgtattgagtttagataactaaactaatatagctccaagtttcaggcttttgtttatacagcataagtatgcagttaatgcaaactacaggcttacagcttatctgcaaaacctgagcttttactttagttctgtatattaacataattccgcataccttcactctgagtacagaagtaaacattcttgcatcttcagatacacctccgatgtagaattttttctgaaacactgggggatgattattttcatcctgaatctcaatgtatactttagctgtattgcctggaggacaagaaacgatgcattttttattggtggttattcatgggggaaaaaatgcactgaagtaaatatttgctgcacttttttttggaaacattgaaaataaatcaaaagccatttctagatgccatgcctagcacccccaaattcaggggacactgataatgatgcttctggtataaaaatgttaagttgctgttatttcttttaattacaatgtcctggtagttcactttacttgatttaatttggcactaaaatactgcaccctgttaattttaatgaaacaactctactgttcacgttcacaaacacttcacacacaataccagttataccaaagggacacaaatatataaaccccttatgaaatagtagaaactgccataaactattatatgaatatatatttattcttaagtataaaatcagcaatggcatttctttagcttaaaattgtacaataacttttatgttttaagactaaaagtaacagtgttcgggtgaggtgtttatttccacaaatggaaaacaagttttatcatgccttggaaactgtcaatgttagaggctaacattcattgaaaacaatggagctgaagatatgattatgactcataaatgctgcattttaccatttaaataacagtaaatgtaccataaatgatatgtcatcatcaaatgttagaacctccctcaaatcatcacacctttaatgagaaatgtggtacttgtcactagtccaataatgaccttttaaaaaacaatttaatatgtataaaaataacttataaaccaaataaaatgggaaataagtggctattcattttgtaaaaaaatagtcaaataagtattgctaatgtattacataagtcgacttttctgattcatttcagttatgaacaaacggcaattaacgtacatactatttatcaaggatgcccttattttggtgttttacctgtgtttaatgcctcctgtacaattttaagtaattaacaccagcctacttgcaggatacatcatgggtatacatttgtatttgttgaataaattaatgaatgaatagcttgtattagtaagaacttagaaatagtcttttttttttttttgcttgcccttggaaaggtcagacagaacagtgagttaacctcaagattttgctcctatcctgctgctactcattcagcttttctctgtttgtcatctgtgacctggaagaggtagaatcaagaggaaaatcatgctagcgcaacagattagagaaccaacagcgaaatagggctaatagcagattatgcttctctatcctgcagtgccagggctctgacttgtaccttagtcagccaccacaaatcagaattcacccaaaatgaaatcatttttagttcagtagcagaccacttttatctctagaataaaaaatgcgaacagctctaaatttaaaaataaaaaggaattttagaatatgtcacctttccaataacttctttgcactttcattcagaaacatatacaattcaaatgtgctatttcttttcagaactcttagagtgacagaggtctcggaaaaatactgatgacgtatattttcttctttaaatgggatgagtcatttaaaatgttatacaatttgcaaagaacaagaactttgtcatgacctgttcccttacctcccaaccctaacttcatatctggatggtaaccaaatcctacatgtcagcctcataagcaggtaaatcatcacctaataaatatatcttgtgtcatttttctctcaactccacagctgcccatatacttaagtctgttgttgtctcacctgagtgactaaacgtcatctgctcccctgtcgtgtctttctaatgtgtcctgcattctgatataacaaagacatcacaaaatacaaataggatacattaaatcaaatgttaaaccaaccaccattcatatgtacatttttttctttttcttgttttttgagatggagtctccctctgtcgcccaggctggagtgcagtggcacgatctcggctcactgtaagctccacctcccgagttcatgccattctcctgcctcagcgtccctaatggctgtgactacaggcatgcgccaccatggctggctaattttttgtgtttttttagtagagacgggatttctccatattggtgaggcttgtctcgaactcctgacctcaggtgattcacccacctcggcctcccaaagttctgggattacaggcatgagccaccatgcctggccgacaattcttaaaaataccatgtgtatattcatatccatacttatatgtatactttgtgcatataagtttaagattcaaataccaaattgttcctatgaaagctcctttgattcagtggcctgtatcagatattaagtggtttgtgggaaaaggcctatggataacccaaaatatgattatataacctgaacataatggggagagatgattatacttaattataatattttaattaaatgatatttatttatatgaaaactaatgactatacaatacaaaattccagaatacttcacaaccagcacacaaacaaaatctcaagaacattgtttagacttaaaagaacttatacatttatttattttaaaaagccacgatcatttagttcttttcacaaaagagaaacagttataatgcgatttataacaatactgtatcatgaattttgaaatttatgatgttagctatatagctaattatgtaggatagtttgtaatagtcaactaaaaataaatataaagttgtgaaaaaggtgttttcattaagtttgtgacttagatgttagaataaaaaaaattgttaacttttattttccataatgtaaaatagactagtcttcctttttttttgcttctccctgataactttaggcagttgttatgtatccctcctttgaaatgctatagtgcactaaaaatgtttctttctataaataacctttccagagcttggtttacattgcatttagttataagcatgattttattcttattagatttcaatattcttaaagatggaaattgtatctcctacatctatcagtactataatgcctcagtttgtaggtaatttttccgctcagatattattgtaacaaaatttcttaatttttgttgaacaaaaaagttgatattcaattaatttgttagctttctttgattataatcatgagattatgattaactgaaacaaaaagttaactcttagaaggatatgagggagctcactaaatcaaagtgaagtaagtccaaagaaggcttttggtaccacaaaataatcaggaagttgtagagcctttaaagcagcagatgtttgattttcttgcagatgaaataacagcaaactctcttcttttatgttattttaccccaccccttattcctctttttttttttttaaagaaacaaaccaaaaaacaacccactaggcttaagaatcataccctggggacacattacctgactgtcctagtttgggtcatgtgcttgctccttgtctcgggaaggagaagtcaccagattatccacttgagaagtcactgggacaattataagaaattgtagtgtgtctacttaaagaatgtaaaataaatgttggccagtaagaaaaggaaaagcaaataagtatacacctatagttaaatcactagaacagcgttctttttgacttttttattcatgtgtatacaatgtacatgacatcatcaatttccttggctcacgtgcttccccactaaggattgtaccatgttcttccaccaaatttggatattgattatttcaaggcagaagcttggaagcaactctgatttaaattcttttaagatagcctgctttttatctccttgagtacttacaaaaactttttttccatgttgtatcctttatttaatgtagacatcaaacacataacaaaagaaagatactagaaagagaaaggaaagcacagatagaaaaataatgttaagggaacaacgtgcgtgcctaatatcctagtattcccctccagtctcccttctggctcatctaaacaatgcaagtattggaaagagaaccacaaacagtgaaagaaattacaaagtaggcaaaaaagttatttggaaagtgttttggttaagagacattataatttttctgtgtgctttggggcaccctgccttatttttcttccattattaacttttttctccaattttctatgggacaatcttttctttggctagaacttttggctttagtaagccagaagttttaaaaatgactcctgaggtaagaaaatgtgagataccttcttgcaatgttttaaagaaagagaaaataatacttttatgtagtcaagctcaggggaaaatgtaagtcttagtatagttacctccttgaatagcacttctgttctattttagacatttaaacatggtagaaggagttcagaagagtgattttaaatacccattaacctcaacttgactctatgatttttaagaccaaatttagtttgatttttcccttcccttacttttaataatcaagactgtgatgctagttttttctttttaggaaggccctattatcctcaagatgaatccatttcatttatccacatgactaatctagtgcctacactgcactggattttcaaagaaagccttactgaataagaagccaatgagttaaaagtgttctcaactgggatcaatttggctgctctagagccatttttggtagtcacaacagtgtggataggggaacgtagtgctactggaattaaatgagtagaggtcaggaatgctgagaaatattctgtgatgaacagaacaggctcttaccccaaacgaacaaacaaacaaacaaaatatttgggccaaaatgccattagtgatgaggctgagaaaccccaagttaaataacaagagaaagaggaattagatgagttaagataaaatggaaagtttccaaatgctatagtaataccctctcctcaatccatctgcatgcacatgcctttaatgtggaacttatcaaaatatgctgtaattatttgatcacacattggttatactcttttttgactgtgtcctataaagtcaagggctcaagcctgtttacctccactcttgtcactgccttctggcctctgttcctgacattctctccatctaaaatattcttaattccaagccatttctctagtcattgccagtaaatatacatcacagaaatatttattcctgtacttgggaatgtagaagtttagtctgattaaaaaacatacactagactatattttcctcaaaccttaaaggaaaggactgtgcttttcttattgttacgtatcgttgcctaacacattaaatgatttttaaaattgttatcatgataaatgatttatagattcttcaaacagtcctattgcagagaattttttaaatgcttggaataccagatttatatttgttaatttgttggtatcaggagattgaagtcagttcctcactttaaaaacacacaaacaattttttatgctgtttttcttttaagacaatttttgtttaagctttacgggtatattaattatggaagcattgtgacttccacatagtaggtgatatggtttggctctgtgtccccacccaaatctcatcttgaactataatcctcacgtatcgacggaagaacctggtgggaggtgatcagatcatgggggcagttttccccaatgtgttctcatgtagtgagtttgcacgaaatccaatggttttataaggggtgcttccccctacactccctctttcctgctgccttgtgaagaaggtacttgcttctctttccccttccaccatgattacaagtttcctgaggcctccccagccatgtggaactgtgagtcaattaaatctcttctctttataaattacccagtctcggttatttctttataccagtgtgaaaacagactaatactgtaggtgttcaataaatgttaaattaaattgtaattgctaccacttcactactcccaagggtcctcttaaataaaataaattactctattttattcctgtaaattaaatgaggtaacagatttttaagcatttaaaaatcaaataacagacacccccattccaagacagctgaataggaacagctccagtctgcagctcccagcgtgcttggcgcagaagacgggtgatttctgcatttccaactgaggtacctaattcatctcactgggactggttggacagagggtgcagcccacagagggcaagccaaagcacggtgggacatcacatcacccaggaagcaaaaggggttgggggatttccctttcctagccaagggaagtcatgacagattgtatctggtaaatggggacagtgccacccaaatgctgcgcttttccaatggtcttagcaaatggcacacaaggagactatacccacacctggctcagtgagtcccatgcccacgaagccttgctcactgctagtgcagcagtctgagatcaatctgcgaggcagcagcctggcagggggagaggagttcaccattgctgctgcttgagtaggtaaacaaagtggctggggaagcccaaactgggaggagcccaccgcagctcaacaaggtctgctgcctctgtagactccacctctgggggcagggcatagctgaacaaaaggcagcagaaacttctgcagtcttaaatgtcctggtctgacagctctgaagagagcaatggttctcccagcacggtatttgagctctgagaacagacagactgcctcctcaagtgggtccctaccccagtgtagcctaactgggaggcacctcccagtaggggccgactgacactgcatacaggtgggtggctctctgggatgaagcatccagaagaaggaccaggcagcaatatttgctgtgctgaagcctccgctggtaacacccaggcaaacagtttggagtggagctccagcaaactccaacagacttgcagctaagggacctgactgttagaaggaaaactaacaaacagaaaggaatagcatcatcatcaacaaaaaggacacccacaccaaaaccccatctgtacgtcaccatcatcaaagaccaaaggtagataaaaaccacaaaaatgggaagaaaccagagcagaaaagctgaaaattctaaaaaccagagcacctcttctcctccaaaggatcacagctcctcacaagcaatgaaacaaagctggatggagaatgactttgatgagttgacagaagtaggcttcagaaggttggtaataacaaacttgtccgagctaaagaaggatgtttgaagccatcacaaggaagctaaaaaccttaaaaaaagattagacgaatggctaactagaataaacagtgtagagaagaccttaaatgacctgatggagctgaaaaccatgcacgaaactacatgacacatgaacaagcttcaatagccattttcatcaagtggaaaaaagggtgccagagattgaagatcaagttaatgaaacaaagtgaaaagagaagtttagagaaaaaaagagtaaaaagaaatgaacaaagcctccaagaaatatgggactatgtgaaaagaccaaatctatgtttgattggtgtacctgaaagtgatgaggagaatggaaccaagctgagaaacactcttcaggatatcatccaggagaacttcctcaacctagcaaggcaggccaacatacaaattcaggaaaaacagagaacaccacaaagatactcttattccaaaattgaccacatagttggaagtaaagcacccctcagcaaatgtaaaagaacagaaatcacaagaaactgtctctcagaccacagtgcaatcaaattataactcaggattaaaaaactcactcaaaaccgcataactacatggaaactgaacaacctgctcctgaacgactactgggtaaataacaaaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaattaaaaactagagaagcaagagtaaacaaattcaaatgctagcagaaggcaagaaatcagagcagaactgaaggagatagaaacacaaagaacccttcaaaaaaatcaatgaatccaggagctggttttttgaaaagatcaacaaaattgatagactgctagcaagaccaataaagtcttgcaccatcacaagactaaaccaggaagaagttgaatctctgaatagaccaataacaggctctgaaattgaggcaataattaatagcctaccaaccaaaaacaaagtccgggaccagacagattcacagccaaattctaatagaggtacaaagaggagctggtaccattccttctgaaaatattccaatcaatagaaaaagagggaatcctccctaactcattttatggggccagcatcatcctgataccaaagcctggcagagacacaacaaaaaaagagaattttagaccaatatccctgatgaacatcgatgtgaaaatcttcaataaaatacccgcaaactgaatccagcagcacatcaaaaagcttatccaccacgatcaagtcagcttcatccctgggatccaaggctggttcaacatacacaaatcaataaacgtaatccatcacataaagagaaacaacaacaaaaaccacatgattatctcaataaatgcagaaaaggcctttgacaaaattcaacagcccttcatgctaaaaactctcaataaactaggtattgatggaacatttctcaaaataagaggtatttctgacaaatccacagccagtatcgtactgaatgggcaaaaactggaagcattccctttgaaaactggcacaagatagggatgccctctcttaacactcctattcaacatagtgttggaagttctggccagggcaatcaggcaagagaaagaaataaagggtattcagttagcaaaagaggaagtcaaattgtccctgtttgcagatgacatgattgtatatttagaaaaccccattgtctcggcccaaaatctccttcaagctgataagcaacttcagcaaagtctcaggatacaaaatcaatgtgcaaaaatcacaagcattcctatacaccaataacagacaaagacccaaatcatgagtgaacttccattcacagttgcttcaaagagaataaaatacctaggaatccaacttacaagggatgcgaaggacctcttcaaggagaactacaaaccactgctcagcaaaataaaagaggacaccaacaaatggaagaacattccatgctcatggataggaagaatcaatattgtgaaaatggccatactgcccaaggtaacttatagattcaatgccatccccatcaatcggccaatgactttcttcacagaactgggaaaaactactttaaagttcatatggaacaaaaaaagagcccacatatcccagacaatcctaagcaaaaagaacaaagctggaggcatcatgctacctgacttcaagctatactacaaggctacagtaaccaaaacagcatggtactggtaccaaaacagagatatagaccaatggaacagagcagagccttcagaaataacaccacacatctacaaccatcttatctttgacaaactgacagaaacaagaaatggggaaaggattccctatttaatgaatggtgctgggaaaagtggctagccatatgtagaaagctgaaactggatcccttccttatatcttatacaaaaattaattcaagatggattaaagacttaaatgttagatctaaaaccataaaaacctagaagaaaacctaggcaataccactgaggacttaggcatgactaaaacaccaaaagcaatggcaccgaaaaccaaaatagacaaatgagatctagttaaaataaagagcttctagccgggcgcggtggctcacacctgtaatcccagcactttgggaggctgaggcaggcgaatcacgaggtcaggagattgagaccaacctggctaacatggtgaaatcccgtctccactaaaagatacaaaaaaaaaaaaaaaattagctgggcattgtggtgggcgtctgtattcccagctactcgggaggctgaggcaggagaatggcgtgaacccgggaggcagagcttgcagtgagccaagatggcgccactgcactccagcctggatgacagagcgagactctgtctcaaaaaaaaaccaaaaaacaaaaaacaaaaaaaaacaaagagcttctgcacagcaaaataagctaccatcagagtgaacaggcaacctacagaatgggagaaaatttttgcaatctacctatctgacaaagggctaacatccagaatctacaaagaacttaaacaaacttaccagaaaaaatcaaacaacaccgtcaaaaagtgggcaaaggatatgaacagacacttttcaaaagaagacatttatgcagccaacagacacatgaaaaaaggcccatcatcactggtcatcagagaaatgcaaatcaaaaccacaataagataccatctcacaccagttagaatggcaatcattaaaaagtcaggaaacaacagatgctggagaggatgtggagaaataggaatgcttttacactgttggtgggagtttaaactagtttaaccattgtggaagacagtgtggtgattcctcaaggatctagagctagaaataccatttgacccagcaatcccatcactggatatatacccaaaggatgataaagcatgctactataaagacacatgcacacgtatgtttattgtggcactattcacaatagcaaagacttcaaacccacccaaatgtccatcaatgatagactggattaagaaaatgtggcacatatacaccatggaatactatgcagccataaaaaatgatgagttcatgtcctttggagggacatggatgaagttggaaaccatcattcttagcaaactattgcagggacagaaatccaaacaccacatgttctcactcataggtgggaattgaacaatgagaacacttggacacaggggagggaacatcacacaccagggcctgttgtggagttgggggctggcggagggatagcattaggagaaatacctaatgtaaatgtcgagttaatgggtgcagcaaaccaacatggcacatgtatacctatgtaacaaacatgcacattgtgcacatgtaccctagaacttaaagtatataaaaaaaaataaaaacaactgcatgttgtttcaattaaaagcaatctattacaaacaacagatttctctaaaaagtttaactttaggaaaatattgactctgaaaccattttggaatttgatgggctatttgaaaacatcttgaagattctggtttttatatcattattaattgtctttatgttcccctgttccagtttgtattctggataatatctggttctataggcaaattaatgtttaaaacaaaatgatcatctgagataaatgcttaagctgttcttactaaggggtttatagatacatatttttgaatatacaggtggaaatacatatttttactacaaatagaataatttatcttaatttgtgtatttttaagttattcactaaaaatataaagtagaatttgagagaaaagagagaaatatgttatagtgtgcccactagacagaattaacaggaacaaaatatacttacaaaacatttagaaaataaattattaactgtattagcatgagaagctcactggttcttctcagcttttgctctgcagagattatatttagctatatttttatatactattcattttcagtggctaggcagaaagatagattgatcttttgtggttcatttcaatagttttcaaatttagcttggacatttaattaattagcctttgcataatattaattgcttgtatctagaagaaatattttgtgtatgtgtttggctgataggttaataactgaattgagtaaataactgctgtcactactggctccaaaatgtgacattcatatttccttttttttgagacagtctcgctctgtcatccaggctggagtgcagtggcacgatcttggctcactgtaacctccacctcccgagttcaagcaattctcctgcctcagcctcccgagtagctaggattataggtgcccgccaccatgcctggctaatttttgtatttttagtagagacggggtttcactgtgttgtccaggctggtctcaaactcctgaccttgtgatctgtcgcttcagcctcccaaagtgctgggattacaggtgtgagccactgtgcccggcccgtatttgtataatatataatacttgattttggctaagtcttttcatgaagaaaatgacaacactgacactttgtcattcctcagtatctgtgggggattggtcccaggacccccttctgataccagaatccacatatactgaagtccctgatagaaaatggccatagtatttgcatataacatatacacatcttcccatatcaatcatctccagataacttataatacctaatacaatgtaaatgctacataaatagttgcatactatattgtttaaggaataatggcaaaaaattctgtgcatgttcattgtagacacaaccatccatttcttttctgaatattttccatctctggttgtctggattcacgaatgcagaacccatggatacagaatgccaactgtatagtcatgaggaaataatcaggaaaaaacagtaatattctaagtattacttaaattttggttttgaatccattttaacatttttttcctcctggaaagattttatgactaaatttatctgcaaattgtaatcaccaaaataggagttaaggatgcaaaattgtttgttttcattggtactgccaacattttgttattcctgagttcaaacggatacatttaaaagcctctgcaaccaaatgactgtgacttttagctcagtttctgtgagaaaaaaagacactattttaaatcatttttatttattaaacactagctctctacaaaaagcagctattatgatattacaggactataatgatcaacaaaactgtagtagttgtaatctgggcaataaaactttaagcataaactttggaagcagagcctgggtctaacctgataataccacatgtatgctgtgtgaccttatacaggttacttactctctctgaggtaaagtttcttattcataacatgatagtaattttacataaataaccagattaaatgagcaaatatatgtaaggcattaaatacatggtagctttactatttcatatatgcctcagagattcctggctctcaaggcaggagggagaaaatattagtaacattattactaataccagaaggaaaaaaaaataccaatagcatgaaattgaaacaaaatttcctagcactaaattttaaaagaaaatggtttttatatgagatatataggaatatagtacacatcaaataatgtagtggaaaatacatatttttagtgcaagtaaaataattttatgaaatcataatgaaataactattggaaaacatatgaaaagtactgtgtcctattaaatatgcatacttttgtttacacaagaccacaaatttatagaaaatttatttcaaaagctgagagttcaagaaaatcagacagtatataatatttgacctaagactattccactgataatacaagccgaataggaattattgtacactgaattgcaggatcatagctgaggaagacaaaattattatgtctgaatagaccattaaatgacctctgaattctttgacatataattaaaaataaaagcatatttatgccccaaaactaatgctttgtttaaataaaaaaagatgaataaatttactaaaataaataaacaagctaacagaaaaacaatcaaagatgcaaaaagattgtgttgtggaaatgcaatttgctaagcacttgaaaagatacatgggctgtagttattgtcacatgggcagttttgaactttcatatatgcacctaaacacagacacacacacaacagatattaacactatgttcttttttttcttgagactataaaggagctgtttctaaaagataagagaagaatccatcaaaaagaaatgaacacactgatacggtttggatgtttgactcccctgcatctcatgttgaaatgtaatccctagtattggaggtggggcctggtgggaggtgcttggatcatgggggtggacccctcgtgaatggcttagcaccatctccttggtgatgagagatttctcactctgagttctcaagagatctagatattgaaaagtgtgtggcacctccccctccctcttgctcctgctctggccatataacgcactggctctcccttcactttccaccatgattggaagcttcctgaggccctcatcaagagcagatgccagcaccacacttcctgtacagcctgtagaaccatgaaccaagataaaatatattttctttataaattacccagcctcaggcattcctttgtagcaatgcaagaatggcctaatacacaaaccaaatatggttttccatatttaatgggaggaatggaaggtgcgttactctttcttgaagagtttctctacattagacattttacttccaatatttctttaaaaaccttgcaacaaatccatgaaataggtattttcattctgctttgtagataaagaaactgagactcaaggagattaaagaactagtcaactattatacagaagagccagacttcattcccaggcatggttaaattcatgcccaggtttctctccctagttaaaacaagatttgtaataacagcaaaggtaaattccattagacacttttgctcagcttctagaatacaggcaatcaaatagtagtactgaataaagaattattgaataaaacgatacgtctatttcaaaagacagacaagtacagttgccccttctatatttggatatcaactgaagagttattacaaatgaattaaaggatttataaatgtctatggtattgttgaaggaagagaaaaaaatgcctttcaaacaatgtgctaaattatttaatgctgctcaaataggcgcctctgtcctttaatgcaaatacacaaacacacacacacacacacacacacacacacacacacacacacacacacacacggataccaccatagcttcctattgcttctgtaatagattacggcaaaattagtggtttaaaacaacaccagtgtattactgtatagtttgtaggtccaaatgggtctcactgggctaaaattaagacgtagcaggtctgcatttctttctagagcctctagggctgtatctgtttccttgtcttttctagcttctagaagctgcctgcttgcattccttaagcttagtgtcctttcatcagtcgaatctagcaatggccagtggattcttctgttgcatcagtctgacactgactgtcctgccttctttcacttataaggattcttgtaattgcattgagtccacccagatagtccagaataatcaccctatattaaatccttaatccaattacatctgggaagtcccttatcttatgtaaattaatatcttcccaaatttcagagattagggcatagatgtctcaagagaagggggcatcattctgcctacaagaggcatattattgtgttcttttcaatgtaaaattcgaaggatctactacatttaaaaacagaaatgtgttaggatgttcccaaatgacaaatttaggaaaaacaaaattctgttttaatacaaatatgggagctctcaagctctttttatgtgcaaacaacatcactgacagaaagctttaatggtaatactaatcactgagaagtttctggaccaagtgttttctgtgcattatttcaatttactcctgtaataacattgtacatattattgattgtccacattttatcaatgaagataatgaggcttggagggattaaataacatgtctaaaattactcaactaggagaaggcataaataagattcagactgaacccgtaacaacatatagatgtaactatttcactttatggccttaaatttgagtcattttttaaaaacctgaagtaatccttggatttgtgatttatggggagtggggagcaaggcggtttatttctatagtgaaaaaaataatttatttgtatttaggtattaggtatttaggtatatacttctatgcctaggaccacaagaaaaatgaacatttcactgggaaatttctaaaactttctaagtttttataaatacccaggaagccaagaatatagattgctagaatggggacagggaaagcaaacctacttctaaactgcatcaggaaaataatttaaggaatatgtagataatctggttggaattaaagcctcccagtggaagtatttctatatgccttcatttgaaaatatctctttcgctcacctcataacagcttgaggcaaagtaaaaacagtatggatacaagatgagaaatcccatttctataaagttgaggactttttcatcttgcacaaggcggttgaatacaagggcctgctttctcatgtataaactgtagacaaacaataagattactgtgatgattaaatgtcatcataaacaggtatatgtttataatcaccatacacctataaaacattagaattgtctataaaaagtgaaaagtgttatggcatatattctattttcaaaacatttgcatcttttaataaaaatagtggataaattatgtaaaagtgcatataagtgtatgtatagatactatataagtatatattaggatattacaatataattgaaaaagatatataatttaaaaaaatcaaaatcacgggatgatagattattttaattttcttcttttcgtattttatttttattgtatataatgataagtactgcttttctaatttaaaatagttaatgttaatgttatgatggaagactagaagtagagcggaaacagaagtcataaagcatacgtacacgaaactcttgaactttatctgttcctttctatgccttttctaaaatatctctttcatctaaagaacctgtggagatactatgtgcaaatcttcattttcttttcctccatcaacaagccctggcttacgctagtaaagcatacattttttttcctcctgaaataaaataagaattttcctgcttgtttgcgaaatatttccctaggtatattggatttactcgtgaagattcaaccaagaagcaatgaataaagagagaagtggccttgaaaaacacagtctaattattatttatctatatatctttgctgtgttcattagtcatatggtatacaacatattaaataattcattttttgcacaaattttagaagtaatataagtggaagcaatttaactacaactacttagtgtaatgaacattttaaattgagcttttggaaagtgcttaattaatacttgtaaaataggggttcacagttcttgcaatatgtcattaagtccaagcattatctttaatcttctcccaaacttctgagaggagaaaatagtttttgaagcaacacaaattgataaaccttcaaaagttgaggtaatcagctacttacatttttgagcactagtcacagtataaatggaaattaaaattccattatgacataaagtaaaaatttagcactgtaagtttcaagtaatatgccacccctctacaccaaccttaccaagcacttcattcaaccacatttcagccctaatatgactttttttttatttgcctaaacagtatcacttcctcctttattttggcctcagaagtccattttccctccttggtttactattacctccacattccatgagtccttaatagaaatgccaactattgtactcttcacttcacccctggccaaggatacacagctcaagccaggccaatcagattctctcaccttcagatgtgtgatccttgaactgactgccagttgcttgaaggtcattgacctcagctttcttaatggcactgcccaaaaaggaattgctacttgagtttctaagattgctgaagcctctccatgtttttgtttttccttagaccctattcaatttctctcttgctgtacaagccaccaagtattcttctgatatgattcctttagtataagccagtcagaagtggtttctgctgtttccaacttactaaccatgccaaaaatagtttggaatgaccaatttagttcatagcagagaatggacaccatacctccctatttatggaaaagatactggattttttcctcccaaaagacattatgaaatgtagatttttcattttgtgttgcaaaatttaatcaagtattaaattttagtatattttcttttttataatcatggattttacatcattttaatttttttttgaagaaagttgtctttgtttatgtatatacattatccggttgtcaatcaaggtaggtgtattcaaatctaaagccctcagaagatgcctggctgcttttctaacatgtcacaacctacaatccctggtaatacagagaattcagaggaaaatatgagatatctctctgtacacttatctaaaggagtagatgaagcatatttagtatgtgcttattataattttgtgtggttcgaacatatcacagctagcagtagtaataaaaaatacctttttatagagtatttcttatgttacaataagttaagtacttttctgatatgatagtccttaaaattctcaaatacccttatgaggtgtagacatatttaccctaagagaaagttgaagattataaaggttagagaagtttgtaaagatcagaactgggtatggaattcaggcctgtctgataccaaaatcatggatcttaagtaatttcatatatacaatttttatgtatctactttttctctgcttttctattaaggtaattttaaatgggaacaacttaatggtttaataatctgtgttacatagaattttccctagtatagatttttgataaaatttctcctttactgtttgtcctttaaactcaggcatatctgagcatttatgaaatatcatcaaatagggatcatttagaagcaaaactgaaccactaaactggttaaagtatccaactttcttgtgtattttaataaaacacaaatataggtcaggtgtggtggctcgtgcctgtaatcccagcactttgggaggctgggggtgggtggatcacgaggtcgggagatcgagaccatcctggctaacacggtggaaccccatctctactaaaaatacaaaaaataagccgggcatggtggcgggcacctgtagtcccagctactcaggaggctgaggcaggagaatggtgtgaacgtgggaggtggagtttgcagtgagccaagatcgtgccactgcactctagcctgggtgacagagcaagactccgtctcaaaaaaacaaaacaaaacaaaacaaaacacaaatatagcaatctctattaaacagtcttgatggcaagcatatgctgtaagtaaataactagtaacaggctttcaaaattgaaagtgacagcttttaaaataatgatttcctctaaactgcttgtctgtaattatttttaagatattacataggggactaattaggtacaagataccaaaagggataagaacaggaacaagattgattaattgaacttacgaaagttcctgggaataaaaaatgaattagattgggaagaactgactacgagacttgtgttctgaataatgattaaaaagaatgacaagctaaatttatgtttcttatctctgaatcataaaattctgtttttgcttttgcattgaagcaatgtgtacattaaattgaaatgcatgccttataaaatgtaaacattaacaaaattagggaatatttaagaataaattaaattttaaattgtgaagataaaaccaagaaatcttctacctacttaattcccatgttttcttccacatacaagccctttattatttatttggcactagctatagttattgttggcccaagttaactattatccaacatactttctttagtcataatttttctggagtatctgcaacatttgatgtttcagccatttttgacttttcttgaaaccctcttctcctttggctaacaggtcatcactacataaattgtactcattttttccactggtctcttaaatggctattcttttcctctcattcactaaatggaagagtttttctcaaactcagtctttcatttttctctcttgacagcctcagaaagacaaatgagatggggcctcaagggacaataatttttttttcttttgacagcttaatttggtcattgtgagaggttacagcctgctggcagccctcgcagccctcgcttgatctcagcacctcctcagccttggcgcccactctggccgcgcttgaggagcccttcagcccgcggctgcactgtgggagcccctctctgggctggccaaggccggagccagctccctctgcttgcggggaggtgtggagggagaggcgcaggcgggaaccggggctgcatgtggcgctcgcgagccagcgtgagttccggtgggcatgggcttggtggactccgcactcagagcggccggctggcaccgtgggccccaggcagtgaggggcttagcacccaggccagcagctgcggagggtgcaccgggtcccccagcagtgcaggcctgccagtgctgcactcaaattctcactgggcctcagctgcctccctgcggggcaaggcttgggacctgcagcccgccatgctggagtgtccccccgccgtgggctcctgtgcagcctgagcctccccaacgagcaccaccccctgctctgtggcacctggtcccatcaaccgcccaagggctgaggagtgcgggtgcacagcgccggactggcgggcagctccgcctgcggccccagtgcaggatccactaggtgaagccagctgggctcctgagtctagtggggacttggagaacctttacgtttagctaagggattgtaaatacactaatcagcactctgtatctagctcaaggtttgtaaatgcaccaatcaacactctgtatctacctaatctggtggggacttggagaacctttatgtctagctaagggactgtaaatacaccaaatcagcactctgtgtctagctcaaggtttgtaaacacatcaatcagtaccctgtgtctagctcaaggtttgtaaatgcaccaatcagtgctctggggttttggagaacttttgcgtctagctcagggattgtaaacgcaccaatcagcaccctgtcaaaacagaccaatcagctctctgtaaaacagaccaatcagctctctgtaaaatgtaccaatcagcaggatgtgggtggggccacatgagggaataaaagcagactgccccagctagctgtggcaaccagctggggtcctcttccacactgtggaagcttcattctttcactctttggaataaatcttgctgctgctcactctttggttccacgctgcctttatgaactgtaacactcaccgcgaaggtctgcagcttcactcctgaggccagcgagaccacgaacccactgggtagaatgaacaactcctgatgggaggaacgaataaccccagacatgccaccttaagagctgtaacgcttaccgcgaaggtctgcagtttcactcctgaagccagcgggaccacgaacccaccagaaggaagaaactccgaacacgcccgaacatcagaaggaaagaactccagacgcaccatcttttagaaccctaacactcaccgcgagggtccgcggcttcattcttgaagtcagtgagaccaagaacccaccaattccagacacagttggatctgagttagcagaatggatctaaacagcatttctccctgatacaagcttcactagctcatctcctcttaaagagatcattgcctcgacagggaatctcctatcattacactgccagtggatttttgtttgcctttatttccatatttcctttatatttgtagagtaatagtgtttccagtccctggtttctagtcttgagccctttctatggtgtgttcagatgtgtgcaaattaagtttttttctttgtgcttatgggaggtcaagagatactttttcctttgatgctttctttgcctggttttctcacttaagcctcattattttacatttgtaccacgtgagactagcgacgcttggcataacaattccttgacttaagtactcatgctatatgattttttttcaaaacctacctgtcagtcttgaacacctttggaagtccagttccttgtttcctgcaagtttttatttagatcttattcatgtcacccaagatcaaaagtataaaatcatccttgatttcttcctttctctttataaccagtcatcaagtcctaccaacttctcttttgcagttgtcctatattttcctcctctcactggcccaatcctagttctagtttgggactggcctatttatccaattctttttagcattcattctatctctctccaagctattctacatactgagctaactttctcatgttaattccctgctttaagaaacaaaacaaaacaaaaaactgcaagcagttaatcttcctatcagtatttcaaatagttgtgaagaaacaacaacaacaataaaaacagtaaatattcagatttccattttccatttccagatatcttaattaagtaggtttggaaaagagatcacaaaaatatgtattattaaacgagtatctcaggtaattatcaccaggtagttcaaacagttgctttatgagaaacactattttatgattcttttacttatctacttcctttttctcttcactaacttttgtttaccactagggcaattcactgtcttctgaagccactttcaaccaattgccaattagaagaattttaaatttatacaaccaagctgcacctcaaccaccttgggcacatgttctaggatctgagggctgtgtcaagggccatggtcactcatatttggctcagaataaattgcttcaaatgttttgcagagttcgaggtttttcactgacaaagctactctaatttcaaatcatgcatgtctatgtctcttgtatatcaattagtcatgtacttcatgctactacttattgtttatacctatgttatagcttctccaccaggatagaaacttctttaaagcgctaatctcaccttgtggatacgtatccccttacagcacttagaacaaatatgtgatatatatttgttaatttaacatacttttcattatctctgtagcacaaaaataatgtttcaggggccatgtgacaaaaaaacagaatcatattagatgtgcctcaaaaataaagggaacagagttgttgaaagtgaaataataacttaaaaagtactagtctgtttggaagttttgtttatatgtaaatgcaagtgtgtgtgtgtgtgtgtgtgtgaatgttaacattagtcaaagagtaagaagaattacaaggggacccacaaaacctttaccaatccatgtaatgttgtcaaagataataagtaatatctaatttcaaaatcaaaggagcattgtcccagtcattctttaccacttttaccttttaccttggaatacactaaattccattgtttgcccatgtatctattattttattaccactttatatgtttaactcatcaaatgttcttgcaaatctgatacaattcacaattcactgtgaagaattataaaattatactgttattaattagtccaggtcaaaatcagatccattttggacaaaatcaatcatgaaaatatatggttaattataatgtgatcttttatataaacgataaatatcaaaaaggtggagtagtacaacaatagatattataacagcgtttctttgaaagcattagaacatggcatcaaacataatttactagacaaattctgtattgtgcaggaaaaggagtatttactattttctgaaatacatctttcatcttcatagtgttatctatactattctcttctttgggatctatctcacatttttatcttctctgctatcatccacacagcacctgtgataaaatctgggacaaaataaaattgaataatactacatctttttatttgaggagaactcacaggccagatgtatttgttcttgtatgacagggacaatgaatgattaagcaaagtctcaaaaatgagatgacctttaaactgacccttgtagaataattgagttgatctgaaaaacaatgtagaaaggacattttaaaaagagagacttgtgcaagcaaagacatttaggtatagacattccttgaggttaagtgaaaagaatgcaatgaatatagaaattcagaaaagcagttacataggatatgcccagtagaacttcagagactggtgaagttgagacaatgaaaccttctgaatgttcactcctatgtacatcttttctatatggcacttttccccatatttctttttattatgtaagcataatgctgaatttattttcgtctatttaatgagaagctttttttttcttctttcgatagtcaaccagtaagatcagctacttgttaaagttgggaaaataaatattttactaacagaaaaaattgcattatccataagtgataaaaataaataaaaaccaatctaataactatgctaaatctttagcaagttattactttaagtgcagacctgaccttgattatattacaacagaatggggatagccaatgcctacaaccataatcaataatgaagaattaattctgataatttccctcatatctatcaatgttaaactacattttatgcttatgttattcatgtagttgcatctgttttctatttctgcaaaggttgttatttctgtaacataagtgacttaatagattccagttcttctgtgcatagtttcatttgcatttaatagggcttagtgtgcctctactgaaataggagtttttctaaagcaagaggtttagagtgactgttgtatcactttggggcctcattattaatcagtaattaatactctctggaaagcataagtttgccaaaatatttggcattcaatgaatggcattttgaatcccaatttaaatttggactaaaaaggcttagaaaaaaaatctaaattatttactatattaattataagtacgtttccaagaatgaagaaaactgtatcttctctctttagttccaggcttattcttaggtataagaaggagaactattttatgcattcctagattcttaaatattttaattttgcttgcccatggcagcaatatgtttccgtcatgaaatatatattttttctcatatatgcagaaatgtaatatttttctattttgaaaagtctgattatatatcattgtcatcagttcagcaaaccaatttgggatcaatggaagagcactgcctcaatgcatttggtttcagaaatgtattaataatagtgtataccatgtttcaaatcacatttccaaggaaacctattgtgcacaatgcaattttttcttggacagacaattttatgctatgagtccactggaatacatttttgtttcattgaaaatataattttttcaaccatatatttatataagatgcctaaaatttctgaaagaaaaaatgctgttaatgatattatcgtgttaattttcataaactcctctccatattttaaagtaatacattattaatatagtttctaaaacagtggccatatatttgtactataaatataaggctatgatcattcctgggattttaggactaaaaaataatatgtgacaggctacaatattgttacccaagttatagcagggatacttttgttttaagtcagtcaatcataggtaaagagtcattagcattatttgtcacagaccttctgttagaaaccacaaaagtcagaagaatgaaatgtattacaagcttgtaccctacagctaaaacataaaatgaaatcaatagcatttgagttgttttaccctcagtttaaagtttatcttaattgtcttgtaatttattcctgattgaaagtctagttattgaatcaaaacacaatgacatatttatagaaagctatggctttcttttttcatgtttaaagataattataattttaccataaagcaaaaattgccacttcaattatggagttacataaatcaatctgtgctgtaaacttgcatgttactgcttttgctctacataaaagaatgggaatgactctgtggcacaaatattaacataagcttctatagatgttctgggtacaggcttcttgaagcttctttgggaccaagtaacattatatcctaaaaacccaggagagtttgagtttttctgcaaagaaagagactatggataggaagaaaagatgactcataattttgaaataatgtattagaaatagcaacgcattcggctgggcgcggtggttcacgcctgtaatcccagcactttgggaggccgaggcgggcagatcacgaggtcaggagatcgagatcatcctggctaacatggtgaaacctcgtctctactacaaataaaaaaaattagccaggcgtggtgtcaggcacctgtagttccagctactcgggaggctgaggcaggagaatggcatgaacctgggaggcggagcttgcaacgagctgagaccgtgccactgtactccagcctgggtgacagagtgagactccctctcaaaaaaaaaaaaaaaaaaaaaaaaaaaaagaaatagcaacgcattcacatttgtctttccttttgaaactagtccaacagtcccacagacagttgttttcagataaacacagagattggctcttctgctgctaaagcttaaaacttttatttgttttatctgagctctttcctcagcaaaggaggaccttcaggcctctgaaaaaagtttcagttatttgaaacttaccagatcactgccccagaggcctccttgctcctccccagttcttgttttcttacactcttacgtttcttccctactacataaaccccctagctttagtcaatcagggagatggatttgaaactgaactcccatctcctcagcttcaacacccgattaaagccttcttccttggcaatacttgttttctcagtaattggctttctgtacagcaagcagcaggacctagaccaaactcctggtgtttcattaacactttgtaaaaggaagataattatttgatcaaattagtggtcaatatgggagtaaaggaagaaaatacggatgcttaacagaatgagacaggaagaagagataaaatgtagggagtctagagggccagaaagtttgagtgcaggaagaatgaaaaatcaacacctaatttctaactgaattgaagagagagaaaactccaaagcttttcagattccctgcaatttcaagtactgggaggaagctcctaagcacattcccatgattaaaacagtgtactgtctccatctgtaataatgactaaaccactgttatgaaaaggctgcaaatcaggggtggtgaggtgggagtgggcagaactggagcttagttagcagtcagccatcaggtggattgtatgagtggtatgtatgctacaaatttgcatactgttagcttgatatttaaaacgcttcacaatctggccttaattttccagactcactcatgcattggacaaatctttattgggggtatttatgtgccatgcattttaggctattgggatacatcaataaacaaaacagatacaaacttctgtcgttgcgcagactaaatccattttaacaatatccactaaattctgttctacagtctcactgaaacaatattcttaatatgaaaatatagaattataaaactctattattttctttcatactatctctttaatcctgctaatatgggctaatatctttcctgctgttgaataaaagctcaagaaattttataatttttaaaaaaattgttaatagtactatggtaaaggtaactttaaaaagaatttaaaaatgattctctagttcaatatatgaatctaatactccaaatttcatttaaaggtaaaatgtccttccccagcttagatatgttaatggaagttcctctgcctttggggaagaggctgtaagagatttctttttacttttttctttattaactaccaccacctccttcattcactagcagttgatttttatcactcagacttctattacctgaccttggagattatggagaaaaggcatgtaaggtaggtagcgaagttcctacttcaatattactgttgtgaaatggctgaatactctttgggtcagacctgggtttaaaacagacatggtcaatgagagcatcttcagcactggtatgcttttcttcagcaacttcagtttgccagcatacttcagttaattccagtttgtcattttataggaattctgcggtctatgtccagtttttgccttttgcagtatcatcactccttcaggtaatcctaccgaacaggatttaagaaaactggcattcacctgtgtcccaaatctggtcctttgggttggtttgggtataattatgcaggcaaagaacagtcacaggctctttgcctgcatacttatagaagcacagacctttctagatgtagctgtaatataatgtaatactccagtcattgtaattgcttgttgctctttttctgtctacatttatctgatatgtctcaaacatggatttgctgtgctaggccaacataagggcagcgttttttactgtagttgccaatgttaaacttgagaagggaaagcatatatttccccagccattgtattttggggaaaagtatactgttgaagtgaattcaagtacaactttacaacaaccctcccctataaaggaatactcatacaaagtcacttctaaattttaattcgcgtgaccattttcaattctcctcgagagtaatggtgttcagagtgttaaactctgttactggaacatgatggttttggtctaggttctgctgcttgccacacagatgggcaatcactgagacaatgagtattgctagggaagaaggttttaatccaatcgggtgctgcagctgaggacatgggagatcagtctcatggagacagatccctcatggcttggtgttgtctttgccatagtgagttctcacaagatctggttgttgaaaattgtgtggcaccttcccccaccactctctctctcccttgctactgcttttgccatgggatgtgcctgctctccctttgacttccaccacgattataagcttccggaggtctccatagaaccagagcagatgccagcaccatgcttcctgaagagattacagaaccatgagccaattaaacctcttttctttagaaattacccagtctcaggtatttcttttttttttaaattttattattattatactttaagttttagggtatatgtgcacaacgtgtaggtttgttacacatgtatacatgtgccatgttggtgtgctgcacccattaactcttcaattagcattaggtatatctcctaatgctatccctccccccttcccccaccccacaacagtcccccgtgtgtgatgttccccttctgtgtccatgtgttctcattgttcaattcccacctatgagtgagaacatgtggtgtttggttttttgtccttgtgatagtttgctgagaatgatggtttccagtttcatccatgtccctataaaggacatgaactcatccttttttatggctgtatagtattccatggtgtatatgtgccacattttcttaatccagactatcgttgttggacatttaggttggttccaagtctttgctattgtgaataatgccacaataaacatatgtgtgcatgtgtctttatagcagcatgatttataatcctttgggtatatacccagtaatgggatggctgggtcaaatggtatttctagttctagatccctgaggaatcgccacactgacttccacagtggttgaactagcttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgttttttcttgtaaatttgtttgagttcattgtagattctggatattagccctttgtcagatgagtaggttgcaaaaattctttacagtaatgtgctctaatacaaagagatgagcgagaaaatgatgaaaagataagagaagattcaacacttgtatactaggaatctcccagtgagacagaggagggatagaactttgggttcagatcacctctactagagcattatttcatgcagtcacactagtcaccagaccttgcaccactgtaaggtgatggcagcatcacctcactcatgccatccccactgaccacaagactgtgcaagctataagttacctagagaaactaagatgagggacattctaccatacatcttactcaaggaagttggcccccaatacccacatgcacagaaggctaaaaaaatgactgtggtggcaggcgcctgtagtcccagctactcaggaggctgaggcaggagaatggtgtgaacccaggaggcggtgcttgcagtgagcccagatcacgccactgcactccagcttgggcaacagagtgagactctgtctcaaaaaaaaaaaaaaatcacacggagatgtaacatgttaatgagacgtgtgacacatgaagaagcaagtcatcaaactgtgcaaatgctataaattcccatttctacatgctttaatgtcactcctttcatggctaggcctgttaaaattactctcttggctatctccagggaggcagcaagagcactttctcttttccgggctgctttccttgtgctccagcataagttccaataacgcctggagtctgggaaattttcttagccttctgtcagtttctattgcacaagagcataagaacttgtggccagtaacaccagaatagatgccacattaataaaaaaaaaaaagtctagaattaaaaaaaaaatccctaaatgagacttgaacagttatactacatatatagaaaatgacccagaattgccaacatgtagaaatacattgacaaaaatactgaactctaaagaaaaaataaaggcaattatttggaaattcagaaataagaccagtttgtcattacacatttttttacagtaatgcttcaaagaataagaaaatggaatgaaaaatttaatttaaaaaaagaaaatgagtcaagttatccagtcaaattggtcttcaatgttaaagccctaagataagcttttcttaatgcaccaaaacataggaaatagtgtctctataatcctgcatcaaggactttacttgggaatgggttactgataacaaaatgactgaattgtgttattaagagggataaaacaatatcactttcaattagatgtgtgggaaaatataagagatgaagcagaagcattgctcacaacaggaaacatatgagcagtgcaaaaaaaaagtgtaccatgtaatgtaaaagtaagtcgtagaacaaatgtgggcaaactacagccctttggtcaaatccagcccacagacagcctgttttagtaaaatgaattttatgggagcatagccaaaccctttggtttacgtattatctcttcttgcttttaagctacagcagagtagagtagttccgacagagaccatatgacccagaaaactaaacatatttgtcatctcagtattcccattttgagtatgatagtgaatcaactcattattttgaaaatcaataataaaaggaaagaataaagtttttttttcttgtttttcctatagttggtggacctcagggttactgagtatttgctatggagacgtttttctttataaaaatattttggctaatgaatatagaagtaataaaaataaaaaaataatggatttagaaaattactattggtggttgctactatctatatcacaaaaagagaatcaaagagatttaatgtttaaggaaggagtgaatatcacctatgatttatttgtttaaaaacaaaccaaaaataacctggatatgatcaagcctccagatctaactacttatttcctggaaattaaggaagcagaaagaatatgaaatgaccacttggagagacagtcatcaatccaggcttcagaaatgtggtttcttgcacaaataaatatcaaggtgaataaaagagcgtagtggtgaagcctacagattaaaagagacttaacagacctatcaaccaatggcaatgtatagaccttattttgattctgatgtaaataaatgttcaatgtgaactggatatgtttaatatgaactatgtttaataccaactggatatatattgatatcaaataatttgttacttttggcagcagtaatcatgatattttaattgttttaagagtccttaagatatacatatcaaaatatttacagattgaatgttatgactctgacctgcttcaaaataatgcaatagtgggtagttgagagcatagaggaacaactatttcccagggcgtgattatgttgaattagggagttgatacatggaggttcaccgtaatattctctgtaatttttgtatgtttgaaatgttccaagtaaaatgttaaaatatttaaatattcctagtgttaaacttatgaaattagctctaaaattttacattttaattaatttgcatttaaatattaaatctaatcacatcatggttgcacaatttactttgaaaataatttcattaacaaatttttggtaaagaagtcacaataaaatacttctttaatgaattacacttctgatttttattatccttattcaaatgatatgtggtagggcaactaattctgctgcagagatgaatatttagctaactaattaacctcaatttacataatggttgtatttgcataactaatgggctggggattgactataggccattaacagttattaattaatgagattgaattagaaatatatgggtttttatttcaaacttaggaggcaaaggtcaatcataaaaggttaataacaatattcaaagaatcaggcagtaaatattttagcttttagacttcatgcatttctgacaggataattcaggaattggtttcacctctacatgcatactggggcacatggaagtatacacatgtgcattagagaaacttttattagcctcagatttacatgtaaattaaagtaatgggagctagttgtattcacatataagaacttaatgcacctctattcataaaaatcacaggtatcacttgagaaagttctacaacctaaaatttttctttcttaaactgttcatttgtttcaaggaaagagtgcaggtacacttttcaattaatcttcctcatttttgcatttgcaataaaataggttacattatataatttagagttactccaacctttccactcctcatttatccaattcagtttacaattggaagcatcctctatatttttaaaaacataattgcctgtagtttaaagattttagaaactcaaagaattcatctgctatttttaaacaatttaattatgtgagtgatgcataattattgaggacaattcaattcctttaatttcaaagacacctgtataatctgatttttcaaatgatttggttgtatctctacaaggaactgagcagctctctacactgaatcagtaaatgaggttcacgataaatgaaaaggagtgatttctttttatgatcaactgccaaactgatacagaaaattctgtcctgcatcttctgcctgttgctcctgtcttgctttcttttctctcacactgcctgggttcttgctttatgcctctgccctcttctttttccctcttctcccttctaagaacgctcgcttgctgaaatgccttgaaatgatgtccagggatagtccctgggtgaatgtttcagatcctgtttctcatttcacactctgtctgggcctctattctattaatagttaacttaaactggattatcttgagtcttctagattttaaaagggttgctctgattacaaaaagatgattgcttaaatgcaaaagagtattacctcaatagatgggaaaagaatagcatttattgcattattgataacatctttaaatctgtgtcagttcccttcacaaattggcttttatatgcttctctgtgggggtaaactatatgccacagaaatgttgaagttcggagtcacagaacgtgggcttaaatctgtgacgctttgtttactgtcatttaaaaaaataacctttttaattattaacaaaatcttgcctttgtaaaacagggtagtaattctcatttcatagattaaaagtgtaggttaaaaagtgtaaattaaaaatgaaaaatgatgctacatataaattacaataaatgttagtcgctaattttaagatgattttttcttttctcgaagaaaatatgtaaatacaagaagccacacaattcaggcaatttctagaagtcattcattaaaaatatctatttcccaaggtttatccagagcttcacagtgggactaagttttattatttaacatacacagacaatggtggtattttaacaatattggatacacaatttgaaaacggtgttttattatctcgacatttcaggagtatgaaatcactccctgccttgtcatatattagctgtttaaacgaataggcaatcatctcagagtattaatgatctttctatgttgtccactgagaatgatattttagacataggtatttcatttaaaaaattagcagagacaccatacaattctggtaaaagctttaagtagtataacttactttttgaaggaactcggagattggcaaggaccacttccagggaatcagcttggactcgaagtacatagcttgtcctggtctcataatccagaggtccattcacatagataacacctgtgatgttattaattccaaatgtatctagaaattaaaatacaattacctggtcattgtctttacgctataaggaaagaaattctctttaaaaggcactgtgatttcaaaaacactaaaaatgcctatttataactagagtgatgcatgaaagtgacaaaatgctggcttttggaaactgttccagctctttgaatgatcaacatcaatacttcgctaaagtctgccttgaaattgtagggtttttttgtttttgttgttttgagataatcctggaaaacaaagttctatggtcaattacatttgggaaacactgaataatatattctttaccttagattcagatggtcttctgtcacactaaaggctttcagaagttgtttcaaagaaaaccatctaattttgtttaaccaaaattttctgaacttactggattattatactctttgtaatttatgaatattattattttgtagatttagtgttttgctaagaacacttgagagaaaataaaaaaatggataatttaatgttgccctgtgtctgtttatttaaataaatttgaatgaaaatcagggcactttggtaaactttataatatctccccctcttatgctctccatattctctccttactttattttttcatgtaattaataatcccttataatactatatatttctttgtttaataatttttattattaatctccgcttactggaccattaacttccatgagggcaggaatctattttgtacattgttctatctgtagtggctagaagagtagttaatacataatagatgctcagtacatatttgttgaataaataaataaatgtacaacagtcactgtgggggacagacgttaataaatatagccactctgctgtcttcaaagaaaaggacaaatagaatcaaaagagaaagtttcgggacggaacaggttgagaaatcatagctttagtcagatgttcgaagtccaaggaaaaaggaaatttagttatttttagggaggacacatagtagcacagtaataatgtagaaagaaaggcaataaaagtaagatattgaccacttgctacactacacgggcagcaatacctagtaatagtttgtcattaaaaagcttaacagggcctttataatttccttgcaaactcttttacattcactcatttctttaatatttactattgattaacttattacatgtatattaactatttcctgactacctacaatatactaggctatctaacataccaaaagggaaaacagaggagaacttgtggagaacaggtaaaacaaaaattaatgcgaaagattgagctatgaccttattcccagaggcctgcaaattcctatgattcttaaattacaaaaacttatatttttatttttaatcatgaattgtatgtctaatttgactattttgggaatcatataacatgcatagcttttaacatggatgtgactctttttaaaattcacaacttatttacaaccttgaagttccttcaggattagttaaggtatgaccaacatggagtaagggtcatggatggttcagacactggggcggacgaagctactgtaggcaatgatcatggccaaaagctgaaaatttcatgatgcattaattttgaggaaatgtcattaaaatattaccaaatgaggaaaagggcaaggtttcattaattagatacttaatatttcttaaggtacttaatatttcttaagggaaaaaatcactttagctaacatcactggatttttaatcgagttcaggatacatggttaacaattacatttaagatgggcacaattttattagaaaacaatagaatagataataatttcaattcaatctgaaattaggccaaatctaagtttactggttgatggtgagaacacaaactaaaagtctactcaccttcttcatttcctgaaacaatggagtacacaatactttgattaatggcagcagcagaaattacaccaaccatggtccctttggtggcaagttcacttactggaggaggtctgcaggtttagagaagatgatgtatttatttttaaatataatttttgatgtaactttacgttcacagaaaaattgagagaaagataagagatttctgatataccctctgccctcacacattcatggcctcctccatgatcaaatcccccacccaactgctacctttgtgataaatgatgaacctacattgacccattatcactgaaagtccatcatttacatgagggtgcatattgttgttgtacattttatgagtttggacaaatgtgtaatggcatgtatccgctttcatgtagtatcatatagggtattctcactgttctgaaaatcctctgtgccctgtatattcatccctcccctcaactcaacctctggcaaccactgatctttgtagtgtctctatggttttgccttttccagaatgttgtatagctggaatcacacagtatgtaaccttttcagattgccttctttcacttagtaatatgcatttaatgctcctcaacatctatggcttgattgcttatttcatttttagcactacataatatttcgcggtctgaatgtacccacagtttatttccataaataaaaaacatcttggttgcttccaagttttggcaattatgactaaagccactataaacatctgtgtgtaggtttttgtgactctaagatttcaactcttctgggtaaatactaattagcatgattactggattttatagtaagactgtttagtcttttaagcaactgccaaactgtcttccaaactgactgtaccattttgtattctcaccaacaataaatgagagttgctgttgccccatattctaaccagcttttggtgctgtcaatagtctggatttcagacattctaataggtgtgtggtggtatttatttttatttttttatccatatttatgacagagttttgaacttaatagaagaatgtacacggtagttcttccaagctacattatgcaattacattgtgctttcattgaaaccttttacaaaaaatcctgaaatacaaatttagtctgaagtataggctttataaatatctggtccaaattgctttgtttttggtactgctgtccatacacttaattgactaggttatctaaatgtaaagcagtctttctcacagatactctagcacctaatggtggtccatatattcattgcatgagcaataactgcttcttgctgaagaataagaaccaatctgtatcattttaaaatgaagtgtgtaaagtagatatttaatttactagtttatttacttacttattttactgtcctgcattttctttttgctttcttttgataacatccaaatattgttttcaataatcttgcctctttccttctctgtacaagtgctttgggtaaggctttgccaatccccatggtacatgcataagcacattaaccaactctggtcaatgggggcattttatcctttgctcagtgttcatgtgatgtatacgtctcatgtaaattcaatggacatactacataagattatgacttgactagattctcgctagccaactttttgggtatatccctcactggatttgatgaagtaagctgccatatggagcagtcctcgtggcaagaaactcaaggtgatggctgactaacagccagcaaggaatcgaggcccttagtccaacatcccacaagaaactgatttctgccaacaaccacatgtacttggaagtggatctttctgcagttgagcctcagatgagaccgtagccctggatgacaccttgattaaaagattatgtaagtccaaaaaggagaggacacagctaacccatgcctggattcctgacctataggaaattcaaaatgatatatgtgttgttttaacccattaagttcatggtaatattattatgccacaacacaaaactaatatttgaacaatggattgttaatttatgacagatcaagatacatactacttatcaaaagtttaatacaagaaaatatgtcagtcatattaggggataattttcaaaaactgaattcctatttgtggaagtagacattacttaaattgtttacttgtctatcttgttactgcacaagatagaagctaaattttatactttccataattcatctgtttgctattccttatacagtatggaaacaagacgtctgcaacttatgcacctttagctttaacatgagaaaaatgctatgtcgggccgggcgcggtggctcactcctgtaatcccagcacttttggaggctgagccgggtgaatcccctgaggtcaggagttcaagaccagcctcaccaatatctctactaaaaatataaaaattagccggttgtggtggtgtgctcctatagtcccagctactcgggaggatgagacatgagaattgcttgaacctgggaggcggaggttgcaatgagccaagatcacgccactgcactacagtctgggcaacagagcgagtttaaatctcaaaaaaacaaaaacaaacaaacaaacaaaaaaaacaaaacagaaaagaaaaatgctatgtcttctttcaaatattaaaaaatgcacgtgtacatttttgctaaccttaactgcacaattaggatagaaataatactaaaaaaagtaattggcataatttaagaagacatttaaatcctatgcataccactaaaagcatttaaaattctatttgttagtaaatgtttacaacagatttacttctagacaaaatttctcctcattaacctttgtcttaattgttccagtacacttgtttctatcagaactaaaacactatacaaatacaatcttctcccaaaaagaattaaatgaacctccatgataatgagcattagattaaaaatatcaattattttctattttttggcaggattacaatgtacaatattaataaaaataatattattttattattgttttaggttgtggaaagtaccagttacatgatggaggcaaattgcatactctctttggagtcacatatgtcttgaatacaaatgatggagttggtataaatcaggattcattaagccagatggacagagaaggtaggaacataaccaaattgaataaaatgggctgaatataaattaatagggagaggaatggaagttaggaatgagagagtatgtaactactgtacaataattcaagtctggtgtgatttgtaaatcaataaaggaaattgaaaattttgtatatgtttatgaacgatcaatgggaatttatttttttaaagcatcaatgactacatttgatctatgggctgtcagtttacgatttttaaagcagattaactatctctaatgtcttttctagttctaccattctgaacctgatataatgtgagttatcattcactcttctttctgttgagtataatcaaaatctattgctcaatttcagaagcaatgaattatggccaaatgaaacatttctcagaaggttttctaaaaaaatattttctctattaaattcataaatcttcaattcatccatttatgaaaaaaatgcatcactagctctcttccaatttaagcttttcgcacctgatttataacaaataattgtgagtgtctgaaatggaagaatactatctttcaaagctaaatttactgccaatacaactgacaaactgcactcttaaaagaaacacttgaaacagcttcagtaatggaactatacagcttactgatgtagcttgagatagataccaactagatggccattttccaaagatggctaagaggatgctaaaggaaatggttatttagcagatatgaactggaacatgggagaggctagtggtttcatgttttcataatggccttcagtaagggcttcctcaaaggccctttcacaaggcttgacctgaattgggtttgatgtccttgcatatccatgatggcagtgttggttcctatttactccacaacggcaatgcttctaactttcttggccgttttaaacaaaatctacaggctttgactaaaattccaaaatcacctcaactaaaactgaaatagaatccgaaataatatttgttttataaatatatttcctcattgttactatttgcattatccttaccttctaaattttacatgtaaaacagctgtgtattttcaaaattaataatatttttgtttttaataaaaatgttattgagaaataaattaagataaaaatactggcacaatgcctatgcatttcagtatatttatacttcctcccagaaaagttcaatggtctcagaattttttgtattcttatttattttttaattggcaaatagaaattttatatacttatggtgtacaacatgatgttttgaaatacgtatacactgtagaatggctaaattaaactaccatttgactacctcacaagtttattagtggtgagaacatgtaaaatctattcccttagcaatgtacaatattgtacattgttgtcaactatggtcaccatgttgtaaaagaaatctcttcaatttattcttctaacagaaattttgtatcttttgacaaatatctccccaatccttcccttcctacccagccccatgtaaccatttttttacgctctactttcatgagttcagctgttttagattccatatatattagctttattagatcactattagaacatgcagtttttttctctgtgcctgatgcattttagttaacataatgtcctccagatttgagacaaatgaacgtatttgagacaaaatagaatactaaagtctaggttcattcacattgtcccaaataaaagaattcccttcatttttaaggctgagtaatatttcattgtatatatatatatatatatatatatatatatatatatatatatatcacattttctttatccattcattcactgatagatattttgtttgactccatatcctattataaataatgctgcaataatcatgggagtgcagatatctcttccaccaatagcctgatttaaaaatggaccaaggagcagaatagatagttccaaaagaagacatacaaatgaccagtaaatatgtgaaaaaaatgttcaatatgagtaatgatcagaaaaataaaagttaaatctacaatgagatatcacctcacatctattagagtaactattaataaatccacttcatataacttgtgtgtgaatatgtctctcaccaggttcaggcactggtaatactgcagcccagaatgcagtggagggaagcatttgagttcctattccggctggttcacatagtgacactgtgtgctatcttccacacggtgagagttttcccttaggatcagttattagtgaacttccttcacactgacctaaaatgtttctgtttttcgtctactcatctcacttttcacctgaacccctggtaaccaatgatctttttactgcctctatatgtttaacttttctagaatgtcacatggatgaaatcatacagtatgtagtttttttggactggcctctttccttatcaatatgtgcttaagtttcctctatgtctttttgtattgtgatatctcatttcactttattgctgaataatattacaatgtattggatgtatcacaaataactgcacttttgtaagaagaaaactgatcaaaataactccaaaatggtttaaagtaaatatttgcagattaaatgcaaaccgaaaaagttaactgctttggaattcgcatgcacaatacttacaatataacctcatgaagatataaactaattcatacatatcctttttgttttgtttagacggagtctcgctctatcgcccagactggagtgcagtggcgcgatctcggctcactgcaacctgtggctcccacgttcaagcaattctctgcctcagcctcctgagtagctgggattacaggcgcccaccaccacacctggctaattttttgtatttttagtagagatgaggtttcaccaccttggccaggctggtcttgaactcctgacctcatgatccacccatctcggcctctcaaagtgcaggattacaggtgtgaaccaccgcacctggcccatatatatccttttaatatttctaagtgttttttgaaaatatagattacaataaatctttcaactgagtatatattaactaattttctgaataatgactatagtagaataacataatttgcaatgtctaaatgttagacccagtttttaccgtataaatatagatgaaacaattacaatttaaaatctacttttattgttgagttcaagaagtaacaataaaagtaaatgttgtatgtgtcaaataaagcttctaattattttaaaagccaggcaatttaggatataaaagtgtttgtaaatagatgctataaaatttcactaggattcaatctggctctattgctttctttgtactaagagacaaatctaatttattttgacatgtttgagttcaatatatttgcaaatcagtaccaattaagatactgtttttctacctactatgagaggatttaataaaaatgggaagggaagaataaaaaaaaaacacccactagaactccgattatttataatcttggagtaattgcatcagagtgatctaattttacatatttaaataagaaaaacagtttaaaaaagacatgaatcaggagagagatgctagttcttccagaatacttaggatggattttagataagaaaattaatgaagggccaaaagactagacactgctttttacgtatgttccaaagaatgcgtgctttctgtcactaagagttttgcttctattcagttccttaaagaatcttcatctggaggatacaaaaactgaagtataaacaatttatccaaatatttgaaagcaaaaactgcaatctaaggtgtttggtttttcctttgcttaaattattatattgttctcattaaaatagtgtgttctaatctctcatagtcattggctcttaaagcttaaatccataagaatgcgctggagaaattttttaaacttactaaagtacagaagatccctgatttatgatggtttgactttcggttttttactttactatgggtatgaaagtaatatacattcagtatgctcctggacttacaacggggttaggtcctgataaacccatccctgtttgtctactgccctaccttaattattatagagggcccttctcactctcaaaagtgccctgctttggacaataaattatatggtcttacctatgctggaaactatatggatatattaaagtagcaaatttattcctctcgcttgaaaatttacaatttttttttagtgagaccgagtgtacaggtaatcagaattctgttttgaattatacattatttgacattaatatagtaatttctgctttcccttgtttgtaattgccagatatacattttctgttcactctatttttgtgcatgtgattttggtttaagtacattacttaatggcataaaatcatgtgtgaaaagtttaccagaggtaaaaagcattcttagaagattaagtaaatggcacagctattaagcaccggaggagttgggaaatgaatgacttatccattataaattggtgataaaaatgtgatgattttgaatcaagatttaaatagtataaaattctactttccatggagattgtggaagcacaaagtgacttccattaagaggatatgcatatgtcatttgcctgtttaacaccattcaatgtcttcaaatttctctgtgataatgaacaaagtttttagtatgactcagtaagtcccttcacagtccaactctccctacttctccagactcatcaccataggactccatttagtatgctattttgtctcaaatatgtttgcattgattactaataaaataaaattaatgtatcctactgtatgttttacttggatcaaaatttcccatagatacaatacaatgaaataatgggacgtataaaatcactctttgtattgaaaagtttgtgctaaattctaaacagtggatgtaagttgaactgtttggacttgagtcctttgttgaaggaagacttgcttcactctgctacatgagcaaatgccaaaatgtgtataaccttggaaatgtgaaagagaaattaaattccatgtaggtgcacagggaacctatcaaaactgtaatgaaagattgtcagaatcattttgtcaatagttaaatgggcgaaacctattatgtttgaggcaaggttttaatagtgccataaaaagacaggaaaggctatcttcaggtaaagccagctcttacattggacaacaaatctaaattaaaatagaaaacaattttagcaatcgagttatgctctctgcatatgcatttgttttacattattttaatagtcttcagacagctttcattaacttatttgcaatcaagacaaatcattctttccaaactattgttcatcttattaaaatcttttctcaaaatctgtaagtccaaacttggaaggttttataagaatgatagcctgggcaatatagcaagacactgtcactacaaaataattaaaaaaaaaattagctgggcatggtggcatgcacctaaagtcgcagctacttaggaggctgagggctgagatggaagattgcttgcagtgagctatgaccgagccattgcaccacagcctggaagacagaatgagatcttgtctctaaaaagaaaaaaaaaatgatggctatgttcctcaacataaggtaattttaattctctttaataatgaaatgttaactagacctgctcacttgctatttctttggccactgtgataatattacttgcattttcatagtttacaaaaatgaatgccttgattataaattatactttttctgttttgtatatcaagaggtataatgctaatcctttgttaaatatactctaattttattctttaatataaagcttcttgagaaacttattttaagtataaattgtgtaaaactttcaacctgtcatttattacaaaactaattcgtatgaatcaaccaactagcaattttttattttaacagagaaagtggtaagattatcttttgaagaagagttaaagtttttcaaaatttcagaatgttcacatgtataatattctgattttgaatttgatatattaaattttaataataatagaaattgaaaaggacttatagtatattctctgagtttagcaatatatcaacttaagaggttaacaaatataacttagggatatttgcccttattttattatatatataccagtataaattttgaatttaggttgttatggaaattacacttgcaaatatacaaatcttaaaaattaacatgaatgtgacactaaatcatgcaatggttaatattcaagttgatacatttccatttttaaataaaaaacaaaggcctacctatataggtggcatatatctttgaaaattttgcaattaattgtatttggcaaattttttgataaattgtgtaatataatgcatttcccactcaaaatcaatattcacatttagactctatgatctattccagacgtgttgaccttttcatgatatttacttttaaaactgatgacaagtgaatttcagtgtgtataagtcttagtccatcatcctgaaatgaaggtcaaatgtcattctcattcttcagaaggctaacttacttcacctatgggagtcaatgtaatctcaagtagtatgtgtttgaactactattaggattttgctatttctgtagggtttaaatgaaagatatataaaaggaatttaatgactctgacattgtaactaatttctaaaatatataaagagataattgaccgaaaatctcttagtaaatatgaacatgcagtgacaatgagagtatgcctctcagatcttcaactacaggaagcacaattggtcaaggtcccagttactgtggactgaaatctgtttatgtttgtatgaaggacatagttcctaagggctgcttaaggagtcaagtattgaaatgattattaggccaactaaatgatctctatagtctatttcattcattgcataatgtgaatttgagaaaagaatttttatgaataagattaacacatttttctcaatttctaatgaaaaacaaattgtagaaaatgatttaaacaaagatatgcaattgtaaatagatatgaagaaactacctaatcacttgaatggttaaaaaatcaaagtttataattggaatatttctgtgtaatagggatattacccggacttaattcatttccctcccacccccaccaaaaaatgaagctagttggagataattttgagaaagagaggtggaggatgtttcaacaataaagaatgaagaaatgccattagctttttaagaactctttgtttagctctttgttcaaggaaagatagtagagcaagaaggaagaatgatcacatggggcatgcaaattctaagacactaatatcattgttatatctttgtcaaaaatagaaactgaaggaaccaaataaaagagaaacaatgcatgtggaagatttgttacaatttgagatttttggtcgtgtgtatgcttctaaaatatacaaacgtttgtttacagttgtagaaaatgtcacaggatccttgggatgttgcttttccagtaggaagcctctgtggctggtggcacctttacatgaatttttttcaggcctactgggcttgtttcacccactcagcctggcaggcttcacttggcttcttctaccggcccagatcccatgcctgccaagggtgagccaggtgcagagcagcaaggtggggatgagagtgagtgtggggtccaccactgtgcacagccaggcacgctggctgctgtggtgggaagggtggccccaggtgccagcacagatgccagctccatacaagccagtggctggatctggtgcactgcaagcagattccactgaaggcacccatgtctggatgaggagaacgtggtggcacccagtagattggagacaacagaaaccagagtcccaaagacggtgtcatagccctggctcagggagctcctaggtctgggatccctgaagggccacttcgcttctcttctctccttctcattgcccacaatgtggcaagcggggaggcatgtttcagccctgctggtattactgctctttcagtcctgccattcagcaggtcccaagttcttgtcccacatctaggaagaattaggtatatagccatctgaagggtgagcaaggcaaagaggtgcttcattgagcaacagtacatctctcaggagacctgaaataggcagctcctatatgcaggcaggctgtcccgatgtctgcagccctcagtggcgaggagacccagagtgggtagctcctatcctcaagcaggttgtcctgatgtctgcctgagtctggttgagactggggtttttatgggcttcagaagggagaaagtgatattgctgattggtccatgggcagccatgggcagccataggcagcctggagaaagcaccataagttctcactccagtccagggaactggcaggctgggcaccagccttcaggcaatccttggctagaaggtggggtttcaccagacccatccctttccacccaggagcctgtctgccttctgctgccattcatggcacccaggctgtttgtgcccaagaggttcctgcaggcccgctccaggccacccccagccccaccttggcttctctcccatgctcattggtgcccaaagtccagagtgggctgaggtggcaaggggctggtatgtcagcaccacatgagtgtgggaacacacagccaggtggtgacaatgctcggggcttgatgacagctttgctctgaaattggagcaggccctggaagcagggagaggccaggcattgggagaacacactttgagcatgcagcaggaggggggcccaggtccacagtctcagctgggtgattgcacctgcacctgagagctctgggctccagcccctccaactcagaagtgggtggggcccctgcctgttctcagctctcactgactctgcagagtgcatagccccagctgtgtttccctggttgcagccagcgtctttgcagcaaatgctccagacaggtcgctgttgtcatcaaaaggaatagtatacagtatgaagagatatatatttcaaaagttttaagaagaactcattgttttctggatagaacaattgatcattaatgacaaatgaagcacacaatgtcttgatcctccatttcacctaagtgactccataaaagattgatgtgaaaaggtcaagaaattaacaaaatgagtctgtttcaattactataacagccctacaaagcaaagagaatcaagtgtatagtaattcttatctactataactctggccattataaaagtaaacatatgaggcaattttcttgccattatgtgattactcctacccttaatgattattgaaagccagccaccaggaaataacatcagttcacaggatttgaaaaaaaaaatcaaatcttttcccaatacatataaaatatcttaatattataaattataaaccagaaaaacatcattttccttgagaaatgtgtttttaaataatgacaacctaatttattttattgagtatagggttgtctttgtaaaattcttcaataattttcaaacttcattaagggagcattagcagaaagtaaagaagtaatttttttgttctgttttgttttgttttgttttgttctgagacgaagtcttgctctgtcacccaggctggagtgcagtggcgcaatctcagctcactgcaagctcagcctcttgggttcatgccattcttctgcctcagcctcatgagtagctgggactatgggcacccgccaccatgcctggctaatttttttgtatttttagtagagacagggtttcaccgtgttagccaggatggtctcaatctcctgacctcgtgatccgcccatctaggcctcccaaagtgctgggattacaggtgtgagcaactgcgcccggctgtaaagaagtttttaaatatgcaaatgaaacagaggcagagcatgattaactatgtggaagaaggggctggttttttattatgttgttacttttacataagtcagaaagcctactaattatctgtcatcaaaacttcacaggcaaaccagtaggtttttcctttagtaaatattaaagtacttactgtggtgtttattacttgtgtctattattttgctattttacaattttggaagaagacaatgataggtctattgttatattccagcaactaatcaattaccaatagaacaacatagaagtgctttcaattctaaaaaaagaacaatggattttgtttctctgtctagctagaactggtatactgaaaaacgtatgccaaatagtaaatgcgaactctgaaccatttttgatcaaggtcttcacaatgctagttttcagctcataactcaaatttacactttgccattatgctttcatttttattttctttatattttacttctgtgaccaagacactgcaacttctcagaaaactggagaaagtaattcattgtataaaatattcaacctttagcttgaagtccagaaaggtttggcttggaatatgtaatgttaatactcattaaactgaaatcactaaaaatacagatttttaaaacaaccagaaatgttaatctgagatttgctttgaattaagaaaataaatattcattctcttgatattttaagaacaatttacttcactaacgcatatttaaatgtaaaaatgtttctattctatcattagctcatgtaccccatggtgcattctaactaatcagtcattttaaaatcactgtggcaattaaaatctatgaatctgtaaattgtttacaatcacatgtttaatgtgctaggtcttcacctacaccatttcccctttttcctcaacaactgaggttgaactaggacacagttgcctagcaaggaacagcattcctctcccctagttagagctaaatgtagacccgtacctggattctcacaacgtaatgtgagctgaactgaaatgtgcaattctcacctcacttggttaaggaaatctctagatgtggacttctgtctggtttcccctttctgctgactaaaatggtaataatgagttattttgaaatagagtgttgaagatggtgacccctgagttgtcccaggtccctgaactttaaaccattgatatttggtggtttcctattacagtgacctaaactaccctaactcagtctgattaccctgagatttaatgatttaatgactgtctaatagaaataagtcaacggagtcagtgacagaacggggacgtatgggtcaataattcagttaaacattctacgataaataaatactttatctttaaaatctctcttttatacctaatcatttgttaaatgctaatttttcctatggaattcaaacacaagtattggaacgaagacattcctgagatgtaaaagccatgtgtacctcagcttacagtgctagattactgctttccatttgtaacacattaccttcccctacaccctacaaagaacataaatcttgagctatcatttttatatttcccccaaatttgatcacaagaagtagaagttttttcactaggagcaatcccaacacgaaagaccatcctaataatcaaaaattaataatgtcatttagcatctctgggaataatgtgcatccagttgaggcagtaaaatgaatttgaaaaaattagagaagaatgaggcatatgaggttggcagaaaccattctgtgcttcactttttttcattaagaaaggaaagtgtgttggcctctaaagcagcctgaaatggcataggcatattgccaaagctagcaattgaacatattaaaagaaaataccatacagaaataaaaatattctaccatgaatattttcatatttccatatattcatattttgcaatatgaatgagaatgacttttaaatatgattaattaattatgcgattagttgttggaaactaataaaatgttgaacaacttatattagttgaaacaacagtagctaataggactaagcctgctcaggaaatgatgcagaccacttagttccatatttttttggccagaaatcagtcaaacggcagaattcagaattcatccctagttaataaggagaggaaatgtaatccagctatatgcccgtgagaaaaaggatttaggaggcatccagatactgctatgtatttcctcaatggtcttcaaaaagaatgaagagataattgaagatgataatcattagccttaagtttctttatagttcagttaaaattttggttcaaatttagacctatataaacatttatattcaattatttgcatttatccaaaaagtagtgtccttgttcatatttggcataacatttatttttcaaattttctggttatttgataaaaaattaatccttttaagtactcaagtactactaaatgcattatgatcaagatactgattcttagcatctctgggagttatgtgtgtacagttgtgtatattattaatacacagtaggatgcaacaagattaccaaattctctttataactcagaataacaaatgaactgggataatcaagggcaattttgtaattgttagaattctggaagatcaaaattctcccacatgtacccatgtgactgttgttaattttagtaccatataattggctaacttttgctctctaagttaacaacaactttattaagagaatctatttgtagttaatagttctatgcagagacggtatgaaatggtaaattatacgttgaacaacacattcgcatttttaaaacatggcattaagcaaagatacttaataaagaaagttaaatgagcaatgccctgtttcaatttatgaccttggcctcaatgccacaatattttagctaaaagagaagtctagaggcatatttctattgacaaggaaatgagctctaaatgaaaacctagagaaacagtacaccacttaagtttatttaaagaggaagtttaagcaatatatcactttcttctcttggagtttccaaagataattagacttgccgcaaggggctttgaagaacacagatgggaattttaagttaaaactgtgagcgtttttttggatccacttagaagactaagtatattttttgagaacacctgatctagataatttagtgagaaacaaagtgagtttatatccgtcctgttcttgagaactccaaaattaacatgttcagagaagttcttccaaaacagaaaactgtgcataggagtccccctttatttatgggggatatactccaagacctccactagaagcctggaacttcagatgacaccaaagcctatatttactatgtttttttttttttcctgataacccagacagttactaagtgactgatgggcagcctggatacaatggacaaaggaatgattcagctccagggcagagtgacacaggacagcacaagatttcatcatgatactcagaatgccatacaatttaaaacttacgaattgtttatttctggaattttccacttaatattttctgaccacggttgacctcgggcaacaaactgtgaaaaatgatactgtggataaggaggggactactgtattccatagcaaagaattggaatccaatccaaaggattggaagcacaggttactgtgtcagaaaaaaaaggaaaataatagataataatgtacatgtgggtgagaataaccttttaaaacagattaaacaagaattcttatttgttttacatatggtttacatctcgatgatttacatacatgctatggaagattttctggtaattatattacataatttaattttgtgtagattcttctaaacgcagctttgtatgagaggatgaaactgcttggttcagtgggttaagtgcttgcagatgtatccctcacctaccttattcctcagtaccttagctgctgttctagcttaaaattattaattcattctaagaaagtaaaaaacactaaagtcatcctagaacatgatcaagttctccattacctgaaatattcatttttcattatcctcaattattatcatcatccaactttcaatttttctttggatagactaaactactaaaatattctggaatttaatgtagactcccacaccccttatttatatttctgcataggctgaatatttggtgtggaatatccatctatatctttttggattgactaaactctacatttccttcaatctacaacttaaaactgtgttaatcatgttcaaatatagttaagtgtcccttagcctgcttcctcaatactgtgatcttatttctaccattgtgttctcacagtgtattatatttttcatatagttatttgtttccagagataccagagagcttgctttctctctctctctccagataaggacatggcaaaaaggcagctgcctattaagaccagaagagaccctgaacctgaccatgcagacaccctggtcttaaacttggattgtcagctaccagaacaataagaaaataactttctgttgtggccgggcacagtgcctcacgcctgtaatcccagcactttgggaggctgaggcaggtggatcaggaggtcagagatcgagaccatcctggctaatgcagtgaaaccccacctctactgaaaatacaaaaaattagccaggcatggtggtgggcacctgtagtcccagctactcgggaggctgaggcaggagaatggtgcaaacccaggaggtggagcttgtagtgacccgagattacgtcactgcactccagcctgggcaacagagcaagactccatctcaaaaaaaaaaaaaaaaaaaaaaaaaagaacagaattttctgtcgtttaagccacccaatttatggtattttgttatggctgcctcagttgactaaaacagtatatatactaaccataaactataatatataatattggtgtatatgcatatagtgtatatatataaatgtatatgtattatatatgtgtatatatagtgtgtatatatatatacacacagtatatatataaatttatgtatacacacagtatatataaatacacacactacatttatatatatatatacacactatatatatacacatgcactacatatttacacacacaaacgtacacacatacacacatacacactgattagatggaaaatatgattgcagattgcatgccaaaattggaaattgaatgaaatgttccacctggcaataatgagaaactaaagatctatttctcaccattcagatcattaattagaattgaaaccccaaaatataatgttgtattttaataagtttgcactaattttttaaaaagtatccattattcattaaaccattactaaaacatattttatactaaattgtcatattaaccatttaaaaatttaaactatattttatgttaatttagaaacgcctaaaccaaaattggaagtctactcataaattcatattacatcaattttgagagactcctttcaaaaatgccctaaacatttcgtgtatttcaaaatcggacagaaatcaatacctatattcctcctgtgtgaagcgtgggatctcaccaggatgtaagacaagaatcttcactgtggcactgctggacatcacaggctccccatcatcaaaagcaaccaccaccaacttaaaaagcaataaaaattcatgttaaagattataagtaagaacagcgtaacagcacaatttttatatgtatgtttttacttattggattgcctggttccagaaggggaagcaatgatcatttcctcactgcctaccaggtggcagacactatgctagaaaatactacgttctcacttaatctttacaataatccagccagataaatgttattattttcacttgctagatgagaatactcaaagaagtaactaactctatgattaaaaaacaactaccagtaaaacaagtgtattatactatatctctccaattaaagactcatttctataattccactgaagcccacagtaaatacacatgattttatagcaccaatacacttatttaagaagtgttaaattcagacacataaaaagctaattatcttgctcaaaaaagaaattaattttcctagtgaattagttgtttttgagattatagggcagaaatactttactctagaggataaaattggaaatctttatagtttaacactctttggtatactatctcttaaaaacaaattataaggccaagttcatttggtatagcagaaattgttcaaatgatgaaaactaagaaaaagctttagtgttgagatgtgatgtctgacattatttatcactgcaataggatttataattgattattttctttaataacctacattacatcaaagtaattctatgtttactttaagacatgttaaatactttcagaactatgtgcttctttggaatataaattgttttggaagctgcaggttaacaatgtaaactaattcaacctagatcacagaagactgtaaccaaggatcatcctgagagccacaattgacctttgggttaatgctaatttacaaactgatcagctgttccaaacagcggtaaaatcatgagagacatagtgctcactgatccttacgtggttaactgataaagctatttccctactgtagagtcaaagactttattcacagtgacaaaaattattctaagtaactattaaaaatggaaatgttcaaacacttaataaaattgtctacttatggtaatgcaaattattgttttaataccttgccaggtagagacaggcattattttgtcaaatatatttttaaatatgtaaaaaacaaaagagggaatatgttctgtttcattagtatttgaagaaaagtaaaatttgacaaaaaatcaaatagatacagatattttcctagatatatgcaaagattaacataacaacaatcagtattgagtggtattaggaaaatggatactctcaggaaagatgaagaatgcatacaaggggtatttttttcaaattttctaggattgtaatatatcaatcttatcttaaaaaagtgagtaagggaaaaatgatattcatacaagtagttgcatgatagcatttattgtaacaaaaaatggaaagtctaattataaagcaactcagtattatattaaaaagaaaaacaaaatgttatatagtaaaatactatgaaaccactaaaataatagtattaatgtcacttattggcatagacaacatcatattgaatttaaaaaccagtatgtataagactatgtgatttgaaaacatatatttatatatttgtgtttgtatgaaatgtcatcatgaggatagagatcaaaacgcaaattctagctatttccaagatgtgagataccaagtggttttctttttactatttttgtaagtttctaagagaaaaaaaaattgtaatttaaaaaaattaaaaaggagaaaaattgaaagaaaaaaatgtgctgtcatctgttaagccaaattctctatcaaaaattaaacatcaaatagaccacataatgaaaagagacactgaccttaaaaattgttgtaggttcttcattaagattgactcgtgttattactcttccagaatcttcttccacttcaaaaatactggcagggtaaggaaactgtacatcatctactctatacctcacacgacttgcaggtaatccctaaaataaaattattaattattaatttgctgttaccaagttaaaacacagtgcaatgataatattaaatggatctttaaaattcatggtcttttagaagtgaaaatcatatttccatattttcattctttcagagctgaaatgtagccagatcattatttcttcatgataactcaatctgaatcaatgaagtatctctactacaggttattttaaaatgatttatatgagagaaaaattaatggttgctttgggcatcttctctaccactttcctttaattatgtgaattacatcttcctcccaaaacacccaatatctccttttttaaattcagagacagggtcttcctttgttgcccaggctggagtgcagtggcatcaccatagttccccataacctcaaaacttctggtttcaagtgttcctatcccactttagcctcccaagtagctgggaatacaggtgtgtgcaaccatgcttggctaatttgagaggactgtagtaaagtgcaggaatggacatgaaagctaaaaaaacaaaaattatttaccatctacactgtgttgattaccatgctaggtatttctatacatcattaggttaatgctcaatcttttaagatgacattaataatgaagatgatagtaataatggtaagttaatgacgctaacaattgctagatgcttaccacttgccggaaccacattaaagatgatgtatgtgtactctgttacccattttagagctaaggaacttgtggcttacaataagttaaagagtgctgaaatattccagagataggccaagataagttgggacaccaaacaaagtcacttttaaagaaaacaattaaaatttgataagtttttaaaagaatcaaagtgattgtaaaggaacagtcaaaattttgctggctgtcctcacttatattaggtttcagattggtttcctttggaactatgtagggtgacattgaggtgagcactgtaacatttacagtgcttaggccttgtaaatttcttaaaacctagaagtcaaataaatatcttgagcagagaactagtatgtggtaaagttttacttcaaacctaaacactaaattacaacattaacttcttcagagaaagaaacactcctatttggcattattctgatgaagaagaagtaagaacattaccccccacagggtgttgatttggctggacttgacactttggtgtaaaaactgttctgagaacattgctttttatatttccattttcttcaagactgtccttgaaaataatctgttgctcatgttggttcctgaattacagttgggctatgagataaatatgagttttcaggatttgtataattccctattttctgttagttcagtcctttcatatactacacgtcaccactgatgactgtctccttgaatacattctttatttaacctttttccactattctgccttttctccttcccatctggtgctctgtctcagactctgcttgttcccactctttctggctactaaatgttggagttttccaaggctctgtttcaagaacttctacattttctacttctactctcggcccctggaacctctcccagtctgatagcttcaaatatcttctatttgttcataaatatcaaattttaatatctggctaaactctgaacattttaagtccaaactagtacacataattgtccacagatatgctattttcaaataaatgtattcaaaaccagaatgatttcatctcccaaatttataactcttctactatagataatggctctaccttttactaaggtgttctatctgaaagcctaggggtaatcattgatcctttctcttaagccccatagccaaatcatcatcacatcctgccaatacctcaatgagtataggccctaatgtcttctcatatcctctgtgttttctgtagtagactcttaattgactttctgcttccattgtattaaaattatctcatgactcctgcttaaacccttccaatgattttgcatcacacacaaaaaaaataaatacaaagttgttagtaagggcaatctgatcctaaaaacatttcttttttgcctactcatctgatttcatcttgttcatttccctttcacacattttccttgttcctgcctccttggctttgccaaggcaatagtcctttaccaggaaaataaggtggcaatataatacactcatctctcagatttttggctaataaatttaccttcctcttctccaggcgttctctaatactccctttaaattatctttcttcagcaaccctgtctgaaattatagcatatattttatgtatttacttgtttactgtttgtctcccacataagaatacaagctttattagggtagggactgtagctgagtaccttgaatgttacctgacccataatatgtactcaaggagtatttgaataaataattttttatttataaaaaaatttatttataaattttatttattcataaaatttttataaattttatttattcataaaatttttataaaattttatttattcataaaatttttataaatttatttaaaaattatttataaaaattttatttataaattttatttataaaaaatttatttgcataaataagtgaatggataaccacacatcaagggtgcccagacacttcaactgatatctaaagtattcatatatttgaaggtttgggaaatagagaacattgaataaaccttgaaagcatgttagggaactgccagttctgggataatatttttatataaaccactgatttcacctagtggtggatggtcagttcacccactgaagatttatagaaacaaggacacatttttttagaaaaactttggcctatatggacagaatcagacttattataatcatatacaatggcaaaccttgtatatgatttgcttgtgaaagagtgggggtttagcagaagacatcgtaggacttggggcacagtgtcatgcaatgtcagcaactttgcttgcatttgaataataatgataataacaagagttgttagctatcagtttgagtattttactatgtatcagactgcatgtattacatgcattttcatacctacaataagttcagaagttggtattaatagtacctacatttttttttttttttgagacagagtcttgtactcttacccgggctggagtgcagttgcacgatctccgctcactgcaacctccgcctctcaggttcaagtgattctcctgcctcagcctctcaggcagctgggactacacgagcccgccaccatgcccggctaatttttttctatttttagtagagatagggtttcactatgttggccagccaggtcttaaactcctgacctcatgatccgctcgcctttgccttccaaagggctgagattacaggcgtaagccaccgcgcccagccctactacctatatttttaaaataataaaatctaggctttaagaattatcttctgaaattttcttagctggaaaatgccaaagttattaattgaacaaacttggctcacactaaaaccgaagtcttttaataacaaatcaacttaacatttttcagtactatcttaaaggcaatagtcctttaccaggaaaataaggtggcaatacaattgagcaaaagtgcttggcaaagatactatagaatttgataccctagtaaatctcgccttagaacactttctaagaggttatgcagcacataattcaagtcacctccagaacaggaggtcaatgatgaaagaggataattatagcaccaactgcttcaagaacaaatttttagagtttttgctagcatgaggacccattcagtctgtaggacggtgactaaaattacttatgacaatcagattggctctcaaaaacataaaataagttaattatacttagaatcttctttttaataaagccaaaatttttttttgcatatggaattatgcctgtaattgataaaatgaaaaagaaaacatgctggtattatggaatgttatctctcagatgcctaaaatagtttgctatccagaacatcttagaacttcctggatgatttttacagataagattgtatgtatataaatatgaacatatgactaaaatagtttgctatccagaaaatcttagaacttcctagatgatttttacagataagattgtatgtatacaaatatgaacatacatgttacatagtgactacatcaataaactttttattctaagattgcaattattctatagatataccacaccatcatgaaagtgtggccctgagaggactcatttagcctgcaagaaacattttgattcttttatcacccttgttatcaaagcacattttattttatatcacatattatgataactatactaaataactaaaatgatgtagactttcctctcaaaacatttaaaagtttttttctctctctgtcctttcctaaaatcttccttcccttcttcccttctttttgctttcccttcctccctcctttcctttctttacttctttccaaagtctttttaaaatagttgcataaataagctatataataggtaaaggtaataggctttgggaaacagctctaattcctaatattatttctgggaaatttacaaaatgaatcaagtcaaattcattgttttaagaaattataaaaatagctgtggctttaatcttggaaaaaattgtcattttgaaacccagaatttcaagtactctaaaaaagttataaacttgatcacttaaaattatgaattagcatttattaagtatcttttaatactttattccactaaaatataatagatatgatcgaagtattctaatgtataaaactcacccttattagttatgttttaaaaactaaaataatatagtaaatgagtttatgaattatatattttaattattatatatgtgacaattaaatatttaaataatcattcatatatatatgtatatatattttaaagacaggatcttgtgttgtcacccaggctgatgtgcagtggcatgattatagctcactgcagctcacacaatctttctgcctcagcctcccaagaggcttgatatggtttggctttgtctccacccaaatttcatcttgaattgcagttctcataatccccacatgctgttggagggacctggtgggaggtaacttaaacatgggggcagttaccctcatgctgttcttgggacaatgagtggcttctcacgaaatctgatggttttataaagggcttttcccccttttgcttggcactcctccttgctgctgccatgtgaagaaggatgtgtttgcttccgcttccaccatgactgtaagtttcctgaagtctccccatccctctggaactgtgagtcaactaaaactctttcctttattaactacccagtcttggacagttctttatagccatgtgagaatggattaatacatagctggaactacaggtgcatgccatcatgctgaactaattatttttaattatttgtagagataaggatttctttatgttgcccaggttggtccagaactcctggcctcaagtgttcctttcagtttggcctcccaaagtattaggattacaggtgtaaaccactgcacctggcctagacaaacattaaatttccaaatatttgcttttattttaaattgtattaggaatagacagaagtctcttttatatatacccaataagttaatgtttctttcaattaaatacttcaaataatcatattttttaaagtaaactatagaaaacatttaaaatcaatatgaaaattttaaatattaatttctacttcattcatgataatatagtatgtatattctaccgtatctctctatgcatagctgtatatatgtcaagaggaattttttggaccatgaataatgataaaagctatctatttacaagtaaatcaatatttggaggaggttccaagatggccaaataggaacagctccagtctacagctcccagcgtgagtgatgcagaagacaggtgatttctgcatttccaactgaggtaccgggttcatctcactggggcttgttggacagtgggtgcagcccatggagcagggtggggcattgcctcacctgggaagcacaaggggttgtggaatttcctttcctagacaagggaagccatgacagatggtacctggaaaattggtacactcccactctaatactgcgcttttccaacagtcttagcaaacggcccaccaggagattatatcccacgcctggctcagagggtcccacacccatgaagcctcactcactgctagcatagcagtctgagatcgaactgcaaggcagcagtgaggctaggggaggggcatccaccattgctgaggcttgagtaggtaaacaaagtggacaggaagctcgaaccgggtggagcccaccacagctcaaggaggcctgcctgcctctgtagactccacctctgggggcagggcagagctgaacaaaaggcagcagaaacttctgcagacttcaatatccctgtctgacagctttgaagagagtagtgcttcccccagcacagagtttgagatctaagaacggacagactgcctcctcaagtgggtccctgacccccaagtagcctaactgggagacacatcccagtagaggccgactgacacctcatatagccggacgccactctgagacgaagcttccagaggaaggatcaggcagcaacatttgccattctgcaatgtttgctgttctgcagcctccgctagtgatacccaggcaaacacggtctggagtggacctccagcaactccaacagtccagcagctgacggtcctgactgttagaacgaaaactaacaaacagaaaggatatccacaccaaaaccccatctgtacatcaccatcatcaaagaccaaaggtagataaaaccacaaagatggggagaaaccagagcagaaaagttgaaattctaaaaatcagagcacctcttctcctccaaaggaacacagctcctcactagcaatggaacaaagctggatggagaatgactttgaggagttgagagaagaaggcttcagaccatcagtaataacaaacttctccgagctaaaggaggatgtttgaacccaccacaaagaagctaaaaaccttgaaaaaagattagacaaatggctaactagaataaacagtgtagagaagaccttaaatgacctgatggagctgaaaaccatggcacgagaactatctgaggcatgcacaagcttcagtagccgatttgatcaagtggaagaaagggtatcagtgattgaagatcaaatgaatgaaatgaagtaagaagagaagtttagagaaaaaagaataaaaagaaatgaacaaagcctccaagaaatatggaactatgtgaaaagaccaaatctacatctgattagtgtacctgaaagtgacagtgagaatggaaccaagttggaaaacactctgcaggatattatccaggagaacttccccaacctaacaaggcaggccaacattcaaattcaggaaatacagagaacgccacaaagatactcctcaagaagagcaactccaaggcacatgattgtcagattcaccaaagttgaaatgaaggaaaaaatattaagggcagccagagagaaaggtctggttacccacaaagggaagcccatcagactaaaagtggatctctaagcaaaaaatgtacaagtcagaagagagcaggggacaatattcaacattcttaaagaaaagaattttcaacccagaatttcatatccagccaaactaagcttcataagtgaaggagaaataaaatcctttacagacaaacaaatgctgagatattttgtcaccaccaggcatgccttacaagagctcctaaaaggaagcactaaacatggaaaggaacaaccagtaccagccactgcaaaaacatgccaaattgtaaagaccattgatgctaggaagaaactgcatcaactaacgagcaaaataaccagctaagatcataatgacaggatcaaattcacacgtaacaatattaaccttaaatgtaaatgggctgaatgctccaattaaaagacacagactggcaaactggataaagagtcaagacccatcagtgtgctgtattcaagagacctatcttatgtgcagcgatacacataggctcaaaataaagggatgaagatctaccaagcaaatggaaagcaaaaaaaaaatagcaggggttgcaatcctagtctctgataaaacagactttaaaccaacaaagatcagaagagacaaagaaggccattacataatggtaaagggatcaattcaacaagaagagctaactatcctaaatatatatgcacccaatacaggagcacccagattcataaagcaagtccttggagacctacaaagagacttagacttccacacaataataatgggggactttaacaccttcaggtcttcagagcagaactgaaggagacagagaaacaaaaaactcttccaaaaaatcaatgaatccaggagctgtttttttttaaaaaatcaactaaattgatagactgctagcaaggctaataaagaagaaaagagagaagaatcaaatagacacaataaaaaatgataaaggggatattaccactgagcccacagaaatacaaactaccatcagagaatactataaacacctctatgcaaataagctagaaagtctagaagaaatggatgaattcctggacacatacaccctcccaagaataaactaggaagaagttgaatccctgaatagaccaataacaggctctgaaattgaggcaataattaatagcctaccaaccaaaaaaagtccaggaccagatggattcacagccaaattctaccagaggtacaaagtggatctggtactattccttctgaagctattccagtcaatagaaaaagaaggaatcctccctaactcattttatgaagtcagcatcatcctgatactaaagctggcagagacacaacaaaaaaagagaatttaaaccaatatccctgatgaacatcaatgtgaaaatcctaaacaaaatactggaaaaccaaatccagcagcacatcaagaagcttatccaccacaatcaagtgggcctcatccctgggatgcaaggctggttcaacatacgcaaatcaataaacgtaatgcagcatataaacagaaccaaagacaaaaaccacatgattatctcaatagatgcagaaaaggcatttgacaaaattcaacagcccttcctgctaaaaactctcaataaactaggtattgatgtaacctatcttaaaataataagagttatttgtgacaaacccacagccaatatcatactgaatgggcaaaaactggaagcattccctttgaaaactggtacaagacagggatgccctatctcaccactcttattcaacatagtgttggaatttctggctagggcaatcaggcaggagaaagaaataaatgatattcaattaggaaaagaagaagtcaaattgtcccttttttcagatgacatgattgtatatttagacaaccccatcatctcagcccaaaacctccttaagctgataagcaacttcagcaaagtctcaggatacaaaataaatgtgcaaaaatcacaagcattcctatacaccgataacagacaaacagagagctaaatcatgagtgaattcccattcacaattgcttcaaagagaataaaatacctgggaaccctacttacaagggatgtgaaggacctcttcaaggagaactacaaaccacggctcaaggaaataaaagaggacacaaacaaatggaagaacattccatgctcatggatacgaagaatcaataccatgaaaatggtcatactgcccaaggtaatttatagattcaatgccatccccatcaagctaccaatgactttcttcacagaattggaaaaaactactttaaatttcatatggaaccaaaaaagagcccacagccaagacaatcctaagccaaaagaacaaagctggaggtatcacgctacctgacttcaaactatactacaagtctacagtaaccaaaaacagcatgatactggtaccaaaacagagatataggccaatggaacagaacagagccctcagaaataataccacacatttacaaccatctgatctttgacgaatgtgaccaaaacaagaaaaagggaaagcattccctatttaataaatggtgctgggaaaactggctagccatatgtagaaagctgaaactggatcccttccttacaccttatacaaaaattaattcaagatggattaaagacttagatgttagacctaaaaccataaaaactctagaaaaaaacctaggtaataccattcaggacataggcatgtgcaaaggcttcatgactaaaacaccaaaagcaatggcaacaaaagccaaaattgacaaattggatctaattaaactaaagagcttctgcacagcaaaagaaactaccaccagaatgaacaggcaacctacagaatgggagaaaatttttacagtctacccatctgacaaaagggctaatatccagaatctacaaagaacttaaacagatttacaagaaaaaatcaaacaaccccatcaaaaagtgggcaaagcatatgaacagacacttttcaaaagaagacatttatgcagccaacagacacatgaaaaaaatgctcatcatcactggccatcagagaaatgcaaatcaaaaccacaatgagataccatctcacaccagttagaatggtgatcattaaaaagtcaggaaacaacaggttctggagaggatgtggagaaacaggaacacttttacactgttggtgggacagtaaactagttcaaccattgtggaagacagtgtggcgattcctcaaggatctagaactagaaataccatttgacccagccatcgcattactgggcatatatgcaaaggattataaatcatgctgctataaagacacatgcacacctatgtttattgtggtactattcacaatagcaaagactttgaacaaacccaaatgtccatcaatgatagaccggattaagaaaatgtggcacatatacaccatggaatactctgcagccataaaaaaggatgagctcatgtcctttgtagggacatggatgaagctggaaaccatcattctgagcaaagtattgcaaggacagataaccaaacaccacatgttttcactcataggtgggaactcaacaatgagaacacttggacacagggcgaggaacatcacacaccagggcctgtcatggggtggggggaggggggagggatagcattaggagatatacctaatgtaaatctcgagttaatgggtgcagcacaccaacgtggcacatgtatacatatgtaacaaacctgcacgttgtgcacatgtaccctagaacttaaagtatattaaaaaaataaattaaaaaaacaaatcaatatttaaaattgcgttactacggcgatatatttcttttctatatcattttgaaattgtgataaaattgctttaatatgaacactaaaagcagtatacagaattactttcttaaagttcttactgaccagtaaattacttttttggttccgtactctcatcaaccaaatatagtgttctctatttaggtttagaaaaatcttgaggtcattagttatttccctgtattcacacagtattaccactagaccacagcatttaaatagatttttaaaagatttttagaaaaaaaaatcatagccattgctccttcactgctgaagacagaatgagatttggtttcaacaaatacttagatatgaggaagagcctttctaattggtaaagtaacatagtctccttcagaaggatacatgtattttagaaataaaatattcaaaataggagcatgctattacaggaaggttactaaatcaaagtgagctgaaaacgttgccaacatagaataataactgaatttaatgacaattttatatttgtttatttgtttattttaccttatttttcttgagacagagtttcactctgtcgtccgggctggaaggcagtggcgtgatcttggctcactgcaacctccgcctcccaggctcaaatgattctcgttccttagcctaccaagtagctgcgattacagggacgctccatgcctggataatttttgcatttttagaagagacagggtttcaccatgttgcctaggctgctctcaaactcctgagctcaagtgatccacccaccttggcttcccagagtgttgggattacaggcatcaaccaccacatccagccagaaattaaacacaatttaaaacaaatctctaggggctttttgttttccattagataaaatatacttaactttaaagattagtatcatacaactaagtaataatatacttatttatataagatatatttgtaagagaaatttaaaaattgtctaaaatattagaaattaaaaattttataaactactaacctgtcatcatgctcatatgttttatttctatttatttgtgaaatacagcattttttcagtccttgtttatatgaaaactgtctaaaggtttgatagttaatcactctatctttcctggaacactctttatatgggttatagaatatcatattccacactactggctgccttagtgatcactcttcattcttctatttagctgattcgtttacctattcacaactttcaagtgatggcgaccacaggcgcctctgccctttttcttattttttttttaaatttcaacttttattttaggttttggggtacatgtgcaagtctgttacacgatgtttcataatgctgaggtttggggtacaattgatccagtcatcgaggtagtgagcatagtactcaatatgtagtttttcagctcttgctcccctccttcccccacctcctctaatagtctccagtatctattgttcccatctttttgtccaggtgtacccaatgtttagctcccacttataagtgaaaacatgcagtatttggttttctgttcctgcattaattcacttggtataattgtttccagctgcatcaatattgctgcaaagggcgtgctttcattcttttttatgtttgcatagtattccatggtgcatatgtaccacattttctttatccaatacaccactgatggacactcagattgattccatgtcttagctattgtgaaaagtgcagtgatgaacatataagtgcatgtgactttttggtagagcaatttatttttctttggttatatacccagtaatggaattgctaggtcaaatgatgattccattttaggttaattgagaaatctccaaactgctttccacagtggctgaattaatttacattcccaccaacaatgaataagtgttttttttccccccataacctcaccagcatctgttttttgactttttaataatcaatactctgactggtgtgcggtggtattttactgtggttttgatttgtgtttctctgattattagtgatgaacattttttcttatgtttgttagttgcttgtatgttttcttttgagaagtgtctgttcacgtcctctgatttttaatagggtgtttgttttttgcttgtcgaattaggttctttatagatgctggatattagacttttgtcagatgcatagttcataaacactttctcttattctataggttgtctgtttactttgttgatagtctcttcgctggggcaaagctctttagtttaattagttcccactcatcaatttttgtttttgttgtaattgcttttggtgactgagtcaaaacttacgtgccaagagcaatgtctagaatgatatttcttagatttccttctaggatttttatagttttatgtcttaaatataagtaatttattcatatcaaaaaaatttttgtatgtggttgaaggaaaggcctagtttcattcttctgcatatggctagcgagtatactagcaccattcactgaataggcaatttttctctatagtttgtttttgtaagttttgtcacatgtcagatggttgcaggtgtgtgactttatttctgagaactctattctgttccactggtctatgtgtttgtttttgtaccagtaccgtgttgttttgattactgcagtcttgtattaataatatagtttgatgtagggtagtgtgatgcttccacctttattctttttgctttgctcatatgagttatagtaccatgcttaaccctaggtaatgtggggttcattcattcattcattcatttaacacgttcactaaatagaaattactgagttgtgagagtataaaaaatgaaaaagctcacaaggagatggagttgatctcacacccccttctcctgaatgttctttagaaataattcatccatattgaccttatcaaacaccaacctccttcctacctcaagcttttccatttgcttttgtctttgcctgtaagactcttgcatcattatcctcttttaacattctggtctcaaatgacacaaactcctctgcatatactcatccacaaactactctatcactattatttttatagcacatatgcttatgtgaaattatgttacatatttacttgtgtatggttttgcagcctgtctctgtccatcatctgtaagctccattcgagtagattttttttgtgatttgccattatttaagagggcaataataatttgttaaatgaatactacaactgatttaaactgtcccatagaagtgatatttacggtgtcttttaaataaacatagaaattaaccttctcagtcttaaaacttgagagagctacatttgttttatctgagttattttctaaggacaccaaccatcgggcctcccagagagtatcaaggaactgaaacttactagagcactgcatctgggcaacgagatacaagacccttcactgtcatgactggctaactgagtccctgtttactgttaaccaactcatcttctttatctgtccctaattcctgttttcctgcatgtagttacatttcttctctgcaatataaacccctgattttagtcagtctgggagatgtatttgacactaacctcccatctcctgggctgcagcacctgattaaagccaaccctggcaatgctttttgtctcagtgatcggctttctgtgcagtgagcaacaggacctagaccaaggatgtccgatcttttagcttccttgggccacattggaagaagaattatcttgtgccacacatataatacactaacactaatgatagctgaaagctttaaaaaaaatcacaaataaacctcataatgttttaagacagtttatgaatttgtgttgggctgcactgaaagctctccttggctgcatgtggcctatgggccatgagttcgacaagcttgatcctagaccaaacccctgacatttcagtaacacttacgtgtatgtgtatcatgagctgccaagatgtataacacatggggattatgagaaaaacagttcaagataagatttgggtggggacacagccaaaccacatcattccaccctggcccctttcaaatctcatgacctcacatttcaaaacacaatcatgccttcccaacagtccctcaaagtcttaactcatttcagcattaatccaaacgtccaagtacaaaatctcatctgagacacagcaagtaccttctgcttatgagcctgtgaaatcaaaagcattgttacttcctagatacaatgggggtataggcattggtaaatacacccattccaaataagagaaattagctaaaatgaaggggctacaggccccatgcatgtctaaaatccaggggggaagttaaatcttaaagctcccaaatgatcttctttcactccatatcatatccaggtctcactgatgctagaagtgtgctgccatggccttggacagcactacccttatggctttgcagtgtatagccccctcttggctgctttcatggctggcattgaatgcctgtagcttttccaggcacacacagcaaactgtcagtggatttaccattctggggactggaggacagtggctctcttctcacagctccactaggcagtgcaccagtggggactctgtgtgggggctcccaccacacatttctcttctgtacttccctagcagaggttctccatgagaattctgcccctgcagcacacctctgcctggacatccaggcatttccatacatcctctgaaatctaggcagaggttcctaaacttcaattactgtcttctctacacccgctggaccaacaccacatggaagctgcctaggattgagaattgcatcttctgaagcgatggcctgaactgtaccttggcccattttaaccatggctggagtggctaggatgcagggaaccaagtcctgaggctatacacagcaggggggtccctggacccagcccaggaaaccatttttccctcttaggcctctgagtgtgtgatgggaggggatgctgtgaatgtctctgacatgcccagcagacatttcccccattgtcatggtgagtaacatttggctcctcattacttacgcaaatttctgctgccaactggaattcctctccagaaaatgtttttttttttttttttctactgcatcatcaggctgcaaatttttcaagcttttatactctgcttccttttgaacactttgctacttagaaatttcttccaccaggtaccctaagtcatctctctcaagttcaatgttccacagatatctagagcaggggcaaaatgctgcgtctctatgcatagcaagtgtgacctttactccagttcccaacaagttcctcatctccatctgagaccaactcagcctggactttattgtccatatcactttcagcagtttgttcaaagccattcaacaaatctctatgaagttccaaactttcccacatcttcttgtcttcttctgagccctccaaactgttccaacctctgcctgttacccagttccacagtcacttccacattttcagatgcctttacagcagtgccactctacctggtatcaaattactgtattaatccgttctcacactgctatggggacataccagatacttggtaatttataaagtaaataagtttaattaactcatagttctgcagggctggggaggcctcaggaaacttacaatcatggcagaaacatacaagacatccttcttcacagggtgacagcaaagagaagtgcagagtgaagtaagggaaaaatcccttataaaaccatcagattttgtgagaactcactcactatcatgagaagggcatggaagtaacctccccatgattcaattgtctcccactgggtctctcccactacacgtgaagattatgggaactacggttcaagatgagatttgggtgaggacacagcaaaaccatatcaccctctaagaatttatttatctaagaatggggatacattgttggcaagttttcaatctataacctataaatatctgctaattttcgcattgacagcttctcatattcgtctctcaagatggtggacaaggatgagaaacataggtatgcttttgtactcatgggcctcacaattggacaggttggagagacaaaatgtacacataaaaacacaattatttcccaacatttctgattaaaactgtgaaaaggaaacatgtggtgctattaaacggaggtgctacaactagagaacagatcttaagatttatagtaaactagactttaaaactcactgcagacactcacaaatcacaaaatacacaaaatgtattttagttcatagagcgtatagtaattgtgttatatgtacagtctaatttagtatatcatttgagtattaaaatgataaactaggccaggtgcggcggctcacgcctgtaatcccagcacttcgggaggccgaggtgtgtggatcacctgaggtcaagagttcgtgaccagcctggccaacatggtgaaactccgtctctactacaaatacaaaaaaattagtctggcatcgtggcgggcacctgtaatccaagctacttgggaggctgaggtaggagaattgctagaactctggggcaggaggttgcagtgagctgagatcacaccactacactccagcctgggtgacagagtgagactccatctcaaaaaaaaaaaagaaaaaaacttaattttattaggattttgaacaaggggtaaaagtagacatatatcagtaggaagttacataaattaaagctgtcttttaaacaaaaagtcttcctaatttttggtaagaacgttattaaaatatgtatattttaaaaatgtgtgggattctaaaggccctgtcagcatattttcacgaaaactttcttctcgaatattacagtgccatggatgacatcagagttacttcaagagtttaggtattaatatcctaaagtttacagttgatgaggatgtaagcactgtaccaaactagatgcaaagttgtgtttttccatcactctggaagtgaggagaaagaggaggaaaaattaactaacatcaatgtgcttcacatgagctaagtgtgtcattctccatcaagcccaaacaataatccagcaaaatagttcttcttattcctatatgattacaaggtttaaagaggttaattaactgctgtacaatataatttttatgagttaaacaaaaacaacaacactagtgacatcagtcaataattttcatatactctagagtgcccaaacctaacggcactcaggaagaacatgatttatgacatctattataaaggaatcaattttttttggttcatgatttaggtatctttctaaatatgattgggggtagtatgtaacttatttaaatattatgtggtttccaaaatatgtaacaaatgatatcagctttgtgatgtccttttatctgctaaatttgaaatgtgtaaaattcaataattatgagtatggatatttactcatatctgtattaacatgaataacacatggcagacaaatcctgcattggtgatgctcacattagatttttaaaataaaaatgtgatataattctacagagtaataaggcgagaataattaatatagcagaatgaatgtaaatttacaccaagaaaatagaataataagatttcaattattttcttcattattcagcacattttctacttttgatttctattcttacagtgtgtgttaaacacaatatgtttcgacttagttatcatgagaatataattaattactacagaaggtaattgcatacctgtatgaaggatgtttcaaacttgaaaacttagggaatttcagtgaggcatcacgctacctgacttcaaactatactacaaggctacagtaaccaaaacagcatggtactggtaccaaaacagagatatagatcaatggaacagaaaagagccttcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaaggcaaaattgacaaatgggatctaattaaactcaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaaggtggcaaaggatatgaacagacacttttcaaaagaagatatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttggtgggagtgtaaactagttcaaccactgtggaagtcagtgtggcgattcctcagggatctagaactagaaataccatttgacccagcaatctcattactgggtatatacccaaagaattataaatcattctgctataaagacacatgcacacgtatgtttattgcggcactattcacaatagcaaagacttggaaccaacccaaatgtccaacaatgatagactggattaagaaactgtggcacatatacagcatggaatactatgcagccataaaaaatgatgagttcatgtcctttgtagggacatggatgaagctggaaaccatcattttcagcaaactatcacaaggacaaaaaaccaaacaccgcatgttctcactcataggtgggaattgaacaatgagaacacatggacacaggaaggggaacatcacactctggggactgttgtggggtggggggaggggagagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaatataaaaaaagaaaatataatggactaaaataattaggtccttagtatcaggggaaatcttgatttagtcatttttcttaaacacataattatcaagaaattacttactcaggctcacattgtttccttcataatttcttcatagttatagcaatcacattgtagcagggaataccaaacttattattatcattaaaaacaaatattaagtaatttgttttcaagaacacaaatattttaccccgacatggtttccaaaattctttttcccaaagtctttgaggcaactactctgactgattttgtaacagtgcaattcacaaaatctcccaagtatgatttaacatcaggaattactataaaggaattactataaagtggtttgggtgtgtgtgtgtttgtgtgtgtgtgtgtgtgtatacatatacacacacaaaatatatatatacgttttgcaggcatgtgacttagtcatattttagtgaatttaactggatgtcaaggtatccttaaaggacaaaagagaaagaaaaaaaaaaaaacagcaggcggaactcttcatgtaaccactgagaaagtcctgtgctttttttacttcttcctccctcttccctgtttttaacacctggaatgaccaatatgttttgacaacatgttggcaagttccttatgcagtttgacacttaatataaggtgtttgtatagttcagtttctacagataggatattgacacagctatttaagattgtaaaaaatacttgctttagggctatttaccactaaatgttttgggaaatgtgcttttcaaaggtaaacgtaactcgacccttaaaggtatgaaataacacattccttgtaaaatttatttatttaaacacagttgttaagtttatgaagttgacatttggcacaccgtcagactttcctaatacaaaaaattcatgtagccaaaggaacttagagatgaaccttatctgagctagtaattagtgaccctatattctatgccttaaattcttaacactgtcttcacaatctacaagattaagcaggatccaacttaggtttccctctccatcctcctgaaaaaaaaatggccttggtttttgaaacttactgttcttcctcatacttcagggcctgattcttttgttacgtgactttatcttggcataaccttcagacctccgctcagaatcacttctagaaccttccttgactctctagatacaatcatgctccctcttatctggtttcatagaaccctaaacatttctaagtgcttttctttttttttttttcttttttcttttctttttttttttttttttttgaggcagagtcttgctctgtcctccatgcttgagtgcagtggtgcaatctctgctcactgcaagttccgcctcctgggttcacaccattctcctgcctcagcctcccaagtagctgggactacaggcgcccaccaccatgctcggctaattttttgtatattttagtagagacggagttttaccatgttagccaggatggtctcgatctcctgaccttgtgatctgcccacctcggcctcccaaattgctgggattacaggcgtgagccaccgtgcctggccttacttgattgactttttaacttttatcctttcaagtttgaaataccaaggcttggaaccatgacagttttcccttatgcttaatctagcatctcttatataatagaatctctttaaataatattcaatgcacaaacatatagtaaatcttgaggaatttttattgtgtttggatctcaagggcacagatttgagttaaatattacctatagtttatgaaacattatcattgatggatcttcaaggcatatttgtttattcatttctttctcttcttttattctcatacctgtttttcctatctctctttgccaccaatggcaatctttttaatacatttaaggagtatcttttaactagaccatttatggtacattgtattatagtttagcaaatatcccctcccctttcttctacttcctattctgattttttgggctaggccatgtgacttgctttggtcaacagacatgaagaactgtgacacgggagcagtctttacatgtcatcatgtggttaggcaagttctcttaggattctattctcactatgtgaaaagcaggcctggttagccatgcgtccctgcagaaggagatatgtggaacagacatgagcccagacaaggtcagccaactcctagctgcctcacagacccataaataaaaatattgatctttgctattgcagaacagtgagattttggtgttgtttactaagaattgtttttgtaggaaaaactgtagaagcttctgtgtgcttaaaaaaaaaactttatataatggtattgctttctttttctattttcattgagcactcagttcttacacttcattctttttgctatgtgttaatcaaatcctgctgcaccagaagttcacagggtacttcacactaactaatgatcacagttgtataggaatctctggtatatgttagaaagttcataatatgacatacaatgttcctgacagtggcattgtcttgaatgcttttaaattatttgactctgtagtaaagatggcttgaggttggagagaggatggggtggcaggctctccattaccatggtgagtggaacagccaggtgtgaagccaaacaagctgtagcatttagccacaatggtagtgtagtcaaagggaaacttcaaaacagaatacttgggtccagtccttagattataaacacaccccgagaaaagatcaagcagggaaaaaattgtcatggtcatgtttcagaggcatagcaccttcctgactccctactaccttatgctacccacttcttctctacaacttatgctcaggttcctggacctctgacctttacaggattttccagaatgcaggggaaaagcacaaagagaaggaagcagatcacaaaatataaatatggatgacagatctcatagacttaaaccataaaaaaggtcagagtaaacataaaaaaaagatagttaatatatattatttactatgtagtaggcaccaactgttccacataaatgacatcatttcaacatcacagcaaccctataaagtatttcttttgtttttagaacacatgaaatatattctttaaacaaatttttaagtgtatcacacagtattgttaactacagtcacaattttggaaagcagatccttagaacaataccagaaaaacaaacaacaaataactcaattaagaaatgggtaaaggatttgaataactttttcaaaaaaaaacaacaacatacacactcgacatacaaatggccaacagtacataaaaatgtgctcaacatcattagtcataatggaaataaagtcaaaactacaatcagatatcgcctcatgctttgtaggatggcttttatttaaaacaaatttttttaaagttagcaagaatgtgaagaaattgctacacttgtgcattgttggtggaaatgtaaaatggcactgtcaatatgagaaacagtatggggtttcctcaaaaaaattactaatgtaactaccatatgatccagtagttccacttttgggaatttattcaaaatatttgaaatcaggatctttaagagatatctatctgtactcccatgtgtactgaagcattattcagagtatccaagatgtggaaacagactaaatgttcattgatggatgagtggataaagaaaatgtggtatatgcatacaagtgaacattactcagctttaaaaagaaggaagtactgccatttgtaacaatgtgaacgaatcttgaggacattatggtaagtgaactaagccagtcataggaccaataccgcatgattgcatttacatgagatatctaaaatagtcgtcaaactcaagaagcagaggtggttgtcaggggctaagggaaaggggaaatagggagtagctgttcaagggttataaagttttaattgtgctatttttgttctcattttccagatgccagaactgagggttacagtaaattaagtgacttgaccaaggccacagggctagtcagtgggagtttttgaagttgaaaccagacattcttgctcctgagcccacacttttgaaaccacttaaaattttattgagctgataaactatataaatttgcatatgaggggccatcatacaccagacacaattcatacaaagaaaagaatatctaaatatatactagtaaaaaactttaatataaaaatggagatttttttaagcagataaagctaaaatatctaaaaatgaagaaaaattaatttggcttcacactttataatttattaaataataaaaacatagcgaaacatcatctatatagctttaaagggaaaaacttttgacccaagactctagtagtctttcaagttttctaagtataagcaaaaaaaaagtgtcatataagaacttacaaagtgtatatcctcaataaattgaatacataaataaactaagagatgcagcaaatgcagagcttaagagtggatgggtcagaatataaaaggagtgttgcacgtcatacataggtttaaatatggaaaatataaatggctgtttaaaaatgcctaggaaatataattaaggcaccataaattatttttaaataaaatgtatgtgactaattcttcaaagaaaatataatgaaaataaacttacagagttaaaaacaaaaaggtgagtcataaataaatgtcatgtccccagatgcctcagacacatgaaaattaaaagagtaagaaggcagcatcaggagaccagaggccaatttaccatgaaggccgcccatgggttcctaatcaacagaactatggtccttcatttaaatttcattgtccttaccctgtctgcaaagtttttcaccattcatttccttctctccattgaaaacttcttttcacctgtaccacattactagcaggtttcccttccatcttgtcagtctttaatttctctggctctttccactaatcagtccttgacatatccccaaattctgagagtctatttccaggtttttctcttatctaattatgttttcattcttagagaatggatttactttcagagtttgaacctcaactcaggtaactcctgtgttcacgtttcttttttaagctcttagtctgatattttctgcccgatccatcccaggctctttaaatgcaaccacatcatccccgcgtcagatcaaagcaatcaaagcagctgcggcaactcaatacctatcatctagggtccttctcacggagttgctgatctgtgtgaaggcaaccttagcctcacactgccatctgcctctagcctcccctcagcattaggtttcatgtactccttggtttgataactgggcaacagataaggtttctgccagccccatggtacagctccttcagcctccatcctccacacctgaggccgaggggatgggggagggtgtgggtgccaatttttctcattctatagatagttgcactcagatgttttgaaatcatttaaaatttaatttgtcctaaaagtgacctcaggctgtgacacagtctctaggctatgttaggtctgtgtttgattgtagggctacggtccaaacatagccaccatgcaagaaaatgaacgaattgcaaagaggacaaagataagaccaggaattatgagtggcttaatttagagggtgttaaggccaagaatccaggtcatgagaagccaagataccctttcagagggtctgtttccatttcccctggcaagacactcagaataaagaatatcatttaagccataagggaggtctgtgggccagtcccagagaaagtctattatatttcactcaattttcttggaaatctgtcttgtttaaagtatgttgggacccaggtcctgtgaggtatattcttattccccactcccgaaatatgtgaattattgatactgttaaaagaaaagctttagacaaatttaagagtttaattgagaaaagaaaaaaaacatgatttccaaatcagcccctagaatcaaagaaaattcggagagactttggcactgtcacaaggtcaaacatctatgggaaaaaaatgtgatgtgcaaaaactaaaactgagatacagaaacagctggattggttacagctcagcatttgccttatttaaacaaagtttaaacagttggccgcctatgagtggttaaagtatacctactggaattggctaagactaagctgtcattacagggaaacatactactaaagttaggcttttagtctgtttacctgctaagtatctgagtatggacattttccaggctagattttagttttatttagtaacacattatgggatctgaaggacacttttttaaaggttgaaacaaacaaattttacgcacatttccatttataacaaaagaaaaatgcccctttagctctggtaagtatgacaatttctaaattaaaagagcattatttacatctgaattgttaattctaatattaatttcaagtattattaataatataatcatttttcactaagccttcccttttatacccgtttacactttcaaatctaattatattccactgttgttttaaagatcaagccccaactgtttcatggtgtaccttctttctaattaagtatttgagacaaatgggagtcaggctgggactatagcatgtcaattttcacaagctgacattcacagtaaaagtagttcttgattatttccctaacagctttgatgttaaggggaaaaaaagcaacaacaacactgagctgtgtatattccctcctcatgctcctgggtgagaaatcatagttagtagctgctgatcttaaaaatcagagtctctgctacattgttagcaataatctaaatcaatacagactaacaacacaagccagtatgtggtgagtcatgaaaaataaatcagtagtgatatcaattgaaaatgataccaaaaaactatattatctggaaggaaaaatacaattttataacactcttggtcctgaatagttttgactatggcacacaaagcaagcaagcagcgaattacatgactgttactttctttctactgttagcaccctccgctaatagattgtaacagaatgactgtttggagggttaagcattgggaaatgtccataattacatagcatgtttggtaacatcgtgacattttaataaaacacagatatacattatagaaaagaagatctagccatctttttacactctctagagatcaataaatgtacccttgaatgacagatgggtgttgaaacccctttgcaaataattcctcaggtagctcttctaagctctgaaacgctacaatagttctcaaaatctcaacagagggaaataaaatacttcacagttgtaatgattttctctttatatatatactttctgaaaaagtatagtgagaatactaagtatttgggaactgattttaaagtccataactattaaaaattgcaagaatttttatggagcatatttatttcataaatcagtattaaagcctgaaaaaagaagtcttaaaagtctacataattctcacaatgttatatatatgttatatatatatatgttctatatatgttttatatatgttatatatataaagaacatatttctcacaatgttatatatatatgttatatacatatatataaaagaaagttggtcaaaattgttcatattgagaggtgacaacatgctggtggccctcacttgctctcagcgcctcctcggactcggcgtccactctggccacacttgaggagccccttcagcccaccgctgcactgtgggagcccctctctgggctggctgaggctggagatggctccccctgcttgcagggaggtgtggagggagaggtgcaggtgggaactggggctgtgcatggtgcttgtgggccagcacgagttccaggtgggtgtgggcttggcgggccccacactccgagcggccgtctggcgccaccggccctgggcagtgaggggtttagcacccgggccggcagctgcagagggtgcactgagtcccccagcactgcccgcccgcccacgctgcactcgaattctcgccaggcctcagccacctccccacggggcagggcttgggacctgcagcccgccatggccgaaccccccccacccccgtgggctcccgcgcagcccgagtctccccaacagggtgctgccccctgctccatggcgcccggtcccatcaactgcccaagggctgaggagagcgggcgcgcggtgcgggactggcaggcagctctgcctgcagccccggcgtgggatccactagccaaagccagctgggctcctgagtctggtggggacttggagaacttttatgtctagctggaggattgtacatgcaccaatcagcactctgtgtctagcttggggttcgtggatgcaccaatcagcactctgtatctagttaatctggtggggacttggagaacttttatgtctagctaaaggattgtaaatgcaccagtcagtgctctgtgtctagctcaagtttgtaaatgcaccaatcagcaccctgtgtctagctcaaggtttgtaaacccaccaatcagtgctctgtgtctagctcatctagtggggacttggagaacttttgtgtctagctaaaggactgtaaatgcaccaatcagcactctgtgtatagctcaaggtttgcaaacacaccagtcggcactctgtgtctagctcaaggtttgtaaacgcaccaatcagtgctctgtgtctagttaatctagtggggacttggagaacttttatgtctagctagaggattgtaaataccccaatcagcactctgtgtctagctcagggattataaatgcaccaatcagcaccctgtcaaaacagaccaatcagctctctgtaaaatggaccaatcagctctctgtaaaatgggccaatcagcatgatgtgggtggggtcagataagggaataaaagcaggctgcccaagccagcagccgcaacccgctcgggtccccttccaccctgtggaagcgttgttcttttgctctttgcaataaatcttgctgctgcttactgtttgggtccatactgcctttatgagctgtaacacttgctgcgaaggtctgcagcttcactcctgaggccagcgagaccatgaacccactgggaggaatgagcaactctggacgggaggaaggaacaactccagacgtgctgccttaagagctgtaacactcactgcaaaggtctgcagtttcactgttgaagccagcaagaccacgaacccaccagaaggaagaaactccaaacacgtctgaacatcagaaggaacaaactctggacacaccatctttaagaactgtaacactcagtgcgacagtctgcggcttccttcttgaagtcggtgagaccaagaacccaccagtttcggagacaatattaaacatgttccaattactactctactttaaacaagaaccttataaattcctaaaatatataaaatataaggaatggtacaaataatgcttcacttgttggagatgaagtgaagatgaaacataaaccctatttatttatcccaattattccatgttcacatactcacaaaagactattctgtcacaatttaaccctgttccccaaaatctcctcataaatgcagtttcaaaaagaacaaaactatgcaaataaacattacacctgtagttttgttctgtcaaatttgggaatgaaacgtctctggtgaaaagaaataaacggttagccatttttaatttcaaaaatgatcagtcattcactattcatgtctcatgtgaactacataatgtcaacgctgtcacgaaagcacggtagaaaaaagagatcctctcagcttcaatttagtagagggaaaagttcctggaatatgtttttcctccctctggagcacttcagttttgcaaaacatgtattttataattcttattttgtattcaacaatagtgctctctctggctttcagagtttttccagtttctctgatatttcaaaaagttatggtgttgtcattttatagtttaacatgagtggttctcacttcattcaaaagaaacaggataccttgaaaacgatgtggccaacctctagaaatgaaaattattattgcttaataatagtaatacctaatatatgcaggggcagaagcctggttgagcatgtatatacatcaatcatttaattctcatagcccttacatggccaaactaagtcttggagatattaagaattttttctacagtaatacaaaattaaatttctggaagtctggcacattttgtcaatcctgaagaatacagaataaacgtttatttattcacctattcaattattcaacaaatgtttcctggcagactagtaagtagcaggcttagagttagacatgagaatacaaactgaaataagttttgattcctgtcctcaaggaccttacattctagtttggaagagagactattaaataaacctacagtgttaagatagatacttacagccccaggtagtggtataggatccctgaagagtatgaaattgaaactattttcttctaattaataaacatttataacagtaacagagtagaaaacacttggcaagcctatctgaataataattattctgtctttatggtaccaacataaaataagggtaaaaagcataacatttaaaaaaaagtaattatgtaatatagtaatttcaaaaacgttcatggaattgagcttttacttaggattcgtgtaggtgcaaccaaattgcaactatgctcacttaagggtcccagtttgcaacaatgattcaaaagctcaattctgatcatagctatatcaaaagattgttggtgtttccaggggcaaaactgagtctgataaatatatactcaataactgaaataaatagattcagtatttcaatggaatgactggcatccactttctatctaatgaaaggccaatatcaattattaaacgctaaaaattactactgggagtgcaaaactgaaaacctcttccaaagaaatatgaaatttaaatctggcaattttatttaaaagagcttcaaagtgtaaaaacagagctttctctttacataaatacttacgataagtaatttatcttctttatagaacagacaacagaccaagacaacttttcgcaccttggtggatgcgctctgaatgccaagccaggcaccacagtcattactaccaaaggggaagtaataaatttactgtctatacgaagactttcaggtctgtcccatgtaggtgaaaaatagcgcgacttttaatctctcatcattaacgccattaaactctatattaaattctgtgctgatgaaaattttttttaaatgtatgttagtattgtgtttccttacactcatttattacagagtgttatggtttctatttgcaattctgtcttttctataaaattttcagtttcttgagagcaaaaactggttgccacaatgaccagtatatagttggtgctaaaaacacatatgttgaataaaattgaatacatattcctaatttcaaagtaattgtacatgttacaatgtacttaaaaaacagaaaaattgccagtttcacattcactatctttattgatgggttcaagtctatgaaatttttgcctatcatatatcccaaagcacaataaagcagtttcaaagacattttaacacacttaagaaaaggagcttctgaattaaagcccaccactttcatattaacattaatacattttgattccatatagtcacaatagagtttataagacttgtccaaatcgaagctgaaaaatgttatgatggccattcacttttaattaaatacaagcattaaaagaaatactatttatattagcaatagaaaacagaacttctaaatcacttataagattcaggattttattttcttactcttctaaaatagttcatttaacttttatttgtatttttctaaaatttatcagccaccaacttacagtgtgagcccactcagagaaaaatttaaatcatcaggataataattaatatttataaaacaaggtatttatagaaagcttttttatatgtatactattaattatacatggtattttatcactctcactataataatattttaattaaaaccttgccttgaaagataatttgggatatctcaaaaaagtaaagttctatatgataaaagaatgttaactattttctgtaagcaatcttaagctttttaatttaccaaaataaacacattcaatataagtttcatgtgatatgttgatttggagtttgctaacaaaatagtcatatatgcatacagtggaaaatacataaatttaaaacatatccagattaagtgaagcttacaaatggagacaattcatatatatttatcattgttagataaattagtaattagtacattgtgcattctagaaaaacaaaaagcatattctttgtctaggttcaataatagtcatctgaaatatgctctgtacctgtggatgaaataagtaaaagaacataaaatgtatgaataaatagggtgaaatttacagagactacttttgctgtcttgtgattcggtcatttatgagtgttaaggatttttctcagtacagttcagaatattaatcaatgccttctacttacaggagggtctgcatcttcagcataaactgttgtgataggtgtacccttgactgcatccggagccaccatccctttgtatattcgtttactaaagacaggaggataatcattcatatcctgtaaaacacaattaggagtttagtacttcagttgaaaccaggttagggatacagttactagattgactcccagtcttcatatcacacaacttatttaccactgtcagccttccatcctctcaattccattactctcatttcagactggcacctcagaggaaactgccagagttctcatacaatattaatgtgtggatatcaactgaaggccgttccactggaataaagtctttcaccctcaaaaacatgccttttggagactgaagtgaccctggaatttttttctaacttctaatggtaagaggtaaaattttaacatttgaaaataagaacaagtttctttaaaagctacattctgtgaagcaggcgtaaaagattttttttaaatgctctttatatgtttttatagcaatgtaaattattttatatacttagcataatactgactagaacatttcagatacaaactgtgaaatatcctttgttgccattttacatgataaaaggagattttctctgcagcgcactaaaataatgacacttaagattagatatatttatacacagaaaacaatgttaatttactgaatttttttcagagcaacttatatgtatcttatttttccaatttggcgctatatatgcattgttattcatgcattgtcaagttcattaaataaatagttatcaggtatttcccactttcatcagatatttagcacttcagtgcgaggcactgaagatactgttgtgactcaagaaaaagatgtccctgtctttgtgtcacttaactgccattaggctagtaaaaatactaatctgcagaaaggctagtaactttgactaaattaatctacttatcagggccaaaataataaatcaagtcccctgaaaggaagaccatatttttctgaatcattttatcttttagagataattgtatataatcttttgtcaataaataatgcttattcatatggcagatttatttatttataatattttaataatccttaccctaccgtgttttgggtagtgtgggtcaaacatatttgaactgaaacctaaatttgttaattatctgctcttctcctccaagtcccctttttctcacttgctagtaaaaacaaaatttaaaaaattctacatattctttgatatttgcttagacacaacaattttcctgtacagtattaagctggaaacacataaattaacagatctcaaacttctctttttgcaaagaagtcagaataattatttcttactatcaaacaatgcttccttttatattcgccatagagttgagttctgagtagtcaatatgaataaacctgcatattctaataggagaacttgaactgtacacaaaactgaaaaataaaaaatatcatttcttctgttttgaaatacagtattcaccatctcttctatgaaaaatatttttacaataaattatggactttagaatctgaacaagtaaatgaaccgagaagttttagttctctataatgaggactgtgaagggtattgatcttgaggctccatgcagggagtaaatatataaaacattagcattcacacattttcgtgccctttccaagagtgccaattaacttaataagtggatgtggtaactaagggtgtggaaatcctttagcacccctaaattgtaacttctgaaggttcgaaaggaaggagcccaacactgcaatgtttccatgcatgagtttccaatgagctcattatgttcttaaaaattttattctttattttattctcaggggaaatttaaaaccttaatgtcacaaggtactttttggaaaatttgattcttcagaaacaaaaaaaatgtatatacttttccaattatgtcaacacagctgttcacagtgttgaatatgatgaactttttatttgcttgggaagtattcattggattcaccttctaacttgaatgtacagtgattcacaaactgattagacacacacctaagactgtaaatgactgaagcctatgaaaagattggttctcttccccctttattttctattgacaggatgaagaataaattaatgtagttattgtagtagtatttctttttatggcacgttgtacatactttggggttataatctttcattgtggttacaaaagcagctagttgcatatagtttttccacaatgcattatttcaagaggagaaatgtattgaaatgcaattccaacaagcataatcaatagttcactgtatttatgctcagggacatctgaacaaaaatgtatataaatcggcttctgtgcaaatgttctcttgtgcagtaaattaaggactcgctcagcactccaaaaccatgctcttttctcttgcccattattccactagagggtagtattagcaaaaagaaatatttcctcctctgtagttaagaattgtatcactaaaacccataatatttgtttcttttggtaaaaatttttattggtctcaacaaaaaatagttttaatgcttcaaaagagtattctgaatgttatgatttacaacttgaaaaaccttatggtttttttcttaaggaaaactttaaaaaatggttatactcataaagcctgcaatttgtttccatgtgtcaagcaaataaaattatacctgaaggtgtaggtagctaacaggagaaaactatgttttatttatttatttgctacattagagtctgtaataatcacagaaaccttttctcctttagcagactaccaagaagatgtaaggaatctttttaatgatcatgctaggaagataagaacttgctggtaagtttgtaaatgtaatgacaagttgaagttctacacacacaaaaaaaataaaaataaagagaaaaagatgataaaatttttgattttctggaatcacaggcaaaaacctatagaacagtttttatttagaagataagtagaaagttctaactagttggaacttgatcatctttttaaaaataacgtgtaggctgggcacggtggctcgcatctgtaattccaacactttgggaggctgaggtgggcggatcacccaaggtcaggagttcgagaccagcctggccaacatggcgaaactgtgtctctactaaaaatacaacaataagcctggcatggtggcgggcacctgtaatcccagctactcgagaggctgaggaagggagaattccttgaacccaggaggcggatgttgcagtgagccgagatcgcgccattgcactccagcctgggtgacagagtgatactcagtctcaaaaaaaaaaaaaaaaaaaaagatatgtatatagcaaatgccagtccttaccatactaaagctaattcaggctctatgaggagacacagacagtataagccaatgggcggaatgactttagttgtttctgtcttatggtctagcattagcattatccttgttgagctatatggctgctctataatgccttgaggtttatggagccgatacctacttttacgtgggtgtatggttgattgtttgcctcttaccagttctgttttccactactagacactttctatttgctgtccaagttgctgtttctcatatttctcatattattagcattctgctgggtttttttctctctcaatttctgtattgtctccttgtctttactgacttatttcccttcttttatgcttctgcataaaaagtcataaaaggctacatctgcagctaaagaaaatatttgatatttttactgccaggctaggcatattcaccacaagctgatttaagaggccatgggccataagtgaacattggtggtagcctggcagtactccccaagggtctttgatagtggcacagggtaaggctcctctgcttgtggagaaggactgtttctcataggttgagtgcctgctcagccacagtacacaagaacacaaggtagaattctaaggttttgacttccagacggtaactttgaacctgttcagggcctgggagatttttgccaccctgaagggaaagacacaggtctggctggctttgccacctgctgattatagagacccatggccttgaacaaacttaagtggtagccagggtggttacagcaggtcttggacaagacccagtgctgtgctgggtttaggtctgacccactgcagtcccagcagtggggtccacaggggtgcttgtgtcaccccaaccccagctccaggtggctccaaacagagacactctgtctgggagagagcaagggaaaagaacaggagtttctgcctggtaattaagggaattcttctggatcttatccaagaccattaaggtagtaagagtctgccaagaaccacagtgttactgggcttgtggtgcctcctaaagcagatacagctttagcaacacctacatcctttcaaatacctgaaaagctttccaaataacaaatacgaagaagtccagactgtgaagaatacaataaatacccaacgcttaaatgcccagacacagacaaacatccacaagcatcaatatcatccaggaaaacatgaagtcaccaaatgaactaaacaagccaccagaaaccaatcctggggaaacagagagagtgatctttcagacagagaattcaaaatagttgttttgagaaaactcaaaaaattcaagataacacagagaagaaatttagaattctatcagatacatttaacaaagagattgaaataattttaaaaatcaagaagaaattctggagttgaaaaatgcaactgacaccctgaagaatgcatcagttttttaatagcagaattgaccaagcagaagaaagaattagtgagcttgaagacagcccatttcaaaatacacagtcagaggaggcaagagaaaaaaaagaacaaaatcaatgaaacatgactacaagatctagaaaatggcctcaaaagggcaaatgtaagtgttattggcattaaagaggagacagacaaagagataagggtagaaagtttattaaaaggaataataatgaagaacttcccaaacccagaaaaggatatcaatatccaagtacaaaagattatagaactaccagcagatttaacccaaagaacactagctcaagttatttaataatcaaactcccaaaggtcaaggataaataaaggatcctaaaggagtaagagaaaagaaacaaataacatacaatggagctctaatacatctggcagcagacatttagcagaaaccttacaggccaagagagagtggcatgtcatacttaaagtgctgaaggacaaaaaaaattcctagaagagtatatctggttaaaatatccttcaaacaggaaggagaaataaagactttcccagacaaataaaagctgagggatttcatcaacaccagacctgtcctataagaaattctaaagaaagttcttcaataaaaaaagaaagttcgtgagtaataagaaatcatctgaagatacaaaactcactggtaatagtatgtacacaggaaacacagagtattataacactgtaactgtggtggtgtataaaatattcttatgttaagtagaaagactaaattatgaaacaaaaataactacaatcacttttcaagacatagtaaaataaggtataaatagaaacaataaaaacttaaaaagcatggagatgaagtatagagtttttattagttattttttcttgtctgtttatgcaaacagtgttgttatcagcttaaataaagggttgtatgatagtatttgcaagcttgatgataacctcaaaccaaaaaatgtacaatagatacataaaaaataaaaagtcaacaaaatcaaagcaccagagtatactaccttcacttaaaggaagacaggaaggaaagaaagaaagaagacaaaccataagacaaccagaaagcaaataacaaaatggaagcaataggtccttagttataaaaaataacattgaatgtaaagggattaagctctctaatcaaatgacatagagtggatgaacggattaaagaaaaaaaagacaaaatgatctgttgcctacaagaaacacacttcacctataaagacacacatagactgaaaataaacacatggaaaaatatattccatgctaatggaaaccaataaacagcaggaatatctgcaattacaggaaacaaaacagatttcaagacaaaaactacacagagagacaaagaaggtcactatataatgataaatgtatcaatttatcaggaagatataacaattgtaaatatatatacatatatgtatatatatacatgtatatatatacatatatgtatatatacatgtgtatacatacatatgtattcagtgtgtgtgtgtatatatatatacacatacacacacacatatatattttcaacattggagagctcaaatatataaagcgaatattattaaagctaaagagccagatacatccccaaacaaaaatagctggaaacttcaacatcccactttcagcactggacagatcttccagaaagaaaatcaacaaagaaacatcagacctaatctccactgtagaacaaatggatctaacagttactcatagagcatttcatccaacacctgcagaatacacattctcctcagcacatggatcattctcaaatacaggccataccttaggtcacaaaacaagtcttaacacattaaaaactttgaaataatatcaagtatcttctctgaccacaacagaataaaactaaaaatcaataacaacataaattttggaaattatactaacacatggaaattaaacaatacattactgaataaccaggggtcaatgaggaaattgataagaaaattgaaaacttttttgaccaaatgataatgaaaatacaaagtatcaaaaccaatagtgaggtgtggagttggcaggacttcctgggttgatttggggactttcacaaaagacccctgtgactcagggttttgagttcttaatcaataaagtgaaggattcaaagttaaccactccaagggaggattgaaaaaagagccactctcaatggacaaaaagaaagaaaggggagggggtaacacagggatataagtcctagccaccacagccagcagtggcaacccttccaggtccccttccaccatgtggaagcttccctttcgctttgttcaataaactgtgctgctgctcactctcctggtctgtggactctttttgagttgtaacactcactgtgaaggtccgcagcttcattcttcgaagttagcaagaccacgaatccatcagcaggaaaaactcttgattcaataggatatactgaaatttttactacgtgggaaatttatagctataagtgcctacatcatgaaaggaaaaaaacttcaactaaacaaaacaacctaatgatgcatctttaaaaactagaaaagcaagagcaggctgaagccaaaattagtagaagaaaataaataataaagatcagagcagaaataaatggatttgaaatgaagaaaacaataaaaagatcaatgaaacagaaagtttgtttttttaaaaagttatataaaattgacaaacctttagccagactaactaaaaaagaagagagaagacccaaataaataaagtcagatatgaaaaagaaaacattacaactaatactgcagagattcaagggatcattagtggctactatgaacaaacatatgtcaataaattggaaaatcaagaagaaacaaataaattcctagacacacacaacccatcaagattgaactatgaagaaatccaaaacattgaacaaactagtatcaagtaacaagatatagcaaataacaagtatcaagctgtaatgaaaagtcacctagcaaaggaaaagccagaacctgatggttttgctactgaattctaccaaatatttaaagaagtactaatactaatcttactcaaactattccaaaaaaaaaaaaaaaaaaaaaaaaacaggaggagggaatactttcaaactcattctataaagacaataatactgataccaaagctagacaaagagacatccaaaaaagaaactataggcaatctccttgatgaatattgatgcaaaattcctcaacaaaataataacaaagaaattcaacatcgtatttaaaagatcattaatcatgaccaaataagatttatctcagggatactaggatggttcaatatattcaaatcaatcaatgtgatatatcatcaacagaatgaaagagaaaaaccatatgatcatttcaattgattctgaaaaagcatttaataaaattcaatgctctttcatgataaaaaccctcaaaaactgggtgtagatggaacatacctcaacataataaaagtgatatatgacaaacccgtagctactcccatactgaatgaggaaaaactgaaagcctttcctgtacgatctgggacacaaccaggatgcccactatcaccactgttattcaatatagtactggaagtcttagcaagaacaatcagaaaagaaaacaaaataatgatcatctaaattggaaaggaagaagtcaaattatccttgtttgcaaatgataaaatctaacacttggaaaaacctaaagactacacacacacacacacacacacacacacaccacacaaagtattagaactgataaatttagtaaagttgcaagatacaaaatcaacacagaaaaatcagtagcatttctatatgccaacagtgaacaatccgcaaaagaaatcaataaagtaatcccatgtaaaacagctacaattaaaataaaatacctaggaattaaccaaggaagtgaaagttctctgcaatggaaactataaaacatggattcaagaaaatgaagagaacacaaaagaatgaaaagatatctcatggtcatggattgcaataatcaatattgttaaaatgtccatactactcaaagcgttctacagattcaatgcaatccctgtcaaataccaatgacattcttcaaagaaacagaaaaaaaattctaaactgtgtatggaagtacaaaagacctagatagccaaagctatattaaacaaaaggaaaaaaaaaaacacctggaggaatcacattatctgactttaaataatattacagagctatagtaaacaaaataggatggtactggcataaaaaaaaaaaacacacatatatccatggaacagaattgagaacccagaaataaatttacacaactacagcaaagtcaattttgacaaaagtgccaggaatgtaaccagggaaaggacagtctcttcaataaatgatgccaggaaaactggatatccatatgcaaaagaagaaattaggccccatctcatgccatatacaaaaatcaaatcaaaattgattaaagatatgaatctaagacctcaaactatgaaatgactgaaagaaaacatgcggaaactctccaggagataggactaggcaaagatttcttgagtaatacctcacaagcacaggcaaccaaagaaaaatgaacaaatgggatcacatcaacttaaaaagcttctgcacatcaaaggaaagaatcaacaaagtaaagagacaacccacagggtgagcgcaaatatttgccaactacccatctgacaaggaattaaacagaatatataagcagttcaaacaactttgtaagaaaatatctagtaatctgattttaaaatgggcaaaagttctaaacaaaaatttctcaaaagaagacatacaagtgataaaccggtatataaaaaggtgctcaacatcattgatcatcagagaaatgcaaatcaaacttacaatgagacaccatcttacaccaggtagaatggcttttatctaaaagtcaggcaatggcaaatgctaataaggatgtggagaaaaggaaccctcacacactgatggtgggaatgcaaattagtacaaccactatggagaacagtatggaagttcctataaaactaaaaatagagctatcatacgatccagaaatcccactactagatacatggccaaaagaaaggaaatcagtatatgaaagaaatatctgcactcccatgtttattgcagcactatttaccatggccaagatttggaagcaacctaagtgtccatcaacagaataatggagaaagaaaatgtggtacaggtacacaagggagtactatttaaccataaagaagaatgagatcctataatgtgcaacgacataatcaatgaaggttaaaagtatatgagagaggcactttctggtgtctcccagaaaccagtgggtgatatttatggagccatgggagagattctttactacgtagatatactatttttaatcctggacatgcacattttctttgttttctctggtttggatttttataggaaatatgttatatcttagtcctaaaactctagaatagtagaattaaagatattttctcctgctatcaccaagttcactgacaaatataatataaagaacacaccaataggaatctgaaaatgcggactagaagagagggaaacatttgaaagccatacttcaaagcaaccccaacagaacaattagcaagttgtaaaaaacaatattaaatctgaccatacaccaactagctggttcacagaaattatcatttattcaaattcccacctccagacaatacctcttacctccatacaataggtatgctgtagatgaaatgtccagaatttctgttttgtttgagtctgggacaacctcctggtctctcaagcatcagcttttctgatgaaatcaaaagcaggaccctatcaacactgtcatgatggagcatcagtagcacgtaactgcctctcaggtgtccacggtttcacaaatgctgccttggtactgggcactgagttttcatctagaaaagctatcctttttcttctattctatggggtagcaatatttctttctggagaagaaaactcctctgaaaggtggaaatcttagcttcattttccaagactcactgtgtttaacaacaacctcagcccttgttacaaggtgaacctgatgatacttcatttctcgtcatttcacccctccctgcctactcccacacctgcacactaagacaggcaaacacaaccaagggtcaatctagtctcccgtcttcacagaagcatgtctccctctctcctactcccatgcagccattctatccaaaattataatgagcaaaatgacttgggtcatctgtttatctcagacaagttctttatactccttataatgctgcttagtataatatatccatttacatattcagcttttcagattcatattcagttttcagtttgctgtagaacagcccttttctttctgtgtattttctatattatgttacaacgcagactctaagaccaggtttctattataacttagtttgtaaggctagttatcactctggatcttttaaaattgtttagaattttattttcactttccagagatttgcttatatcatctaatttactatcatcacagattcagttcttctaaatatttagtatatctagaaatatacaagaaaaatatttacaagtaaaatacacaagaaaatatctctaatttactatcatcacagattcagttcttctaaatatttagtatatctagaaatatacaagaaaaatatctacaagtaaaatacacaagtaaatatcttgtatatacaaggaaaaagccttgttacattgatgttctataaaatcttttcaagaaaaaatgtatgttatttgtttgatcatcacaggttttgttttggattcttaaaacttgacactaagaaagctgtgtgcagatgtcttgataaaaatttttatttatactgtggaaatattgtttttccaaataatacttgaattttcccattcttgctccaattttaaacaggtttgatggactaggcattaaacacttcatcttttattttttcctcttgtttacaaaagaaattatgtttctgctcattttgaaagaaagaacttcaagatgttttcctgtggtgactttttgggtccaagtatctcctagcgaataccatacaattatgttatcaacaaaacagcttttcagtactgcgagtaattagaccaagtatagacaatttgaaaagctggtaaagactacatttgtagagaactgagaattgtactccattcttctcttaaaaaaaggataataatattttatgggcctcagtagtatatactagaattttaaagttatatttgtgataatccccaccctgagttatcagaaaagaggaaagcaagtgtcagtctacatttgggagaatttcctacaaattttattatgcttagatgaacttggaataaaaaagtggtattacatatgtctagagttaaatgttaagttttgctttaaatgtataataaataggcaatgactttgcatgagtcaggacgccttgaccaaaggaatggtgtgatttctctaaataagataaagcaattgatacaacacgaattaaaccaacactcttctctatctgaggaataaattatcttccagctgctgatgtagaagcgttaagtaatacccccatattgaaataaagggatgttgaggcaacattaagaacttttttaaagaggtatgaggcccagatacagaatgagggttacttagggcatatcttgctttttgaggtgataattttggacataatttaactcccctaacattttccatcaaaacaagccaagcaaatatatccaaattgaatccagagctgccaagtcagaatctatgagtgtttaccataactgtctgtcatcaaccacaccctcatcagagaaaaggccacaccatttgaggatctatttttcgatctgggaagaaaaggggaaatgtcattaatagcaagtcttttttttctcttctttgtccaaaatcatcaataaatgaattatttttctatttttaatgttttaactgttcaattccaccaagtcatatgagtagacaagagtaaaccaaggcaaatttttcacctggtccagaagatattttgctatttagtctatatagatcactctcaccttagtctttttcatctgcttacatattatggcatcttcataaccaccaatattatattccctaaatatttttgtaacagatttctaaatgttataacacaatagtgtgacaaaatcatatttcaaaatacaatacaatcaaagccctcccttcaggcaatccataattttgtcttgtcccttgatcctttttccagaccactagagcactgataattattgtctcgggaaagagaggtatgaaaagaaaaatcaggttaccccagaaaagattttgacagtttgagttcctatttccaaagaaaatttagtactgaataaagttttaatttcctgaaatagacacatttcttacctcctgaaataaatatcttaggacagagagacacaagaacggaataattaagtatatagacatgtggacccccgagaaataaagaacccagatcctgataaaactctcccaacaggtttagggtgtccgaggatggaaggagcttacgatctccattccaaggtagtttagaggtggaaacagtatccatagaagaaatggcatcaatttgtgtgctagcagataatccaggtcaagtgtaaaaaaagacagcgaaagaggtgggggccaagagaactaactagagggagctggtgtgtgtcaatctcattgagaaaagaaaggctggcgagtggacactagctcatctgaaaaatccaggtggagacacactggaattcatcaggaaacagcataacacatagagaacagaggagagcaagacaagacaactgcccaccctggggtggcacagagtcaggggagtcctcccactgtggagaaacagtgagtaagtgagtccctggggacccaccttctgccatggacttttgcatccctggactcaggagatctcccccatgagctccccaccggtgcctccaggctgacacggagaaccatgtggagtcttggcagagccatactcaggcacacagggagtcccaggagacttgtatccccagacactctggcaccagtggctgtagctcctgcagcagtggaggccagacttgcatgcctccagtaaaggggccaaatccacgaggctgagcagtgaaacattgcaggcctcatctcagctgcaccttgcaggataaggcctactgtccattccagccccacctgagttcctgggtcgggagcagctctgtacttctctgggacggagctcccagagggagaggctggctgccatttttgctgctctgcaaccctccctgtttttgctcttaggcttgggagggacagggattagggactaatgccgacccccaacacagcgcagtttccttacagaaaagcgggtaggctgttttccatgtgggtccacacccttgctacttctcaccgggcagggcttcccaacctaggacctcggcaacccccgacctgggctcttgggccagtagcagctctgtactttcctgggacagagctcccagagggcaaggcaggtcaccattttttgctgctccacagtcctcattcctgttgccctcaggctcaggagggaatgtggtggttggagactgatgcaaacgcccagcacagcacggcagcattacagaaaagcagctagactgctttctatgcaggtctctgcctctgctactctttactgcccagtgcctctggacttgggcccctagcacaaccaccttgtcaatgcctaacacttcagtcagtggtgagaaaaccccagagacaatccacaacctctctgtgactgcagctacccttgggctggggaggaacaaagggcttggccactatgcaggaactccagcacaccacagccacaatatggacagaagcccagtgtctgtttcccgtgagcccccacctctcactctttaccaggcagtgcctaagctcgggagcacggaacagccaccccatctccagctgagcattctcactgctagtggctttgtgtttccttaaggaggggctcctacagtcaactaacagccactctgccactgccacagcagtagttctgcccctgctgcccttggactggagaagaaagaaagggccaaaggttttactcactcttccaggaggacacagtcatcatatagagagaagcccagactgtcctccctgtgaatcctcaacctcccgttctttacccagctcaggccagcagtgcagccaccccactccctggctggacattcccagtaggagcagttttgagtttccctcaggttgagcacccagggacaaccgaaagcccctctaccactgctgctgcagtgatattgcccttgctgccctcagactgtggagggagcaaagaccctgagtgctttagccacacctccagacagctgcatcacccacaagcttggtcctacaatgcagccaccacaccccaggctgactgtactgattagtagtggctctgtatttttctggggtggagcaccaagagacaagtgaaaggccatctgccacagccacagccaaggtcccttcccttgttgtgtctaagctggggaaagaacataaagcctgagcttgccccagagctacaatgtgtagcctgggagtgccaaacagatatacagccagcagtcaagtgcaaaaggagccgacactttcagatcactgagaaggggcacaacaatccttaggaaatagaggagactgacgaagagtctacctactggccattccagttaagtgccatctgctggatcacagcccaaactttactattaaaaatattttgctaatatattcttctgtgaaaccaaggacaagagctcagttacaaataaaggtcatgcacaaaacctcactcctctgaaaacatctaaataaaccaactgactgtactcaaattagacagttgaaagaacatcagcgaacacagatgagaaagaaccagtgcaagaactttggcaactcaaaaaacaagtgtcttctttcctccaaacaactgtactagttccctagccaggattcttaactcagctgaaatagttgaaatgaaagaaatagaattcagaatatgggtaggaatgaaaatcattgagaatcagggaggaagtcaaaatccaaaccaaggaaactaaggattacaataaaacaatacaggagctggtagatgaaatggccattataagaatgaaccaaaatgatctgatagagctgaaaaacacactacaagagttttatattgtgattgcattaacagcagaagagaccaaactaaggaaagaatcagagagcgtgaagactggctctctgaactaactaagaaggacaaaagtaataattaaaaaaagaataaaaaagaatggacaaaacccctgaaacatatgggattatgtgaagagaccagatctacccctcattggcgtcactgagggaaatggggaaaaagcaggcaacttggaaaacatatttcaggatattgtccatgaaaacttcccaacctcactagagaggccaatattaaaatttaaaaactgcagagaactgcaagatactatataagaagacaatccccaaaacacataattatcagattctctttcattctttttaaaatgaaagaaaaaaatataaaggcagctagaaagaaagagcaggaaacctacaaagagaacccatcaggctaacagtggacctttcagcagaaaccctataagccagaagagattgggggcctatgttcagcattcttaaataaaagaatttcaacccaagaatttcatgtccagtgaaactgagcttcataggcaaaaaagaaataaaatacttttcagacaagcaaattctaagggaatttattacaaccaggcctgccttataagagctcctgaaaggagtgctacatgtgaacagccactacaaaaacacacttaaatacacagatctctgacactataaagcaatgacataagtctacataatatccagctaacaatatgatgacaggctcaaattcacacacatcaatattaacactgaatgtaaatgggctaaatgacacaatttaaagctggataaagaagcaaggaccaacgttatgctgtctttaagaggcccatctcacatgcaatgacatccataggcccaaagtaaaggtttggagaaaagtccaccaagaaaacagaaaatagaaaaagctgaagttgctatccaaatttcagacaaaaagagactttaaatcaacaaacatcacaaaagacaaagatgagccttacataatggtaaaggatacaatgcaataagaagatctaaatatcccaaatatatatgcatccaacacaggagcacccagattcataaagcaagttcttacagacctacaaagagacttcgatttccacacaatagtgggacatttcaataccccatggacagtaatagacagatgatggaggtgacaaagtgaaaaagatatttaggacctgaattcaacaattgaacaaatggacataatagacatctatagaactctccacccaaaaacaacagaatatacatacttctcatcaccacatggcacatactttaaaattgaccacacaattggacatcaaaacaatctgtaacaaattgaagaagactaaaatcataccaaccacactctctgaacatggtgcaataaaaacagaaatcaatactaagaaaaacattcaaaaccatacaattacatggaaattaaccacttgttcctcaattatctctgggtaaacaataaaattaaggcagaaataaaatatttcaaactaatgaaaacaaagatccagcataccagaatctctggggcacagctaaagcagtgttaagaaagaagtttatagcactaaatgcccacattaaaaaagtcagaaggatatcaaatgaacaatctagcatcacatctacaggaactagagaaacaagagcaaaccaaactcaaagctagcagaagacaagaaataaccaaaatcagagctcaactgaaggaaattgagatgcaaagaccatataaaagataaatgaatttaggaattatcttagttatttgaaagaattaattagatagatggatgaatagctagacaaataagaaaaaaaaagagaagatccaactaaacacaatcagaaatgactgactgaatgaaaaaagacattaccactgaccccacagaaatataaaagaacactcagagactatgaacacctctgggtacacaagctaagaaacccaagaggaaatggatacattcctggaaccattcaacctcccaagtttgtgttaaaaagaaactgaatccctaaacagaccaataatgaattttgaaattgaatcagtaaataaagagcctaccaactaggaaaagcccaggaccagttagattcacagccaaattctaccacatgtataaagagctggtaccatccctactgaaactattccaaaaaattgaggaggaggcatccctccctcactctatgaggccaaaatcatcttgataccaaaacctggcagagacacaacaacaacaaaaaagaaaacttcaggccaatatctttgatgaacacagatccaaaaatcttcaacaaaatactggcaaaccagcagcacattgaaaagctaatccaccacagtcaagtaggttttatgcctgggatgcaaggttggttcaatataggcaaatcaacagaagtgattcaccacagaaacaggactaaaaacaaaaactacatgatcatctcactagatgcagaaaaggatttcaataaaattccacatactttcatgttaagaacgcttaacaaactaggcattgaaggaacatactttaaaataataaaagccatctatgacaaatgcacagccaacgtcacactgaatgggcaaaagctggaggcattctccttgaaaagagaaacgagataaggatgtcctctcttattgccactcatcatagtaatggaagtcctggctagagcaataaagcaatagaaagaaagaaaacccacccaattaggaagagaggatgtcaaactacccctgtttgcagatgatatgattctacacctagaaaaccccatagtctttgtccaaaactccttgatctaataaacaacttcagcaaagtttcaggataccaaatcaatgtacaaaaatcagtaatagcattcctatgtaccaacaacatccaagctgagggccaaatcaagaatgcaatcccatttgcaatagttacacaaaaaagtacctaggaatacaactaaccaggtggtgaaaaatctctacaatgagaatttaaaatattgctcagtgaaatcaaagatgacagaaacaaattgaaaaacattccatgcttgtggatagaaagaatcaatatcattaaaatggccatactgcccaaaacaaagtacagattcaatgctattcctattaaactaccaaaggcattattcacaagaaaaatgtattctaaaattcatatcaaaccaaaaataagcttgaatagctaagacaatccaaagcaaaaagaaaaaagctgaagatatcacatttcttgacttcaaactatactacaatgctacggtaaccaaaacggcattgtcctggtacaaaagcagacatatagaccaatggaacagaatagagatcccagaaataatgctgcatacttataagcatctgatgtacaacaaaataaataaaaacaagcaatggagaatggactccctattcagcaaatgatgctgggataactggctatacatatgtagaaaaatgaaactggaccccttccttacaccatgtacaaaaatcaactcaagacggattgaagacttcaatgtcaaacctaaaactataaaaacacaaagataacctcggaaatatcattctggacataagccctggcaaagatttcataacagagatgccaaaagcaattttaacaacagcaaaaattgacaagtgtgacttaattaaactaaagagcttctgcatagcaaaaacaaaacaaaacgaaacaaaaaaactatcaacagagtaaacaggccacctacagaatgggtgaaaatgcttacaaactacgcatctgacaaaggtcaaatatccagaatctataaggaacttacaaatcaacaagcaaaaagcaaacctcccacttaaaaagtgggcaaaagatatgaacgcacacttttcagaagaagacatacatatggtgaacaaggatatgaaaaaatgctcatcatcactaatcatgagagcaatgcaaatcaaaaccacaatgagataccatctcacaccaatcagaattgctattaaaaagtaaaaaagaaaaaaaaaaacatgctggtgaggttgaggagaaaatggaacaaagcagtttggtgatttctcaaggacctcaaagcaaaatgaccatttgacccagcaatcccatttttaggtatatacacaaagataaacaaattgttgtaccataaagacacatgcacatgtatcattagtatcatgctattcacagtaataaagacatgaaatcaatcaacctaaatgcccatcaatggtagactaaataaagaaaatgtggcacatatatgccatggaataactatgcagccataaaaaagaatgagatcatgtcctttgcagcaacatggatgcaactagaagccattatcctaactgaactaacataggaacagaaaaccaaatactgcatgttctcacttagaagctgaaggtaaacgttgagtacatagggacacaaagatgggaacaacatacattgggggctgcttgagggtggacagatggaggagagtgaggataaaaaaactacctataaggtactatgttcattacctgagtggcaaaataatctgtacagtcaaaccctgtgacacacaatttacctgtataacaaaccacacatgtatctatgaacctaaattaaaagctttaaagaaagaaaagtgttggaaattactcagaatcatttgaattactcacccgaccattccctaaaccttttgaattaaaataataatatgttttcagttacaagagacaacatatgttaagatataacatttattttattttattttttgagacggagtttcacttttgttgcccgggctggagtacagtgctgtgatctcagctcactgcaacatccgtctcccgggttcaagcgattctcctgcctcagcctcctgagtagctggggttacagttgtgtgccaccatgcccagctaattttttgtatttttaatagaggtggggtttcatcatgttggccaggctaatctcaaactcctgacctcaggtgatccacccaccttggtctcccaaagtgtagggattacaagcatgagccaccatgcccagccaagatataatatgtatttatcaaagttttatgagttacaataacaaagacatggaatcgacctagatgctcatcaacagtgaattagataaatacaagggggtacatatacaccatggaacactatgcagccataaaaaagaataaaaccatgtcctttgcagtaacatagataacagcttgaggccattatcctaaacaaattaattcaggagcataaaaccaaatactgcatgttctcacctctaaatggtaactaaatattgggtactcctggacataaaaatagccactgaaaattaatagacagaaattgggtggggtaggaagtgaagaagcgggggttgagaaactaattattgggtactatattcactatctagttgacaaggtcattcatatcccaaacctcagcatcatgcaatacacttatgtaacaaatgtgaacatgtaatgcctgaatctaaaataaaatatgaaaatgtaaaataagacactaaaaaaagaaaaggtagtggaatacttccgtgtttcactgtgactgaagaattatcttaaaaaaataaaatccataccccaaaattttatggtcaagaacattaacctactggaaaaatacagttatactaattatgtattggtgaaatcttttttcacatcattactttgttgtctaagaaaaccactagcatatggctagctatttagcaggataacaatcatactgcaacctaagaaaagtgatgatttcttcttccatcatttcaaataaaagaaaatcttatttgtagtccctataatatgagaattgtagaaaagttgcctatgaccttcttttccttaggaccctggatacatatagtcttctactaaggtccctcagagacatttgtgttgcacatgcagaatctgaatgatctcacataatagctttgctattgtagtactggccactaaacaaaataaaaataaaaataaagaaaaagggagtaatcctcaggaacttttatttttaggaataaatgtatctgcactttcccacagtcttcaggtaaccaacagaatccaaatgatatggaattgtcagtaattatcataggtaaattctgctaaacaattcaccttaaacacataatggactttaactataatcacttcaaaagaacaaatgaaaaggcattcatgggaacaaaatacaacctgaaaatataatactggcaaagattaagtgaacatagatgcctagagttatctgcatgatctccaggattagataacctaacaaagttggtaagtcatgtaactttgatcccactcagctcttacacattttagcgactatatgaagcatgaatagtatcaccatgtagtagacaatatgtggttgccaatatttcattccaatcctatggtatgatcctgcaactaaacatttattaaaaatgtccacatctttccacatttttctatctaagcccatagatttcattgttttttaacatagaaacttgatatctatagtcacttggtaaaatctgagccataattatcaattatatttttgggggtagaacatagatacaactgtgaataaaatataaatcaaaacatgtatactaaagttaaattgtttattcaactaattactcatattcatctattttattcatggtcattgatatactctataggcttctttgcaagtgcttcatttatcttatagatcttctgtctttttcctccctccactgcccttgctctgtgcaggtatctctattcctttctgaccagccctttttcatcattccaagtctattcaggaagcagaaaaaaacactttaaataagacttttttaagtttctattttcttcccttaccaaaacaaaaatttttacaatgtaccatgatagtgaatgaacttttactttatattgcctaagaaattattgtcatgtaaagtcattttttagtaatatactcatttagtaaagtaacttgaggatttttgtatatgtatctttgtaattgaagtaaatttctcaatatgggattcagatgtcttgtataagaaacatctgtgtacttttctcaaatgctgatgtttatgatggtccccatgggacaggtccttctttggggaaggagtagagaaatctgaaagtttaagatgacgctcagaggatcacggtatgtactactatttgagaactgatcaacttacagtacttcttctcatatctacttttgtctcttaaaaatcactagaaattcaaaaagttaaaaatgccatgctctttcaggcaatcatctggcacatggtattataataaatgggataacaaatccagagaggttaacaaagtccccaaggtcatagagcttaaaaagggttgagccagaatttaacctcaattccatctaacttggaagcttatttcattccagaggtttgggccctaaattaattttagggcctaagaactcttggcccttcagagtcatatataaaatttttttagttgaaggatttgtaccaaataattatgcctgatgctgtggaatttgaactaaaatctagtctagagaggttaggacttgatggaagtcacagagctgatgcagactcaaatttccatggtctttgtacacatatttactgcctctttcaaatttatcttttatagtcaaaaatatagttatttcttatgtattcataaatatttccattggaaaatctatgttatgggtctggtaccactgtgtcattaggaattgttatcaaaacatattataggtataatagaaggaacaaaacctacatgtagagagagcaaagcaggcaaccagaagtcatctctagcccttacctttacaatcactgtgacagtagcaataccaggtggcattgttccataaatatcaaaggcctctaccagaaaagtgatacttgcttcttggtctggaaatgcctcataatctaaactccttaaaagcgatagttctcctgtaaatggatgtagtgcaaaaaagtgcttcacttctgggcttcttatccggtaagacacatttgctccaaggtcgacatctttggcctgtaataagcagaagaatagttttattagtgacgttaccaaaataaagaaatgcaggaaggatggaagtcatgcgttagtgcctaggacagcatcaatttaacgaggacaaaaagacacgttttttgtttttgttttttaaaaaagcacattatttaataatttaccagggaagagaaggagggatgggggagagaaagatggaggcagggaggaaaggagggagacagtgagagggagagtcagagagagagagagagggatctttctataagattttgtcattgttgacgttattactgtatctgtttaacttgaaaaatcactaaatgaactatatcacagtaaaaaaataaatattgtcttaaatgactgtttcttattttctactgatttgataatcatgaacaaatattttaaataaaaataaatactgagtgatttccataaacataatagatggctaaagtactataagaaaactgagaaaatataagtagtaattatttgtcacagggatcctataatacatttctagagatcactctaccatacttcctttgatttaactaggatttgagtagtagttacgcacaaggtgctgtagagagcaccaaaatgaatccagacacaattactgccctacaggttatggtctcagagaagaaacaagacacaaatactaaaatagaaaggaaaaaaatgtgacatgctatctaaaagatgttctaaattgggaacgatatcctttagctgaaaggatgggttttcatgggagtcttgtagaatggctatttcactcagcagtacagactggcaaatgcacctcaggtacagaaaaccgaatggagcaagaatgaaaatggggaagatccagagtatgctataatgtgcatttttaaatgcaaacacctcctatggtgaacctcagccttggtctcctccaatcaattattgacttaacaatcagaaagatgctattaaagcatacattttattatgtggtttttcctgcttaaaatcccctggtttttaattcaattttcaatcaacgccattatccttaacatggtaagagccactacattttctagacctttagcccctcacccctcacactttcccatcttccatgattttgaccaggctttttccccccaactactttgaacaatctttcttccttttctgcttggatagctcttacttgtccctcagttcaccatttagaaataagtttctctagcaaatattctctttgccttaagattaggttaggagctccacctctattacctaggccctttgtactgaggacctacgttttaactactaattttcttgactgatagctaaaccagcctgaaaactcgaagaaagcagtaaatttgttttgttcacctttgtatccccaaagtctttgcatcccctaggacagcatgaatttaacaacaccagcaggagacttggcatactatacatactgaagacatgtttgttaaataaataacttaactaattaattaattgacagatgaatggtggaatagatgaaggaataattgttctctccctggccagtatttgccttatttagatttgttaatgtttattgctgagttcaattatggaagggatacagagtctggaaaagtatgctaaaaacattcaagttgtggactgcaggtggaaaaatggctacttttttttttttccaaaacataccttatagaccaactgagtcagtattaaatgaggtggttgcttaaaaatgcagatttatggatcagcctaatctactgaatcaaaatgttcaggactgtgtaatttatagttaaaaacttaaaaaagaggcttgatacagagatgtcattaaaaaggagagttagattactagaagatggcttttgtgtattgaatgtgaaaacaatacagaataatgggtataaacaatatttgtaaaatagaggggaaaccaatttgtaactctctatattttttctgtgtgtacacatttatgttatatatgtataacccacacaaattcatatatatatatgtattttttgacatttgtgtgaacacaaagataaatgtgaaataaatttaatgctgagtactctggaggcacaatgtgggagattattaacttttgcttcataaactattgtattgtcaactgttggaataaacagaatattacttttgtaaattaaaaaactattaaaaagtatatttttaatttcttacaaatagatctttctgcccttaatttttgggatatctttaaagtaggcttgccacataaaatacaatatgcaatattggagaaataataaaaatttattcattgtttatctgaaattaaaatccaacttggtatgttgtattgttacttgctaattttggcacacaaaccctaatagcaaatctcctaatgtaggattcatgtaataaatgctttttcccacacacctctatttgaaggatggtagtcccagctggcaaattctcttcaacaaggacagtgtatgttgaattggtgaacacaggactgttatcatcaatgtccaaaaccttgatggccaaggttagagttgaatgacgagggtgtactgctccatctgttgccacaacaacaagttcatagtagtccctgacttctctgttaagcttcactgctgtgtaaatgctcccattggatgtgatacgaaaaagattattaaagttacccaaactgtagtgcacttgaccatttattccagcatcagggtctgttgcctattaaataaaacaaaaaaacaaaaaaattcacgtaagttttgacgggctactgtaaatgaaggtaacagttaacaaattatggtatttttctaaccaaaaattatttggccctctaaggaggaaatgacaatgacaatacaatgcaaaatttaaaacatgaaaaatattatactttaatattcttcatttaaaattaacataacaaaaacggataatgtcattagcaataacaatactatgttatgacagaaaactcataaaaatactgaatctttgtcttatgattttaataggttttgaattctaaagtgagaaaaaattttgtttgtaattcatttaacataatctgccgagtgacaatttaagattatgtaggtttttgctcactgtatatattcattttatatttatatatgtttagtaataatgttacacattatgtttgtttataataaataatattttattatgttatgctgttatttatgtgataatgtttattataataaacattaatcatatttaccataaataatatttataagtataacctgacttaatcctcatgatgttgttatgagtaaatattattaatctcattttacaaatgagaacactgtggcttatggaaggttacacaagaaagaaatatctcagtgtcccagttcttaacacaatacttcatatataaaagtacttaacaaatgcttgtggaattaatgaacattagatgaaataaaacagatttgaaactaaatctgttccaaaagtcaaataggattaaaactacagtaactgtaatgtatgtgcaagggactctttttcaacattagaatatacatctctgcataagtaagaatgtttgataccataatatacctatatttactgaaaatttgaagtcatgtaaaatcactttgcatcaaataaaatgagaaaatattgagtaaatattcatcgaatgaaatgtaataagaattaatcttagctaaaactcaattgtgatactaattatgaatctcactatcagctactgtatattttgttttgaaaagttccatgtaaaagaaactgaaataaatcttagaaactgtaaaatattatataattatgccccaaactgtcaacaaggaaaggaaggaaaacaagacacttggctgccttatgagccagggacacaaaaatcactcgaggtccataaagcgtggaatgcaatatgatgtattttaacagcacatatgcagtggtatatccagttttacaggcaatggtaaagcatgcagaatggggatgctgaatatttgcatcttctttgaaacaagaatgtctaagatgtgaaaatcatgtttacaacagtgctcctatatgtcataatgccaagcatttcagcaggatttgtctctttgactcatcaaaacacaactgcccctgggagtttgacatctctgaggtttaattctgagaaaagatagaagaattgcagaaatacctgaagagaaaaaatacggtgacagagtagaatagtttctgttgatatagtttcttttacttttatactttgcctagaatttgtcttacgaattattgacaaatcagtcaagctgatcattctagtgaaaacaaccaacactgccttctccctttttcaccaaaaaaagagggtgatctctttttttggtctgaaattactcatcaagtaaatagataaaattgtaagccaagaacaaaatataaatatgttttgtttcataataataatacccttaaaaatttcagtcactttttctgtctatggaatatcttaagatcaaaaaaactaatcatttatgcaattagaaatttaaatgactcttgttcaagttgtttttattgacccatataattgaatatttattatggtagaatggctcaatttgactgatgtggctgtgtgtccgtgtgttttatacatgtccagctgcttaactatacatccactaggaaacatatctaaacatatctaaattagttttgtttttgctcccatagcaaattatcacaaatttagcagctgacacaaaacaagttcattattttaaagctctataggtcaaaaattcaagatggtctcaccagggctatgtttctttctggagactctaaggagaaacaacttctttgctcattcaagttgttgacagaattcagttgctagagtttgtagaactgagatccccacttccttgatggttgtcatgtgaggaccaatcccggttgctagaggtccccatatcccttggttcatgacacatttccaccatttttttttttttttttgagaccaagccttgctctgttgcccaggctggagtgcagtggtgcgatctcggctcactgcaacctccgccttctgggttcaagcaattctcctgcctcagcctcctgagtagctgggattacaggcacctgtcaccatgcccagctaatttttgcatttttagtagagaccgggtttcaccatgttggtcaggctggtctcaaacccctgaccttgtgatccacccgcctcggcctcccaaagtgctgggattacaggcgtgagccactgcgcctggccatttcttccatttttaaagccagcaatggtggtcaagcccctcacattttttgaatccctccctccatctttttccattttatctttctgacctactcttcaggcatcctccttcacttttaagggcatgtaagattacattatgctcccttggacaatccaggatagtatccccatctcagaatttttaaccttgatatatgtgtgtgcacatgtgtgcaagtgtgtgtatactgccatatataaatatatagcaatctatattttaggatgggatttttttttttttttgaaacaggtcttgctctgtcacccatgctggtgtgcagtggtgtgatctaggctcactgcaaccttcacctcccaggctcaagcaatcctcccacctcagcgtcctgcgcagctggcactacaagcacatgcccccaggcctggctaattttttgtatttttatcagaaacggggtttcctcttgttgcccaggtcagttttgaacttctgggcttgagccatcctccccctttggcttctcaaagtgctgagattacaggcatgagccatctcacctggccggataggagtttttagagaaaatatccaagcagatattcattaagcagactgacagtaaatgctaaatggggcatcctcaccaatagagtttcagaattttaaataatcagtttaaattggtataaattacgatatgtcaagtacacacacattttgactgaatctatgacaacttaattcactgaattcaaagctaccatgacaagaagtatatttgatgcttatggaaaaaaagactacaatatctttggctctgtttatatgctggattacatttactgatttgcgtatattgaaccagctttgcatcccagggatgaagtccacttgacagtagatgcagaaaaagcgtttgacaaaattcaacgacacttcatgctaaaaactctcaataaattaggtattgatgggacttatctcaaaataataagagctatctatgacaaacccacagccagtatcatactgaatgggcaaaaactggaagcattccccttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagaggataaaatacctaggaatccaacttacaagggatgtgaaggacctcttcaaggagaactacaaaccactgctcaaggaaataaaagaggatagaaacaaatggaagaacattccatgctcatggataggaagaatcaatatcgtgaaaatggccatactgcccaaagtaatttacagattcaatgccatccccatcaagctaccaatgcctttcttcacagaattggaaaaaactactttaaagttcatatggaaccaaaatagagccttcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaacgttagacctaaaaccataaaaaccatagaagaaaacctaggcattaccattcaggacataggcatgggcaaggacttcatgtctaaaacaccaaaagcaatggcaacaaaagacaaaattgacaaatgggatcgaattaaactcaagagcttctgcacagcaaaagaaactaccatcagagtgaacaggcaacccacacaatgggagaaaatttttgcaacctactcatctgacaaagggctaatatccagaatctacaatgaactcaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaactacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactagaaatcatgctgctataaagacacatgcacacatatgtttattgtggcattattcacgatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattgtcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataataaaaaaaagactacaatatcccccagaaagctactctaaaaattttaaggtgactgagacacacatctaatggaaacaaagggaacagaatataaaatgcagagctatttccttatctattcctatgtccccattaaattaaggagcataaataaggtgatgtaagttaagcaacatgagctggctaagcaaggcagttttacttctttactattctagatgaacatgtagatgttaaacaagataaccaaacatagaatcccttattatcagcagtactgtcaagaactttgcattgatgtttaatatttagtcaagcagctcagtgtatgatgctataatgaaaatatatattttcctagaaatcaattaaaagttaattaaatttgttaataagaaaaataacacatctcttttccccttgtactacatcaaagcaatgaacagtaatagctgcaactttataatcatctgtccatggttaacacatttttgtaatatacaccttactatggggcctgatttgtggctactaatttgtgaatgcatattgctgggaaattggctgatagcctgtagtcaaataaagacctcactggacagaactttgaataattgccagaaacaccacttgcaaaccttattcattaacaccaaagttagagtatatgaaagacaaccaagtaattacttaagaaaaaagtcaagggaatttattgaaccaaagttttttgtataatttttgagaagcgattttatagcatgccacttgaaaagggaaaagggaaatatatttcttaaacactaaattcattccccacccctttttttctcattatcttcttagaatggtctgttacacaattctttccatccataaaagtggaagtccattactgggtttgctaccctgggggttaccagtcctgtagagaagaccttaaagcatgcctgtatgggtggaatatactaggataaaacctcaaagaacaggttgatgtttgcactccttccactgagaagtccctgggtaggttacttgtgtaatttacaatgattcatttccatttaaaatatgtcaaatatccattcagattaattatttagatagaaaattttatgacaaaaatcagccccaaggaaataacttgaggacaaaaccaaaatgttatagctattataaaggtgtgaactaccatgtagcacctaattggcccagtgtgaagctgagagagtgctttgctctaccttttgcttgtcctttacagcgatttaagaggtcgtgtacatctttctcactttgaagtgggaaccataaaagctgttgatcagggaggttgggcagtgcatccttcatgacattattagtgaaaatacatttttaaaattattatctattaacttcaaaaagatgtacaatagttgtctttttttttttttttttaaggagctgagctatttcaagggctgtgattattagtgtaaaaggagacaagcaatttaaagactcataatgcaggtaaattttttcactctccacacaaatgcctcataatcattattgaacaatggcaagtagacttactggccagaagataacttgcataacttgaattaaaatcactaaaaacataaccagaatgaatagcttttcattctagtccctagaaatctagtccctagaaaacacatatttaacacaaataatttctcaaggggtcagctattattctaagatacacaataaactacattttatcctagcattcaaggctctacctggtcttgttctaacctatctttatgcatttatatccctcagactaactctctgacacaaactctgtgttttagtcaaaggagtctatttatggtatgaatcaccaccaagaaactctcaagtgtcagtggtttgttaccactgatgtttctttctcgcctatacagcacccactgtgaattccaaatccagctttactctatcttgtctttactcagaagagaagctaaaggagcaggcttcattggaatatgaagctcatgtggtgcaagaagaaaaaaagacatgagatagccaagctgcagcttttaacgcttctgcttggaggtcaacgtatcacctatactcctgcttcatcgttgaaggcaaatcacatgacaaggccgatgtcaaggggtgcagaaattccattccctcacacagtgggacagtgataaatcagaaacacttttacaatgtactaccctggttttccttgaaatgaccatgctctccctcaccttccctgatataggttttttttttgtttgtttttattttcccccaatccaacttaaacgttcaaaacctagcttcagttctacttcatctgggaaacctcttctttccatccagccttctggtccctcttgcacatagcaaaactcactttttattgctatttaagtatgctacgcaattaaataattggcctaaaaatctgtggtgtatccatgtattatgtaataggagacactgttagagaaaagaatctgtaaattgttttgtggagtgtacaatgtatgagaagtggaaagttggagcacagatggaaatatggtagagaaggaaaaaaaaaagatagcaagcaaataaaaataaacaatattcctgtagttgggtgttatttaacgcaaatgaactgaaggtgtcaaattaaataagacagtttaagctgttccaacataacctgcaggcctcttactaagtaagcattaggaagaaactttgcactaaaaacctttacatattcagttctcatgttaatggtaaacacttgaagattatgacatcaatgcttcaggaaaagagttgttgtcatgttcacgctcatacagcaaagaaagaaagtaatgttgtttcatgttcattaaatgtatttacatagtaaggctgtcttttccctttttcaaatattccttatagtgctgaaaacgaagaggaaaacctgggaggactcatttcatatttccccaccattgcttagtatttgataattatgcagtataggttgagtgtgtatatacctctttatgtgatggtaaaaaaaattatatattaaattatatttagttttccaacctcttcttacttctatttctccaacttcttcattctcatctttttctctgtgggcgaacatattcttaccactaaatctaagtgcattttgccatactaaccatgctatttcatgtctgctttatccagtcataaaatcttccccttatttccaaaactgattattcttcagccctagtatcacctctcagaagcatctgagtaagctaaatgcctcatcttcatgctcctgaagctcattgtatgtttctttaccacatgccctattgctttttttctgtcattttttaatagcccacatgaaattaagaattcataaggacaggatggcttatttatatcatacaatgcctgctttatttttctttttgcaatgacataggttagatatgcaataatttctgccaaaatttcttctgaagctatttccatttttcaattacatatcattcccaccccaaccacccaaacacatgaagaaataaaaattgccaattagtatttataattttgtcttaaaagaaggtatgttttctgtttattagaagaaatataagaaaataagacacattttgttctttaaataaaacttaagtgatcacataactacttattaaactttgtccttttgttacattttattgctttcttgttttcaattttgtcactatattagtcagttttcacaatgctataaataacttcccagaaactgggggatttataaatgaaagaggtttaattgactcagtttcacatggctggggaggtctcaggaaacttacaatcatggtggatggtgaaggggaagcaggcaacttctttacctggtgacagaaaagagtgaagaaggaactcccaatcacttataaaaccatcagatctagtaagaactcactcactgtcataagaagagcatgggggaagcctcccccatgatccagtcaccccgctccttggacaagtggggattataggtccctccctcaacacatggggattacaaatcgagatgagatttgggttggtacacacagccaaaccatatcagtcacctagaattctttaaggaaatctatttctaggtcagttttaaagtaagtacaatatatatacctatttttgtataattaaatatattagtttaacttttaacagtctattctagcattgcttaacctttttcattatcaactcctgtcaaaagaggattttaagatttttttctttctaatagaacccttataaatttgtacttccacagatatatttatgtatatatattatccatgctttatacataagaaaagtaaggttttcttgtctcccaaaacctgattttccacattggaaatgatctaccaccgttgagaatgcatgctctagccaaaagagagtcctctgtaacttccttatataccataaacatttccacataagcattgttctttcagcactcattacagtggcatcactttctaaaatgtctgtccatattactatatggggcaactcagggtatctctgagcttgtactcaatactcatcacttcttaagtaatgaaataagggaaaaataccatctccatgaattgcattttatgtgataatctgcttagcccaggccttcctatttatttgattatgcttacattttctgccaagttataacacaaagtattgtggtttgttttctgaataactattttaaatagtcttctctatgcttattgaatatgtgacattttgcttatcaggtgtttttataggtcctatatactaatccaagttttaattttcttttttctagtattctgttgggttcaatataaacatgcccatgcccttctctgaagagtcaagagtaatgtataccttaagcattgtccttctgtcacagggcttttcattatattacattgtctcacaaatcattttcttgtatcatttctagaaaaaaaattcttaactggaaactgaaaagaatgtgacagccagattggattctctgtgaaattctatacaattaaattttctggataacattcaagtaaaggattaacagaattgtaagtaaaacaagagcaataaaaatgcctctggctaatataataactatttaatgagagaaaaatatctcttaatttcccaatactatcaatcatttcatttgctgaatataagctcacgtttttcccaaacaatacccataaaattaaaggtgtttttctctattttacacacattgtcacaatttgacctaccttgataacatcacagggatagagccagatataggttccagttttattttatcatcactcattccttgagctagtttagtaattttcagctgtttcattaccttaatttgggatgtctccaaattggttgatttaaaaatgtatgttaggtattcattttgctgacaacaattcactgaagtaactgaggatcatgttttctaatgtcttgtccaacacagtaatttaaattaggaaaacagaattaattggaagaaacaacttatgtttctctatctactccctgggactgcattcaaagagctaagatgtacacaatgtgaaactgccttttgaattagaagttatgaactcagattctgctgtgtccttccttttccagctgccttccttcagatatactttcctagtaccttcctgtgtgctactatgtaaatagtaggtaactattttagaatcattcctcagcagcaggctttatgaaaagtgctgtcagtttgttttctttaattgtggtgtaaacagtactgctgcttaccttaatattaattatatacacacatttttagaagttacagatatataaaagggccaggtactttattaacatccttttttctttctggtaaaggtaaaataagccagattggagattaaaaagtgtaggaaacttcatttggatgccattcctttgttaattgttagcatgtaggcaataagaggaatatttcaatatcaattggccaagcagaaattttcctgagaataacagaatgttttcaatgacatgttatttatggagtgtaactgttccacaggagcagtctagtcagtagaattaaatgatactgtatactagaactggaatctgagataaaatagaagtggtaagtttacaggcacactctgtttcattgcacgtggctttattgtgcttcacggacgttgcattttttacaaattgaaggcttctgacaaagatgccttaagcaaatatattggcaccatttttccaacagcgtgtgctcatttcatgtctctgaggcacattttggtaattctcagaatatgacaaacttttaaattactactggatctgttatggtgatctatgattagtgatcttttaagttactattgtggttgtgttggggtgccgcagaacacaccatatgagagcaaatttaattaataaaggttctatgtatacatttttttgacacatggtccaagatgagatggtgtatgtgttctgatttctccacccactgaccattcccccatctttctcactttccttgagccttcctattctctgagacacagtgaaattaaaattaggccaattaataaccccactatgtatgggctctaagtgtttaagtgaaagagttgtgtgtctctgatttgaaattaaaagctagaaatgattaagcttagtgagaaaggtaggtcaaaagctgagaaagcttaaaaacttggcctcttgtgccagttagccacattgtgaacgcaatggaaaagatatttcataaattaaaagttctactccagtgcaaacacaaatcataggaaagtaaaacaacctgatgtgaagctgatgtgaagaaagtttgagtggtctggatagaagatcaaactagccacaacattcccgtaagccaaagcctaatctggagcaagaccttaactctcttcctttctctggagcttgagagagggaaggaagctgcagaagaaaagtctgaagctagtagaggtgggttcatgaaatttaagggaaaaataaaaagccatctccataacataaaagtgcaaggtgaagcagcaagtgcagatgcagaaggtgttgcagctagttatccagaaaatccagctaagatatttgtagagggtggctacgctaaaaaaacagatttccaatgtagataaaacagttttctattagaatatgccatctagaacttccgtaacttaaaacagagaggtcaatgcctagattcaaggtttcaaaggatgggctgactttcttgttaggtgctaagagctggtgactttaagttgaagccaatatttattgaccattctgaaaatcctagtgcacttaagaattctgttaaatttactctgtctgtgatcaataaatggaataacaatgcctaataaaagcatatatttatggaagcataaactatgtttacagcatagtttagcaagtattttaagcccatggttgagtcctactgctcaggaaaaaaaaaagacttctttctaaacattactgctcattgagaatgcacctggtcactcaagagttctgatggagatgtaaaaggacatcagtgttgttttcttgcctgttaacacaacttccactctgcagctcatggataaaggagtaaatttgaggttttcatcttattatataagaaataaatttcataagattatagctgtcattgatagttattcctctgatggatctgcgcaaagtgaactaaaaatcttatggaaatgattcaccattctagatgccaatagcaacatttttgattcatggaaggaggtaaaaatatcaacattaatagaagcttggaagaagttgatttcttccttcatgaatgactctgagaggttcaagagaggtttaagacttcagttggatgaaggaattgcagatgtgatagacatggtgagaactagaattagaggtggagcctgaagatgtgagtgaattgctgtaatcttatgataaacttgaacagttgaggagttgctttttatggaagagcaaagaaagtggtttcttgatatgatacctactcctaatgaagatgctgtgaacattgttgaaatagcaacagataatttagaatattttatatactttgcagcaaggattaagaagattgactccaattctgaaaaaaacttatttagctacaatgctatcaaacagcatcactagctacagaaaaaaatttaatgaaagcaagaagtattcaatgcagcacaattcattgttgtcttattttaagaaactgacacagccatcccaacttcagcaaccaccctcctaatcagtgagcagccaccgacagtgagacaagaccctctatctgtataaagattaagacttgctgaaggttcagatgattgacagtatttttttaagccataaaacactttaattaaggtatggacactgtttttcagacacaatgctaattgcagtatggagtatacttaatggagtatagtatagtgtaaaaataatatttatatgcactgggaaacctaaaaccttatgtgactcgctttgttgcaacatttgctgtattactgtggtctggaagagaactctcaatatgtctgaaatatgcttgtattaaaaatgtgtattgctttgagaaacagaaactctacaacctatctaccaagaatctttgcagataataaagaaagaagttattgacttatttcaaacttaaagtctgaggagtctaaatggagactgaagttacgtctaacatgacaagtgtgaaccactttgatttggtttgcccagaggaaacattactcctgctactttcataaagactgattgcttttgacagaaatctgtctgtgcagagttggatgagtatgatactgagaagtcataaaaccattagaaaagactgggctcagaggatctcctcataaaaatgttcacatagaaggaataagacagtgaaaaagaggctgtatttgctatatatccacgttttgaattatgacacacatagggaatatttccagagcttggtttcagaaatcccaatgaactaattcttctgagatatcataaactaaatagtgggaaagcaagccaaagaaatactgtctgatttatttattttgcagactgcacttagattttttaaaaaagagcctctcactttgattcttgtatgacttgaagaaaaagctatactgtataaaggtgtttgcaggtgggttctctggcaagcagacaatgaggcagagattagttgcaagagttttgttggggtatgctttgggggtcaacatttttggagggcaaaggacaagaccagaattggattcagggagaaagtcaaactactgtgcagggtcaactacagccttggccaacccaaggaaggagctgcagaattgcaattgcatgtcacagtttttctgagctggggtaaaatgtccagcattttacactcaggcatcagtcaggatatgggctacactgaaatgggtgtgactatgggcaagggaaccttctgtagataaggtcatctctgaagtggctagcagctgtacatccctctttactccttcatccctacatcactccaaaaagccaagacattcagctctaccttcaagggagatctgcttggcacacagtcttcataacaagcctctatcttggattggtttttttcttagagtataaaatccttgcttaacagaatatagcaaattttatacacatacacacatatattaaattattacaatatcattcattgttttcaaatgaaacagccagctacattattacctcaaaggtgaaaaagtctagggtttgatttttttgatccaaactaatatttgtcattttccacccctgtgcccagagacgtaactcatattttcctgttgaatttgtttcccaagtagaaacagaagtcttaaatatgatgaactttaggttttttcttttagttcttataaacacccagtatggcagttattattgtccatattttacagccaagaatatttcagaaaaacaaaaaataagttcattttcctttagctagcaaataagagtatttggatttgaatttagagtatgaatgtgccatctgtttgtaatttttgtgcaggtaggggatgctgctataactagtgtagcattattaattattctagctgcatgatagattggagtccagagatagaaagatgagctggacataatttagaattcactctgaattattttcatgatggggattaagggccatatcacacaaatacacacttgaaggttatcattacatagcccctcagactttacatatatttcattagaaaaataaaaatctaagttacagagaattgtcagtgggttccctcaatgtctcccttactctgtggcaagctagtctgacatgatatctaacagaaggaaaaacatacttcagataagtcatggaagtcataccatgaagtcatgagaattacagtatatagtgtgcccagagctgtgaattccactaattattttgaaacattgaaatattcatttcaaaataaatctataaaccatccaacatctgtacttatctttatcattctcctgctgctaaaattgaggaaaactccacttcctcctaggttctcaagggaacatatgacacttgagcttttgggactctgttgcctctctttctggcatttctacatccctctttactccatctattgccatcagttttcaaacctgctgaagaatttatcattacaaaataaagagaaatgagaaagaaaatataattgcttcctactatgtctgttttcctacaatctcttcacatcccaagattctatgtgagggcagtgggtgggggaagaaaaggacaacatatatatccattgcactcatttattaatgagttattttgttatttagtcatgcaaatcatgcactatacaaaacatacactatgtttcctaatactgtttacttaattactcttaaaaagtcataattagttctttaaaatgtaaaactaaaatatgacaaatgatgccatctttgctattgagatggtttggctgtgttctcacccaaatctcatcttgaattgtagctcccctaattcccatgtgttgtgggtgggacctggtgggagataactgaatcatgggggcggtttcctccatactgttctcttggtagtgaataagtctcatgaggtctggtctgatggttttataagaggtttcccctttgcttggctctcattctctcttgcctgctgccatgtaagacgtgccttttactttctgccatgattgtgaggcctccccagccatgtggaactgtgagttcaataaacctattttttctttataaattaccctgtctcaggtatgtctttatcagcagcgtgaaaatgggctaatacatctatattcagttactaaatgtgttctgtgaatgaagttggatgttgaatgcagatgctaatgtactgccacatgccagttagacacaattatgtatgtatggagatatatataataaagggtacttgtttaggaatattttacaaaagcatggcctgtcagtgtgcaccatacatttcagagacatgatgaaaaaacattaccactagagtgtcacactacaaatgtgattttttgaattctctataaaaatgtcaatttcccaagcttagcatatatgtgtgtctaaatgtaatggcaagcttcataaatgatgagcatgccaatatacgaagatttggatgcaattatttactctaaaacttcatcaatattatgtggttgcaggtaacttttaaataggcccttttggatctcacatgaattgaaataggaaaaaaatctatttaaagaagtcctgaagtagacgtatatgcttaatattaaacattgtttgaaattgaagagtctggcttaacacactaaattaagaaagaagaaagaaagcaagaaagttggatgttgaatgcagatgccaatgcagtgccacataccagttagatagcatgtggcaagttctaatgggcacaaaatgtgccttgttcacattaatgctttagtgtagcactgaatttgcctctcagtaaatgttaactaaatttaaaaaatagtattattttccccaaatacatcaattcataacattacaaaataattatgctataagtttgatttgacttaaccatacatgttttcatccatcaattcattcatttattcacccacatttattgttgactttaagctgaacaacattttcagggctggggctctaactaaggacaagagtaatgtgttctttgatcttatgtcacttgaaccaaggtgaaaaagtagatattaaaaaataattgccttttaaaaattattacagtgataaacctaagtaataaagtaaatatgcattgcataataagagcatacagcaggacttttaacccggcctcctgaaaattacattctaatgggaaagacaaatgtcaaccaaaatattaagttacgaaaataaacaacttcatattttaatggacattatgaaaaagtaaagtgaactatgagagcacataaatataggtacttaaatccaatattgtgggttcaaaaaggaaatgacattcaacagcatccagaactcttaaactttagttttcacactgtcaggaagtttggaatcccaacggtgactttcacattacttgtattaaataaaagtcatgacaaaatgattacatttttcccattagtttacaatatttgtaaatacaggaaatgacaatagatacagtacctcttgatgttagtaacattcttgagattatttgatattagtaacattcttgagattatttttagtaattaagatagaaaaaaaatgttttctatataatggcataatgacttagattcagggatgactgaagaatcattctcaagttgaatgtcaaactggggaggctctgatggcacgaagcagctttctataacaatttcccatggatgaaatattgccagacatttttgtaacgtcttgggtgatggtaaattctctcttttaagttttagggaatcctattaattaggactactctctccatttcatagctaaggaaactgagtttcatatggattagatcatttgcccaagtcaatagttactaagtgatgcagctagaatttgaatgcagacaacctaaataggaatatgctatatttgcaggcagtcaaaaatgctgtaaagaaaatttaatgttggtaaagggaaagggggtatacttgtttctggaggacagggagagtgctattgaaatggggtactcagtgaagtcatccttgcaaaagatgtctttttgaatgaaagagtgaatcacacagagagttagagaaagagtgctccaggcagaggtaacaacaagtacaaaatccatttgaaggtttggtaagcgtagctgtgttcaagaacagcaagaagcccagtgtggctggagtggagtgatgcaaatgatgttggagagagcaggaggagccaagtcatgtggagatatgaaggctatgaaaaaggagtttggattctgttctaacacaatgagcatccactgaaatgtctgagtggcaaaatggtgtcatctaatttgcatttttaaaatatcactcttgctgtagtgcagaaattgactgtaagaggggtagcacaggtcaaaaagtaagatactatttacataatctaggggaaaaatgattgtggtttagaataggtgaggagtacttgcctttggaatatgtttcagacagatttactgataatgcaagaatcagaagtggtcctaggaagcagatacttaagatgagattttggaatttgctaatttgctagccaaatggcatgcttactgtacaggagttcagagtaagtcatgattcatttgaagccttcacctgagatgaactgatatggtatatgggggaatggggagcctggtttaatgccatatctgtataatttcagatttatcggtgaacattaattcataaaacttacagagttgattggttgctaaatataacaaaggtgttgaaaaagaataaatgaagctcagaaccagcaatatcaattcagaggtaaagagtaaaaaccaatgacctccattagcacgtttaaagaagctccatatccacagacaatgacagactttactcaaaatcatgctcaagatgtaattacaacctgctctctctctctctctttctctttctttcttttttttcgagacagggtctcactcccatttcccaggctggagtgcagtggcacaaccacagctcactgcagctttgactttcctagctcaggtgatcctctcacctcctgaatagctgggactacaggtatgcaccaacatgcctggctaatttttgtatttttttgtacagacagagatttgccatgttgctcaggctggtctcaaactcttaggctcaagcaatccacctgcctcagcctcccaaagtggtgggattacaggtgagccactacccctggtctcaagacataattacaaggaaagatgcaatcaactccctgacaagtcttccacaccagtattggtagggaaggagagctggtctgggcacatgtggctacaaacacttcaaaaaaacatactgattctctggaacttctagactgaaaacttcactttcttttcatttttagatgagaacagtatccctcgcctggagatcaggtaatgacttcatctgaattagataccttaccatcttgtaagcaagatgatagatgtcctctgtacctatgtccctgcattgcttttgcaccaataactaaagtcaagttgcagcatgttctaactgtccctgctatgagtagaaaaggattattcccaaaaagaacagcaggatatgccttatagtattggcagcaccaggaggacatgactgaggatagatcttgattatgttggaaggggttgaagggagaaaagtacatcttaccaagagtttagtggtatggagatactttgtcataattgtggccaggacacctggagttgattctaaggtactgctggattattccccaaaggttgtgaaaaacagtggcctataataaacaaggtgtaggtagtgaaagtgcctggacagggatttgaagttaaaggtatatagaagtgggcattttagcatggatttcttatgtatgaccagagaaaccatctattagttttgttcctcaggagagcctaggtagcactcccaattctgaagcaatatagaaaggtgcaacaagaggtgctctggtatcattgaaaagttcagtgatggctctcctcaccaggccagagtagagggtagtgaatgttgctatgaaacttgtgttccttagtgtcaatgtgagtggaagaattctggattcagaatccaggtggaaatactccaatatcagaggcagatggatgaaatgtatcatagcaatcagcaaaaaacaacgtcaaataagctgctacgaagtgcaaagatctataaggatggctatccaaccacggtgttcccaaagcaaatacagaaaggcagccaagaaggctattgctggatttatataatctaaaaacatcaaaatcaggtaaactaaagccgcatcattgtgttctttcctgtgattaatacacatttgaagtatgagttgcttttttattgctgcagtgatttggccaatattaatagctgaggacactgactattctgactttgtccagaaaattgcacataacatcaattccaaccaagaagttcatctcatggcaaagttaggtgcaatcatatgcataggaccactggatctgttggcactaatatacagtaccacccagcagtgctgacctagtagaatactggaaaagcctcttaaagatagagctaaggatgaatttgggaatgaaatttttcagggccacagaaggaatgaccattgtatggtacatttttcttgataagaagactagatggaaatgacaaatcaagggttcagggtgggaatggcctctctcatcatcatcttgactaacccatttgggaaaggcatactttcgtccttgcaaagctaggctctgctgcactagagatcctggttttctgaagaccggggtgatgttttcactgagatgacatagtaagggtcccattaaaccaatatttatggttagtcagtagaaattattggctctttatgccaacaaatcacaaagtacagaaagaaatcactacacctatgaaaatagctaaaatttgatgaaaaagatgagagagcttgctctgctaggtatcaagactgtatgtaaaatcactataattgagacagtgtgctattgctgcaagactagactaataaaccaacacaatagaatagagagcccagaaacaaaccctcatacacatgtatatgggatttatgataatatgtattgcgagtcagtgggaaatatatatatttatatagaagaaaacaaattatactcccacctcactccacacacaaaaatcatttcagatgataaacctattacgaataacaagacaataaatctttaaaaagcaggtccttcatgacctgaggaagtaggctattttttaagcaaggtcaaaagaatagtaacacttacaaaatgatggataaatttgataatcttaaaatttaaatctgtgtgtcaaaagatatcttgcaggaagtgaaatggaagctcgagaatgggagaaatgtttgaaacatatataacaaaggaggggctcatttctataataatcaaagaactcccacagataaaaaagaacattcaagaagaaaacacatttactccaacagataaataagaaactcaaataggcatttcggaaaagacgaaattcaaaatagtaagtaaatatatgaaaagattctcaatgccattagcaaaatgctaatcacgatcataatgcgatatcactgaaaccgtaacaaggtggctcaaattagaaagactgacataccaagcacacagacaggaaccatgaccaactctcatatacaactcttggcatagttactatggaaaacaatttcgcatttccaacaaaattgaatagacacatgttcataacatagagaaactcaggcacatgagcgccaggagaaatgatataaacatattcacagcagcactgaagataacatcctcaaactggagagctctcaaacactcatcaacatgagaatgtgaaaataaattgtggcatagccacaaacagcaaataaatgaatgaacaggtagaaatgtggctgaatagtaaaaagttaaatatgaatgaaagaagacagatactaatgcacacacactctaaaattctgtttacaggcttcgaaaaaagacaaaactaaactataatgtttataaatgcttacttagatggtaaatgtgcaacaaaaaaacccaggaaattaacatagtggttaactctaggtggaggaaagcaattgcgcctgagaaggagcatgaagaaagattttctggtgatgcattctatacctgatttggacttacatttatgtttactgtataataatatactaaactgtacatttatctttaaatcacttttgtgtattacattttttttcttaaagtttaaaggacaagagttggtcttaataaaaatctccggatatagctggaattctttctgtaaaaccaagttggttgccaagcttattcctcaggtaggcaataaagtccacgtaagtaattgtagtgagttataatatttgtagagaaggaaaactgaactgaactaaagtgaataggtcatgaattttcatcagtctataaaacagaagtgcaatttgtataaagtaggatctcataaataagtaatgtagcattaaaatatatagctagatagatgtagcaggggtttgtgaggcaaaattacttggtattgcttcttggatatacattaaataatttaaatggggaaatggaaaacacaatttcaaatacatgaccaaataggctgatagcatgtctgttatacttttcttccatgtagtttttacgcctgggaaatgccttcattatctttgcctgtcccatgagtgggtaaagagatgtgctattttttccagtaccaactataaatttcaattgttctttgcattcacactgctgtgtgtggtggggggtgggggtgataatcacttttttttttttatttcaacttttatttagattcatgcatggatggtacatgtgtaggtttcatagaagggcatatcatgtaatgctgatatctggggtactaataattctattgcccatgtagtgagcatagtacccaatggttgtttttttcagttttcaacccttgtgcccctcccccagtctcttctctagtagtccctagtgtttattgttcccaactttatgtccatgtgtacccagtgtttcagtcccacttacatctgagaataggtggtattcggttttctgtccctgcattaatgtacttaaaataatggtctccagctgtattcatgttgctgcaaatgacatgatttcattttttatgactgtttagtactccatgctatatatgtaccatattttctttatcaaatccaccattgttgggcatctaggttaattccataagtttgcgattgtaggtagtgctgtcatgaaaatacaagtgcatgtgtctttttggtagaatgatgtattttcctttgggtatatacccagctataagaatgttggttcaagtggtagttctgtttttagttcagccactgcagaaagcagtttggagatatccacatttacatttccaccaacagtgtatatgcattcccttttttccacacctttgcaaacatctgttatcttttgactttttaataatagtcattttgactggtgtgagatggtatctcattctggttttgatatgcatttcttgatgatttatgatgtggatcattttttcatttgtttgttggctgcttgtatgtcttgagaagtgtctgctcatatcttttgccaaatttttaatggccttatttcttttttgtttgttgaattattttaagttctttatagaatcaggatattagacatctaaaagctgcatagttagcaaatattttctcccattctgtaggttgtttactctgttgatattttattttgctttgcagaagctccttagtttaattacgtcccacttatcaatttttgtttttgtggcaattgtttccaagacttagtcataacttctttgccaaggctgatgtccagaatgatatttcctaggttttcttccaggatttttatagttttgcatcttacataagtgattagtgcatcttgacatactttttatacatactgaaagggaggagtgcagttttattcttttgcatatggatagccagttatcccaacatttattgaataggaagtccttttctgattgcttatttttgttgactttataatcaaatggtttaattctggggtctccattctgttccgttaacctatgtgtctgtctatgtgtagcctatactactgtaggcttgtagtatagtttgaagtaggataatgtgatgcctttggttttgttctttctgcttaagatcgctttggctattcaggttcttttttgtttccatgtaagtttcagaacagttttttttttttctaattcagttaaatggtactggtagtttgataggagtagcattgcatctacagattgctgtgggcagtatggtcattttaatgatattaactcttccaatccatgagcatagaatgcttttccatttgtttgtgccatctatgatttctttcagcagtgttttgtaggtctccttgtagcaatcttccacttccaaatttagatgcattcctaggtattttattttcacttgtgactattgtaaatgtaattgcacacttgatttggctctcagcttgactgttatttgtgcataaaaatgccactgattttttttaccttgatttttgtatcctaaaactttactgaagttaccagtttcagtagccttttaatggagtctttagggttttctaggtatagaataataatttcagtgaggagagatattttgacttcttctgttcctacttggatgtcttttatttctttctttgcctgatttctctaactaagatttctggtaatatgttaaataggaggggttagagtaggcatccttctcttgttccagttctcaaggtgaatgctttcagcattttcatgttcagtatgatgttggctgtggatctgccatagatggatctgattattttgaagtattttctttcaatgcctagtttcttgtgggtttttatcatgaggaaatattggattttatcaaaagctttttctgcatctattgtgatgattttttttttttttgagacggagtctcgctctgtcacccaggctggcatgcaatggcgcaaccttggctcactgcagtctctgcctcctgggttcaaacaattctcctgcctcagcctcccaagtagcttgcactacaagcacccgccaccaagcctggctaatttttgtctttttagtagagatagggtttcaccatatttaccaggctggtctcaaactcctgaccttgtgatccaccctcctcggcctcccaaagtgctgggattacaggtgtgagccatggtgcccagctttgtcattttgagatactttttagtatgctgtgaaattcagttaggtagtattttgttgaagatttttatgtctctgttcctcagtggtatgggcctgtagttttccattttaactgtgcatttaccagattttagtatcagaatgctggcctcacagagtgcgttagggtggagtccctcctactcgaagttttggaatagtttcagtaggactggtgccagctcttctctgtatgtctggtagaatttggctgtgaatccatcctttcaagggcattttttgatcggtagatttttcattactaatttaatttcaaaactcattatttttctgttcaagcttttgatttcttcttgattcaatcatgggagcttgtgtgtttccaggaatttatccatttcatctacattttctagtttgtgtgcatagatgtgttcataatagcatctgaggatcttttgtatttctgtgaggttaattgtaatgtcatcttttgtcatttctgcttgttcttaattggatttcctctctttttatttgttaatctagctataggtctataaatcttgttcatcttttcgaagaaccaacttttggtttcattgatcctttatatagattttggggcctcaatttaattcagttctttctgattctagttatttgttctcttttgctagacataaggggttttgtttgtttgtttgtttgtttttccctagatcttccaggcatgatgatagagtattaatgtgagttatttctatatttttgatgtatgtatttagcactatagactttcctcttaatgctacttttgctgcatcgctgagattctggtgttgtaacactgttttttaaatcaactgtattgatatggtttggctgtgtccccaccaaaatctcatcttgattgtagttcccataatccctacatgtcatgggagggacctggttggaggtaattgaatcatgggagcagttacttctatactgttctcgtgatagtaattgagttctcaaaagatctgatgttttacaagcattttttctctcccttcactctgcatttctctgctcctgctatcatgtgaagaaggatgtgtgtgcttccccttccaccatgatcgtaagtttcctgaggcttccccagacatgctgaactgtgagtcaattaaacctctttcctttgtaagtatccccgtctcgagtatgtctttattagcaatgtgagaacagactagtacagtacattggtaccacagaaagtagggttgctgtaaagatgcctgaaaatgtggaggcaaatttggaagtgggtaacaggcagaggctggaacagtttggggggctcagaagaagatctaaaaatgtgagaaagtttggaacttcctaaacacttggaaggctaggaagacagaaagaagtgggaaactttggaactctctagagacttgttgaacggctttgaccaaaatgctggtagtgatttgtacaatgaagtccagctgatgtggtctcagctgaagatggggaactcgttgggaaatagagtaaatgtcgctcctgctatgcaaagagactagaagcattttgcccctaccccagatacctgtggaactttaaacttgagagagattatttaaggtatcttgtggaaatttctaagtgccaaagggttcaagagaaaacagagcattaaagtctggaaaatttgcagcctgatgatgtgatagaaaataaaaactcattttctggggagaaattcaagcctgctgcagaaatttgcatagataacaaggaaccaaatgctaatcaccaagacattggggaaaatgtctccagggcatatcagagacctgcacagcatcctttcccatcataggcccagaggactaggagagaaatggttttatgggtcaggtccagggcccactatgcagcctcagtacatagttccccatgttctgcctgcttcagctccagccgtggctaaaaggggccaatgtataggtccaggtgttgcttcagagggcacaagccctaagccttggccgcttacatgtggtgttggtcctgtgggtgcacagaagtcaagaattgaggtttggaaacctctgcctagatttcagaggaaatatggaaatgcctggatgtccaggcaggagtttgctatagaagtggtgccctcatggagaacctctgctacggtagtgcagaaaggaaacatgtggtcagagcccccacacagagtccccactggggcactgcctagtgaagctgttagaagagggccaccatcctccagactccagaatggtggatccaccaacaccttgtaccatgtgcctagaaaagccgcaggcactcaatggcagcccatgaaagcagttaggaggggggctgtacccgccaaaaccaaagggttgaagcttcccacggctatgggagtgtcactcttgcatcagcatgacttgtatgtgagacatggaatcaaaggaggtcattttgaaactttaaggtttaatgactgccctcttggattttggacttgcattgggcctttagcccctttgtcttggccaatttctctcatttagaatgcatgtgtttatcctacgcctgtaccctcattgtatctaggaagtagtaacttttaattctacaggctattaggtggaagaaacttgccttgtctcagatgagacttaggacttggacttttgggttaatgctgcaatgacttaagactttgggggactgttggaagggcataattgtgttttgaaatgtgaggacatgaggtttgggaggggtcaggggcagaatgatatggtttagctgtgtccccacccaaatctcaccttgaattttagttcccataatccgcatgtgttgtgggaggaacccagtgggaggtaattgaatcatgagggcaattacctccatgctgttctcatgatactacgttttcacaagattgatggttttctaaggagcttttccccgcttcgctctgaacctctcctgcccccatgtgaagaaggacacatttgcttcctcttccaccataattgcaagattcttgaggccttccaaactatgtggaactgtgagttaattaaacctctttcctttataaattccccagtctaaggtgtgtctttattagcagtgtgagaacagactagtacatgtaagtatactcttacacatactgaaattctaaaagtggacatatatccaatatcaaagctttttatttatttgtcaagagaacttatttatgtgtttgtatgcttgtgaggtaagacaaatatgtatgtttagatgctgacatatactttaccggttctctttttacatttaggaatcttcattacaaaactttacttttagataattttatgtcattaaatttagtttcatttcatgtatgtacatacattatgcaagggctaagccaagcgttgggctatgtagtgaaatttctaacatcaatctctactttcaagatgtttagataaatagacaacataaatatactctagcaattactatcaaaatttgtacacagtattacatgagaccatgaatagaaaacaccgagggtataggaaagttcacaaaagattttctggaaaagattatagtggctaaattttcaagtatctgagttatctttaaaaaatggagaaaaagaaaatcaaggtgggggtataaacagatgcaaagagacatatattagcaattgtgagcaagtgagtatggctagagataaagttgtcaaagtaatagtgtgaggtgggtactgtgttttgtttgttctgtgggtaataataaccatattgtgtacttaagttatttgttagttagagacataattccagaatttacatcacagataattataaagtgtcaagaccagtatcaggataactaactcacaggctgtagcaatagttcaagtgagaaataataagagcctgattatggttgttatgagagagagaatgtgagaaaaatttgtaacatgtaaaatgatcaatattggtgattacttggatatggagagtgagagagaaagaggagacttagatggctccttagcatttggcttggggaatagttaattgaggtacagaattcagaaggagccctttctggggaagacgaaaataagacttcaatcttaaaaatgttgaaatttagatgctttctggaaattcaagtggatattttacagatatatgtctatttgaggctgtagcttaaaggagtagaaggaaaataagcatctcaatgtaagtaaagctgtcggctttaatgtaattgcaattgataaaaaaggaatacatagagtcaaaagggcaacttagatgatactttcaaaatccaaagtttaaggagcaaacagataaggggaagacagaattagatgtgcttaaacatgaaaactagcagcaagcaggtagtagaatcttaagaaaaaagagagacagagagagatcctatagcaatagagcagtaaagtgacttagataaagataacatttaaaagcacagtggtcatttgtgaccataaagtggacacagatatcattcattgtatagctgggatttcacaactataaatatttacacatacacacacacacaataatgtgtatttttctaatagctgatattaagcctaaacattgctaaaggggtaggccctaaataaatattgtaaaaatatattcttaaaattttctaatctatttatgagctgctaattgaatatctgaaacatgaccacatttcaaaaatagtcacagacattaggtagatttctattgtaaatattattatgtagcacatttatattgacataaccaatttttcaaattgtgtgggcttttttctttatcagaatgagttacagggtttgcattatatagtttggcttaaaaagagaactcataaaattccccacttgcagcccacttaaaaaagaattattacagttttaggcactgttgagtgtcatactgagctacaaaaaataagaaatcaccataatgctctccaccttcattttagttttagaaccccacacagggagacaactatagtaatcagagttaggccactgaggttcagatttattttgtttaatattaaattgtatagttgaaggaaacatcatttttttaatgactgtatcactacccttccaaacactgtagtttactaatgattttaaaacttctttaagtgcttaagacagaaacattcctacaatatcttagctaagatttagcatgcaggtctcatactgggaatacatttgtgttttaagttaaataaattcagcctcttatttagaactggaagaacatgttgtagacttatggttctatttttgttacctagacctcaaagaagtcagttcagtagaaaaatttatacaaggtattacatggaagtttactgggaatcagcttactctatattatacaatgctgagaacattgtttaatctttgtttaaacattgtttaacaggcagtatagtttccaagtgtgccttctctaatgcatttgtgcaagcatttatgcccagggttgctatgaaaaacagagataaataatttagtccttaaacttgagaattctgaccttagcagactcctcaatgagatactcctacaaaggccagacacctctgatattagctgaaagccttcctacctccacttccctcccccctcaacctccatccacccatgtctcacatacagaaatgcactaaagcatatagtgtgataagtgtgctgaagtaaaaggccacctctttttcttttatgctgaattatgttaataagtacaaagaagtttttctcatgatcatgtatcttagacagaatttactgaaatagatctttatcttctcactttctaacccagactgatgattgaattcacagaacattagttgagaaaacaaatgaaaatgacagaaaccatgttgaactatgcatcatgttctcctacttctgatgacatcaggtttataatgagaccagattcatctgtctgactgttacacattagcataaattattcccaggaaatccttcaattctcttttaggaataaataagattctgagaggcacatccaagtccattgttgggattatgccatttttaattgatatataatatatgtacatatttatggggtacatgtgatattttgctggaatgtgtaaaaatcaaatcagggaatttggggtgtccatcacttagagtatttaccatttctgtgtgtggacattccaagttctctcttcaagccacttgaaaatatacaacacattgctgctaaccacagttgctgtattagtctgtcctaatgttgctaaaaaaggcatacctgagactggataatttataaaagaaagaggtttaattgactcacagttccacatggctggggaagcctcgcaatcatggcagaaggtgaatgaggagcaaagtcacaccttacatgatggcaggcaggagagagcttgtgcaggggatctcccatttataaaaccatcagatcttgagagacttattcactaccatgagaacagtgtggggaaaactgcccccatgattcaattatcttcacctggcccctcccttgacacatggggattataattcaaggtgagattttcgatgaggacacagccaaaccatatcatcccatccccagcccctcccaaatcccatgtcctcacatttcaaaaccaatcatgccttccaaaagccacccaaaatcttaactcatttcagcattaactcaacagttgaagtccgaagtcttatctcagacacagctagttccttccgtctatgagcctgtaaaatcaaaagtgagttagttacttcctagatacactggggatacaggcattgggtaaatatacccattccaaatgagagaaattggccaaaacaaaagggctacaggccccacgcaagtccaaaatccaatggggaagtcaaatcatgaagctccaaaatgatctcctttgactccatgtgtcacatccaggtcatgctgatgctaaagatgggcttccacagctttgggcagctccacccctgtgactttgaagggtaaagctcccactcctggttgttttcatgggctcatgggctggtgttgagtgtctgcgacttgccaggcccaaagtgcaagctgtcagtggattactattcttggggctggaggacagtgaccctcttttcacagctccactaggcagtgtcccagtggggactctgtgtgggggctcccacccacatttcccttctgcactaccctggcagaggttctccatgagggctctgcccctgcagcataactctgcctggacatccaggcatttccatacatcctctgaaatctaggcagaggttcccaaaccttaattattgacttctgtgcacctgcacgatcaacaccatgtggaagccgccaagacttggggcttgtaacctctgaagccctggcctgagctataccttggccccttttagccatggctagagtggctgggatacagggcactaagtcatgaggatacacacagcagaggggtcctggacccagcccaggaaaccattttttcctcctaggcctctgggcctgtgattggagggcctgccatgaatgtctctgagataccctggagacatttcccccattgtcttggtgattagcatttggctcctccttacttatgcaaatttccactgctagtttgaatttctcctcagaaaatgaggttttctttactactgcctcatcaggctgcaaatttctccaacttttatgctctgtttcctcttgagcactttgccacttagaagtttcttctgctagatatcctgaatcatctctttcaagttcaaagttacacagattcctagggcaggggcaaaatgccaccagtctcttgcatagcaagagtgaccttaactccagttcccaacaagtttctcatctccatctaagatcacctcagcctagactttattgtccatatcactatcagcattttggtcaaagtcatttaataattctctatgaagttccaaacattccctcatcttcctgccttttgagccctccaagtctctaggaagtaccaaactttcccacattttcctattttcttctgagccctccaaactgttccaacccaggcctgttacccagttccaaagttgcttccatatttttgggtctctttccagcagcaccacactctactggtacccattcactgtattagactgttttcatgctgctaataaacacatacctgagactgggtaatttatcaaggaaagaagtctaattgactcacagtttcacatggctcaggaggcctgctttcatggcagaaggcaaatgaggagcaaagtcctggcttacatggtggtaggaaagacagcgtatgcaggggaactcccatttataaaaccatcacatcttgtgagacttactcactatcccaagaacagcatgagaaagacctgccctgatgattcagtcacctcccacctggtcctttccacgacgtgtgggaattatgggagctacagttcgagatttgggtggggatacaaccaaaccatatcggtcatatccccaaaccatatggttggggatacaaccaaaccatatctgctatctaacattagaacatatttctttctttctttctttctttttttttttttagaccaagttttgctcttgttgcccaggctggagtgcagtggtgcaatctcaactcactgcaacctctgcctcctgggttcaagctattctcctgcctcagccttcctgggtagctgggattacagagatgtgccaccatgcccagctaattttatattttcagtagagacaggatttctccatgttggtcaggctagtctcaaactcccgacctcagatgatccacccgcctcggcctcccaaaatgctgggattacaggcatgagccaccacacctggccagaacttatttcttctaacagtatgtttgtaacaactttcttcatcagccccatcctccaccaccaccactcttctcagcctctggtatctatcagtctactctctatttccatgagaacaactttttcagctccagcctatgagtgaggacatgtgatatttgtctttctattcttgatttattttacttaacataataacctccatttccattcatattgctacaaatgaaaatgattttcattatgccacttttaaacatgaacatttgacaagaaattgacttatttattattgttatgtaaagtaactagtttaggctaaattgggtctactgttgggagtatgcacaataacagtaatacaataataattatgcataaccccaacaacagacccagctttaccctatttatcttatataacaataagtaaatacataatacataaaagaattttatatttttcctctaacacataatatttctttatctcccttttcctttttctctctttcttacatatacacatgcgcttgtgcatggcacaggttagtataaaccagaatcaatggcagagctcactaaaacacagatttctggccccaacactagggtttctgattcaatctctgtggtatagagtatagcagtctgcatttctaaggtgtttctattggtgctgatgctgatgctgatgctgcttttccaggaacaacactttgatagccacctaacgcatgtttgtattttttcagttcagatacgcatgagcaagtcacaggaagcatggtcattggagaatcctgtatagtagagtggttaagaccaaacatttgaaagtaattcaaatatgtacaatggaaagcatttagaatagttcgtggcacattgtaagaattcaaaaattgatagtcattattactgattttttactagagctgtcagtctatccaatatgcttctttcaatgcaagctccacatatcccactagctggacttattttaagatgaataaacaaaaatacaaaaatcaggatcgcaaccatgagctctattttgataataacaaatatctttcatttcctttaaatttctaaaatatcctacaaatgtgactatatgcatatatatgttcatgtactaaatgttgatttgtacatttgttattatcaaagaccaagctttggctaacacacttaaaaaggataaacgctgtttataatctgactgactatgattgtttgtagtgatgcagtagaagaaaatcatttatcaacttaagattttatagtttcttaagaacagtacttccattaaaatgttctctaaatatggtaatattaggcaaatgcaagagtgcaactaccgtatttcgaaaaatcataaacaattgtttgcatttagttcatagtgttgtaaaaaatattactttctataatatacgtagccatactttataaattatttagtatttaacataattataataaaaattaagtgcatattagcttcattccttattttaaacctgtacatatattatgtgtatgtattaatccttcaaatcactacttgagatgaattctattattatctccattttgcgatagcgaaatccagtcccagagaagctaaattagttatccaagattgcattagttattttggcaagtcaaatttgaactcaggtagttttattccatggcccatattttaagctgttcattaagttctccatcttgttgggatgctgggtctggattcatggagtcacgtgatctagtgacaggatgaaccaagtgaccagggagtggtcgtctcattaaagtatgtaaggagcataagaggtgagggttgttaggtaagatgagaagtccgggatccctgtgtggtgagtctagaagtcacagtccagtataaaacaggcttttaaaggtaagtggctggaaagctggacactgatttagtagactggcttagagtcagtctatctaaaggctgaatggaccttcacagaagttatatcatgctctgctgttgtatattcccaaatgcctattcctttgagacttgaggggtccaggaccaggcctgcagatttgatcagaatatgactgcatttgggggcttctactggcatctgctcccccaaagacttgggatcatctgagagttctgcagttgagtatgaggcctctagtaagaggcctctcatatctgagacccattctaaagatcaattatttgcatgcttgtggtccacagtcaagatatgcatacaaatcctctagattctatctcctgtgaaatactctcaaggatactaggcaaaatattacactaagtcttcatatcattcactatttcattaggccccatctgaactcaatgtatttttaatcatttttccagaactcctttaaacagctcttccattattgtcagaatactgacttagagtcctcaaattgcttcttcagctggattatatttcatattacatttttttggctggtatttttatttccttttttttttaaatttccaacaaagatttcactaatacattgaaaagaaccaagaataatctgcttttctcatgaaccctaacctggccacctcagtctattataatgtctctttttccttgcagtaaagaatttatagcacccatttgacacttgacacagagtatatacttactgtatttactaggttttgagtatatcttttcatacatattgttacagttttcaattctaaatgcacaaggtataatatgataccttgtgaataaaaagataaacattaaaaattgttgattggtaggttattttttaatatgctggataaaactttttgctatgtataatccataaatttgcttcaaaagtattccttagttattatttgttactacaacactacctttaaaaactaaatgaggccgggtgtggtggctcaggcctgtaatcccagcactttgggaggccaaggcgggcagatcacctgaggtcagaagttcaagatcagcctggccaacatggcacaaacctgtctctactaaaagtacaaaaatttgctgggcatggtggaggttgcctgtaatcccagcgactcaggaggctgaagcaggtgaagtttgaacctgggcggcagaggttgcagtgagccgaggtcactccattgcactccatccagcctgggtgacaagagtgagattctgtctcaaaaaaaaaaaaaaaaaaaaaaaaacaaaaaacaactaaatgaaaactcccttcagcattttaattcaaatattggattattcatattaaaatatcaatagaatataaacacaaagttgataactcaaattcagtatagtaattaacaatatgtatcttggttttaagtcttaatagtttttgatgacaattaaaattaaattttacaagcagagcatgagtaatttagtgaaattaatatatgatataattatcattaggtagcaaccattatgagcatcaaaattccatcctataaacattacactgtgcagaatcagttagatgcagcctgccttggatgtcttcctcttcctttttgctttcaacatcgttttagtttttatgaaaacaagttattgcctaaagaccaggctaaggtccatatttcaattttaaaaactgaaataaattatagaggccatttcttatcaaatttaagaaccaggagacaacaacaaggttaacacaataattcaagaacaaagaatcactaggaaaagcgggaaaaaaaaaataagaaaaaaaggaaaagaaatttaactaaaaactaatcatcatgttgatgtctacttgtgtgtttttagttatatattccatctgggctttatctctccaagctaaataaattaagaaaatgggaaagatcatttttgtaaataatttcaatgcttgtttgtttttaactgaatagttaatatatatatggctaagtgaagtttttcagttttcagcaatgtggcattttaaactgacaactgtaatataacttaattatcattaataaagacgattacattagttcaagcctcatatgcctggtttattacaattgcctcctacttctgccttctggatttagaatctcccatttcaatatatcaggagtaatttttataaaatacaaatcagatgttgccatacctcagaccctttagtggctcccccgtcaccttctacaacatggtatagaaaagtgtttatgacatggtacgtcttattcattgtaactatgctatgtcacactctgatttctctgtgcctttacttatacaactaactttccctaacagattccaacttctctcaacttctctcttacctgtgttcttccttcttgagtcaacttcagcatttctcctttgatgataatttttgcacatgcccctgttatagactttattaccttgttttcttggtgtagccaaacttgtcagtgtcctatgcatgtccctcagagcatttggtatgctttggccaacttccacctcctggtattgtcactggatcctaagggtgttgcttttccagccagaaacctctgcgggtggtggcgcctttgcccaagttttgctcggactagctgtgtttgtatcacccactccacctggcaggctgtgcttggctcatgctactgggctaaatccgacactttgccagggcaagccaggttcagagcagcgatgggtgcatgagcgagcaagtgcagggtcttgtcactgtgcatagccacgcacgctagctgctttggcgggacgggtagctccagccgccctctcccagcaaaccttagattgaatcagatacagggcaagagccttctgctgtgagcacccgcgtctggatgaggggctccctgaagagccgcaactcttctctcctttttgttgctcgccacatggtgaggggggtggcagctaaacaaggttttagccctgtttgtgttaccgctctttcattcctgccatttggtgggtcccgagtttttggcccacatccaggaagaatgaggtacgcgcacagctggagagttaaggtggagaggaactttacaaagctacagaacagctctcaagagaccgaagtgtgtagctcctatccataggcaggttatccccataagtgtccagctctcagcagagagaagacccggaataggtagttcctttctgcagaaggtggtcccaggagacacgaagaggaaatctcctccctgcagctggtattcttgatgtctgtgtgaggctggctggctccagggtttttttgggctcagaaaggaggaagtacatgttgattggtccacgggtggccatgggcaggcccggtaaaagcaccgtaagttttcactctgggccacggactccactggaactgatgggctggtccccaggcttcaggccatccctggcttgaaggtggggcttcaccagggacaccccactttccacccaggagcctgtcttctgctgccatcaatcatgttgttcatggtgcccaggctgtttatgaggagaagtgcctgcaggcccacagtgagcagccctctgtcccctcttggcctccctcctatgttcattggcgcccaaagttcacaggaggctgaggtggcagggggctggcatgtcagcaccaacccaagcacgcacacacccagcctggttgtgacagcacctgggctcggcctgaactttgcttcaaaattggaaggggtgccaggagctggaagaggtcaggcagggggaacaggcacttccgactctgtgggggcaggggagcttcctggatccctgagagcacagagatgcctaggtctgcagccacagctgggcagctggagctacacccaggatggcagggctcccaccctgccaacttggaagggggttaggttcctgcctgctccttgctcccaccggctccctggagcatttagcccaggtcatacctcctctgctgtagctggtgtctttgcagtggctgctccagatgggccactgctgccatcagtatctacagcctgactcagtgcccttctatcagattatgctgagggaatttgactacttgcttctactggaggcaagaaaatccaaaaacttggcagcccattggccaacattgcagctaattactctcaggatttagtgtatatgttttccagttccataacctctcaggaactggacaattaaaactatcaggacagataactctgatgcatgagtttgcatctttttctagagtttgcccttggagtgaagtttcagttctccttatgattgctggtttaatagcaatcttgttactggctaccttctcttctttgcctcactttctcacttccttatcactgttatctacacttctcaaaaaatatttatacatgaatattttgtgtccagattttctgttggagaatccacagtaagccattggacaccagaggtactacagtgtggggagcagagccttcagatgggatgctggagttgaatcgcttgttggccagttggtatcaagaccagttggcattttataacatcacaatgaccaagattatcccctatgtgaattgggatggcataaacatataaggttatgtatgccttatgcagtatttccagaatttgagatagtgacaatgataatgataatgactgtggagttggtagttgcaagtattgtcagtgatctaaaggaaaaaatgacttttaaaaaagcttcaactggtcaatcaaaatctcaggacatggtgtgaacatcacaagatctctataacaccatttaaagcaaccctctccttttgcagtttaaaggagattgagctaaaaatcagatcttgtgcctggttataagaatagcagaacagtagagaagcctcacttgaaagcaccagcacgccttctgtggaaaagtcagaaccttcacagggaaggagtaggaccctgaactctgggtttggaacatctgggtggctcacacctcactaaaccaagattctttcctcccctgaagaccacataaacacctcatctgaggttgatacttcaaattgtgcacatcttcctccaatttttttcttctttgtgacttctagaccaattattatgttcaagaccaagaatggcccaaatgaggaagtactgtctctgttttaacaataaaggaattattcatcaaatgaaccacagacaccggctaatatgtccaggtagatccagaagcacttagaagaacactaagagtaagtttactacgagtaaatcttctgagtgctggaaaaggtgtgtgtgcaaaatattagaaacacacggtagactctaaagatagtatttacctaatgtaatgaattcaaatctaaatatatatattttgaggtctaaatgtccacatccatacctagtagtatacctaattacatgtttctgtaaaatgttttaatttcagaaactaaaaatatatattaaattagcatactatcacattaatcaatgtttaaattatacaataattataaaatgtaaatctgtatccttgaaagttaattaaaatatataggatatgattcattttttaaagtcttgaagaatatccagcacagtcatttaacagattacattagctgagtttcttttgagaattaaaatgtaataaacttacactctttgaaaaactacatataagatctatataaatattccacttacttttacttgacccacaaaggcattggcttcttcttccaccacagataaatttcttggcagataaggatcaaacactggagcattgtcattgacatctgtcaccactatgtttactgtggcagttgaggtcttaaagaaaaacacaagcattaaatgtgagaggagctatttttacttagaattcatttaagtagtcattctggcatttgtctatctgaaaagcatctcatttttctttctaatccttagctttccaaaaaataaaaataaaaaaataaaaaaattaaaaaaaagaagcttgcaaagaagcttcccacctcaaaaaacagatgggaaaagcaaatgatgatattaaagggcaaacatctttttggaaatgtcaagtatttcctggaggaaaacggttttacctttatcttgttcacattttatgggtggcaagcttttgtttatacacacgtacactgctttatctctgaaatgtgccatttctgtagtttttgctgcttgtatgtttgactgtttaaaaataaaaccagtacattataaaatagcatggtacatcaaatgagcattttctggaaagctcatgctatcgaaaaatgctaccttaataattttctaggtgtacatttaaaccaagagtttgagtaccatatactaggcatgaaatgattatcttataagcatacagcttacggaaatggtatgcaggtaaacctaccagtagtgtgtgctacctagttaaaagttaaatccctggcctgctgcagtcaatattatgtaggtcaatgacttctgcacaatcaatgactatcttcataagtgattcaagctggaaactgctctctctaatcaaagcctgagtacagcacagaacctctacctagctctgtcacagtgtggggctgatcacaaaaggctgagagcaaaggtacagagagaaagaatattaacctggaaagtaagaaacctggtatgctatggtattaaatatttagtaactataaataaaaaggaggaggaaaaagcaaggtgatactgtcatgagagaattatccaccttttgtttaaaaaaatgcaagttccattaattagtaagtgatttgtagtgagaggctaaaatcctgagcactaagaagtgacttgagtgaagctgaaaaggttttgcagcagtcatggggctaaggagtcaagtgattttttttattttttatttttttttatttttttagctattaaagaggacagatcttggtaaatacccaatgctttctgttggggtcacagaagttctataccatgcaagtcatggtgcttgggaaaaagaccaaacctccctcaaatgtaaacccagtattgaaactctgattggatttaggtgatctgcccttattttaacagaagcaaaagcaaatactttttttagtaatgtaactttatcccaagcctctataaattttttcatgcacagtgttcagtagtcacttaataattaccatgcatagcagggaattcctgggtattagtgatggcttatttctttatttgtatgttggcttaccctttgaaaatttatgttgctattcatatgtgatttgcacacatttttgtatttaaagttaaataaaatttttatttaaagacacgtacaaagatggtcagaacatcattatatagtcaaaatctggaaacaacccaaatgtccatcgatagtagatggttatacaggattgtgttttatatatgcaatggaatcatatgaagtactgagaatgtacgaactactgctataagtaataacatggattaatttcatgaacctaagtttctagaacataaataacacatactatatgattccatttatataaacttcaaaaacaggcataatccctacatggtgataaaaattagaatacgggtcactttgaagaagaagatcgaatagcgacagaaatgatcacaaagctgagcttctggagtgctgattaatttctgttttttgttatgagtagtggttacataggtgtgttctctatgtaaaaattcattaagctgtagaattattgtttgtgcattagtctgtgtgttatattttcttaagattatttactttaaaagatgcacacacacaaacatacacatgtgtgtcgatatatgtaagtatgtttaaagaaattcaagtgctacttgactagatggaatccagatcatttcattttcctcgttacttttatatattttctaaatgttctcccaaaaggctaccatgctttcatgacaaaaagtattttaacaaatattatttctttaaaatttgccttagaattgaaagcagtaaagaagatgtgttttttacagttgcggtagttcccaatttgcctgagggttaacaagacattgaaatttacagcctggatccaaaatctaagaatggtgaccctggagtttgctggcttttcttcaaattgcctgaccccctttacaccagcctgtctttacctgtcaatccactgtttttctcatcctattctttaaaatttatattcatgttttcagagtattctgtatcctcagtttaagactgtaactcttaagtggataatgaagaatacaaccagatcactaagtaaactaagaagtcaaataacaattccataattttgtgctaataggggatgatatttatgggacatgcaggcattttcttcatttcttactgaattttatatgacatgaaaaaaatccatgtcttacagaaatgtacagtcacatctatacatagaataatttccagtttatatatttcttgaagttttttaataccacttgcttcagaaatacttatgtaaaaatgaggatttcagggctatccattaggtctattgactattgttctgaacctatggaaatatttataaattagttaggtgtaaatcatatttatttaatttttcttgattggttcagaaggatggcaacaatatgcttcaatgtggatctgtgccatagagaatgtttatgtcttattaaggaaagacttcttttcattgttcaagcttaaaaattagcaaatgaaaacagatcactttaattaattgttaggaccatatgtcattaacacatgttcacaattaattttaaatatgaatatatatataatgccagttaaattaaaaagatctcaaactaataaacctaataaataaaaagttacgtattttccatcaacggagtttgctcactgattatttcctcaaaagttgtattaacttataattccactagctggaaatacttgcatgttagtactaaatactgtaattgaacactttcatgttcattatttaatttaaatgtgtcttagaatttccttttgtaatatcatagaagaattttcaaaatatatgtctcattctcaacaatgcaagatatttctgtttttgtttgtttgtttgttttgagacaaggtatcactctgtcattcaggctggagtgcagtggcatgatctctgctcactgcaacctccgcctcccaggtttaaacaattctcctgcctcagcctcctgagtagctgggattacagacatgtgccaccatgcctggctaatttttgtatttttagtacagatggggtttcactatgatggccaggctgatcttgaactcctgacctcaaacaatctgtccgccttggcctatcaaagtgctgggattacaggcgtgagccatcgcacccagcttactgttgtaatttgaatacacatttatttttataaactagtatggctctgaaagaaggatattaatatagcatctttttttattttcattgttgttgttttttttgagacatgtctcattctgttgcccaggctggagtgcagtatgtgatcatagctcacagcagctttgaactcctaggctcaagtgattctctcacctcagtctcctaagtaggtgggactacaggtgcacgccactatgcccagctaatttttatttctttattttatttttgtagagacagagtctcagtatgttgcctaggtggtctcaaacttctcatctcaatcccaccttggcctctcaaagtgctggggttataggtctgagccgcgatatccagctcatcttttgttttttgttgttgttgttgttttttaatagtataaaaaaagtgagttataaagccatagtcaaagaaagtagtgtaaattcatctatcaatacacaatgcattatttgaaattcgtgagaacatacattaagagtatcttatttattctcttctagtatttcctatctcaggaaatgacatggcaaaataattaactaattttctaagtcactttatctcatacatgcaatttattagtcaccaagtcctgttaatttgaccttgtaaatgcgccttgtattatacagttttgagcaatggataaataatacaattttcatttcctgagtaaatagctggaagtcagataactgggttttctgattagcatatgtttagctatgtaagaaaaccagaaatgtgttttgctcaataatttaatgaataatttttaatacattttcttgttaatcaacttaatgaacacttttaagggcagtgtgtaatactacgaatttaataagcaattttggctttaatcctagagaggataagagaagggatgtttgttttttatttaatcacaaaaaaatgcatttttttatcatttaatttttacatcttttgacacaaaatttgttaaacatttcatggctagaaaactatttctttatattttgtgtgcatctcatagcacagccatttgttttgtgctattacatttatattagatgattgaaattcaatgacattcaatacatggtttaagaaacatgtatgcttagaatttatctgagcagagactcatggtatgtataggaatcagtcaggaatatttcaatttgttcattaagaaagcagaaaacattatcagaggtaaggtaacactataattatggagcacttatcatttatctatttcttaaataaaaacatgagtgtttaatttcaaaggtgcaatttcttttctatagtcaacaagattcactatatattctcagaaataataaagacattattttattaagaaatgtgtctaacgtgtttactaatagaacacacaatgtcagctcaatgaatatttttagatactttaaatatctatttttattataatttgtactacatgctgaaataaattaccttataacttattttatttaaatgtctgaaaaaagaagagctagaaagaatattgaaaatttccatctgtgagaaaacacaagaaatgttatttatagaacacaaagttttcctatctgaataaaaatcttcactactatatctaaaattcttttcaataacaatgggacaatgaggatttatagtttagaattcaatcattttttgtttaggccaataaaacaagaaaaatacatattcaataataagtatagtatttagagaatattaatttaaaacattttcatccttaagcgcaagtcatcttgttgctacacagttcagagccaagccaacttcattcagattgtagagtttcattcatgatgtagagtggaggtccttcctaccattaaagattagccaggaggctttctttccttctgaaggaaaaaaatatacataaaatctagaatttctttgagaaagagaaaagggaagttccttctattatgaattacgggaaggagaaagggagacacagaagagacatgaaggcaggaggcagaggtcctcctcctcatcccctactgccactttggacccctccttaagtgaagaggcactggagaaacattttggaagaagggggaaatgatgactgggaaactaagagaaatttgggtgaaataatcacagtagttttcaggagtatgtaagcctccagaaaatttccacaggttccatgggaggtcccatctaataggttatggcactgaatatacagcaatggcagagagaggtgtcaagagagagaagccatactaccagcataaaggactggtaaatacatgttacatctagaccacaattttagaatgaagtcagggaggagaggtttggttggcagcttaactagtgagtatttatattgtcttaaacagataatgctgaaatactgttctaagaaacttaagtgtgacccagattacatctattccctacctgtccaaacacatatttatacattattgtctaagtaggaagattgcatcaggtataaaaaataaagaagcttttttttctctgtgcacatctgagtgtagtgtgtaaagattatatatgtatgtgtgtatgtatgtatacacattttatgcaatcgtgcatgtttttatataaatatatattttcaaaaatatcagaaagtatttatagtatacctgtatactatagtatatataatatagaactatagatataaatatttatatatttgtacataaacattttgcatgttacatatattgtaaagattcacatatatgacttaaatgtttaaagttttactattctataaccatacgtattgtgttctaaaatattaaatcaactattttgaaattcaaagttactttaacttcacacattttctcacgcatgtatttttgcttttgttaaagtttcctatttgattatgaagttaaatgctcaacttttaaatgttaattgttcatttatattgccatgtttcaaagaaatttaggaaataatattgcttcaagacaaaaacaaagatgctaagtcttctagcaatctgaaattgtgaaatattacaagtgttcagactgaaagccataactgagtaattcaatccagtaattcaagagcattttacagaaatcaaaccatgatggaatcaagttacctattgtatcaattaaggaggaaaataatattgctgaacacacggaatctggtcagaaatatctaggctacagaataacttcacattttaaatgaaaaaaattactgatcactgttcgcatatttatttatatctttcactgtgttattggttgattaacacagctgcaatccataagccctacttcctagctatttttctacccactgttgctacttacagataagaatatctaaaaggaaatctgctagatggggtttctgaaaaaactttggtgctttgttaaaataaagcaggggtgcagactcttctggcattcatctttatactttgtctggtatagagaattgacgtctagagttgcagaagatgggaatgaaagtagacaataaaaatggcaaagcagaaaatagccagcaggcatcctcaatggcactgatgtgcacctgcaccatctcttcactgtccacctctagattttttttctgtatttgtttgtactatctcaatttttaaatgtaaaatgttgtggtattaagtatattcatattcttgtgcaaccatcatcactatccatctctaaaactcttttaatctagcaaaacaaaagctctataacattaaacaataactccccatttctcttttctttatcctctggcaaccatcattctactttgagtctttgtgatttttgaccattctaagtaccaaaatataagtggaatcatatggaatttaacattttgtgactggctaatctcacttagcataatgttctcaagatttatctgtgatatagtgtatgtcatactttcttccatcttaaggccgaatgatatttcattatatgtatataccacattttgtttatatattactctacataaacatggaaaactgggttgcttttacatcttagctattgtgaataatgctgctatgaacatgggaatacaaatatctcttggagactctgctttcaatttttttgatatataaatgaaagtgtgattgggggctcatatagtaattctatttttaattttttgagaaactaccactgttttccacagtggttgtaccattttacattctcaccaatagtgcacaagggttccaatttttccacatcctcatcaacatgttatgttgttgttgttgttttgttttgttttctgtttgttttttataatagcgtctctactgggtgtgaggtggcacctcattgtggccttgatttgcatttccataatatttagcaatgctaagtgttttttcatatgtttactggtcatttatatatctcctttggaaaagtgtctattcaagtactttgccaattttgaatcagtttgtttatttttgttttctttaaaaaattctcgggctgggcgtggtggctcacacctgtaatcccagcactttgggaggctgaggcaggcagatcacgaggtcaggagattgagaccatcctggctaacacagtgaaaccccatctctcctaaaactccaaaaaaatagccaggcatggtggcaggtgcctgtagtcccagttactcgggaggctgaggcaggagaatggcctgaacccgggaggcggagtttgcagtgagccgagatcgcgccactgcactccagcctgggtgacagagcaaaaatccatctcaaaaaataaaaaaaaagatctatatattttgaatattaatgacttatcatatatatgatttgcaaatattttctcccatttttatgttgcttttttattctgtgtctttgacacccctttacaaaatcacaaattccaacttgtctattttttgttgttgttgtctgtgtctttggggtcatagccaataaatccctgacaaatgcaatgaaatgatgcttttgccctatgttttcttctaagagttctatagactcagttttcattttaggtcatgaatcacttttgagtttgtttttgcatatgatgttagataaggtccaacttcattcgtttgcatgtagaatgatcatagcacccatcttaaaaattatctgaccaattaagtgaaagtttatttttggattttctattaaattacattggcctgtatttctgtttttatgctagtactactctgttttgagtattgtagctttgtagttagtttgaaatcaagaagtataagttctccagctttgttatttatttttctttttggctatctggggtcccttgaaattttaaagataagttttagaataagtttgtttttttaaaaaaattatttctacaaataacatcattgggattttaatagaaattgcagtaaatctgtagattgcttgggagagtattaacattttaacaatattaagtcttcccatccatgaacatgggatatttttcaatttagttatgttttatttaatttctttccaaaatgttttgtagttttcattatacaagtcttttatctccctggttaagttaattcctgagtattttattcttttggatactattgcaaattgaattgttttcttaattaactcattcattttcaatctatgaaaatgcaaatgattttgtgtgctgattttgtactctgatactttgcaaaatttcttagttccaacatttgtgtatgtgtgtgcaaacatgaaacatgtgtatggaatcattaaagttttctatatgcaaactcatatcacctctaaacagagataactttacttcttccttttcaaattggatctttctctctttctctctctctcttttctttctttttttgcctaatagctctggtgaggacctctgatactatgttgaacacaaatggtaaaagtagacacccttgttctgaatcttcaaaaaaaaattagaatcgaaaaagtatagttttatctgtacccccgatagctaaaaaaaaaataaattacatgacacatgcaacttatacagatttttcaacaatcattaacaaagaaaatttagaaaaggacagtcaaatcaaacttcctccatactgtctacaaataaactcacaatgaccaatagaatgtgacctcttatctccatcatccccattttgagatggtagaaaacgtgtattctcatgatcaaattttcaaactcatcctggcaatttgtttcacacaaattgcttgttaacattttcatttcaataaattccatccatctgtctgtgtttattaaatatctgttttaaaccacatgattcttaagtttaaaaggttaattttactgtaattactaaatatttagataagaaaagtgctattaagacgtgagaatattattgttatataatcactttttttcttcaggaacccactgtgtatgcctacatataagtatatccgtaaaattatataaatgatggaattaactgaataaacttttgtttgaaatctaaatgctttctactctactgatattctcattacaaactttacaaatgaacacaaaatttactcagaaaatcagaattttaaagcaaaatgaaacctgagtgattatatgaggaaacgaggacctagaaatgctaagtgtcctgtccaaggagaattaaaatatacaaataaattactgaacaatgaactagaaagaacaaaactactgattttagcccagaacttattttggttttaagtagtcaaaagtattattagtagattgtgactattttccttccatctgtttccttgtctaagaaactttaaggacagacttaaaatgttctagctaatattactgccattagtttctgatttataatgtggcatatttcaaagctatgtattatcctttctttttttcctattttattggttgacctgaatgctttcttaatttcacttcactgtaattatacctcttaatctatgctaaataatttctccttctcctccttagaatattttctctcacttattgcctagccgagttaccctctaaactttcatcataagtcaagttcttcaattacttcctccagaaactctcactgacttctttacatacatctaacacagacatactgtaataatttagggcaggctgggcgcagtggctcacgcctgtaaccccagcactttgggaggccaaggagggtggatcatctgaggtcaggagttcgagtccagcctggccaacacggtgaaaccctgtctctactaaaaatacaaaaattagccaggcgtggtatcatatgcctgtaattccagctacttgggaggctgaggcaggagaatcacttgaacccgggaggctgagtttgcagtgagccgagatgtttccattgctctccagcctgggcaacaagagcgaaactccatctcaaaaaataataataataattaggtggattgcttatataaaaattagccataggttttatttacttttctatcatctaagtacctattatcctcactgtttactacaactgttctgtatattttattatatgtataagtatgtttatttatgtaatgtctgaaaaatgttaaatagcttactatggacagactgcaattaccaaatttaattatttctatttatctcacttttagttaagatgagaaaactattcaggtatcaattttatatttttattataataaaatctcagaaatcctcctaaaataaatgtgaagatacatttattttacatttattattacaataataaatacattattattgtatactttcagccaatgtagtatatagattaaatagatcatttcaaggagccaggagatatgttgatatttaaattgagtgagccttgcttatcaatctgtaatgggtttgaaattatttctagacaatagcactgagttgacacataagcacctgattgaaaaaaaaaagagaatcacctaacacatggcatagaaatggtgaaaataattattaacaatggtaatattacaatacatagaaagcgggatgctggcagttgtgaatgagatcgttcaaataacacagacaagtgattttaaagcagttcagaatgtctaacaattttttttttttaaagtgagttttaggtccaaaggaaatagaatttatcttctttggaattataagcccatttaaattatttagataaccaagaattacttatgattcttactgctacttacaaatgcctgtggaaacaagcaaatcactttcctaagtgcttaaagatatttatccacaaaatccactcttcctccctgacccttaaaaaaatgacgctaagtgtaacaggttccaacataataaactgccagaacacatttcatggtgcagtgcaaatgacagacacaatggaatacctgttagaataaagtagatttcattttccctacaagttaggtgagaatgctgatctcaagtatctgttctgtcaagtcaaaggttgcagcacaatagcaaattcagagtataggtgcatgtattaatagcctgttgaagaaaagagcaacacttctagtaattataagaagttgctccagatgaaaaacattaattcatgtctgtgatacattgtttaagactctctcagttgccttaatactatttttaaaaccccttcacagggagcatactcaccccatctggcctgccatctgaagctgtgatgatcagaatgtagcgatcagtgctttccctgtccagtgctttccctaaggttagaatccccgtgctagtgacaaaacaaacaaacaaataagacaaaaagagatattatgtcacaaggagagtcttcttagtatagtgaattacttttgatagctttttttcccctctcagtaatcacagcttgagtattttagatgtataatactaagattcattctgaaaattgaaaacagcttttaaggctgtcaaatttcttagcagtatccatgaaactgacactgagctgatttcctaccttccaggaaacaaaacataacaaaactgtgcttaattcattccaagaagaacagtatctatcttgttttcgattatttcaagagaaaagacttcattattccttagcagtctcagaattctttgaaacaaggaatggtttcctataactaatgtatatcacctcccaatttatgtcatatgtatgtccattatgaaaatgcaaaaacccatctaaatgttatctctgacaaactctatggataaaagtttttcttttttcttacttttaaaataacagagacccattgtacaaaattagaaaatagaattttttcaaattacagaaattatgttttttgtaatgtttctttttgtactttattataaccacatttaaatatatgattgtttcagaagaggaatcattctgcatattttacattttttaagaaaatataattgtattagaattcatgttctcattttataatttgtttaaaaccccttttgtggctacactaacaattttagtattttgttattctttggaaatttagctgtttcttaatttaactgatgtataatgggagattaacagcacttgggaaaattattgcacttacaatatttttaatacctactccttatcttttcactgctcagaataaatgtttccaaatatttaagactttattcacccatgtaatttattttataacagtttggcttgctctctaatgtaggttctacatttatttcttaaattttacatctgatattgtacacattttaatcgagcctaacaagtatccactgtgtagaagagtttatctgaatataataacacattaaaatatatgtaccaagtccaaaacataaattgtttctaatggataaaatgctttcattttaaggtaagtgcttttattgtaaagaaaatttaaacaattcatatcacatatggtagttgagtacagagagtcaaagccgatgaatcaaaataagaatcacagttactcaatttgcttattatgttgtaatggttgacgtggactttttaaaaagttctgaacatatggcatgcccatgaaaaactgactttgcttcctgtacattttaaaaatgttttgtcaaaataattgaaaaccagttcccagagcatgttcacaacaattaagtttggaccagcttcctacagtacagaaggtccagataatcccattttaaaattacattaaatgagaaaagtaagacatgtatttcttctgaggcttattcacaagtatcttaagaaacaggaaagctgaaaacctagccatggtataataagagaaagaaagaaaattgagttaccattttcattttgtttcttccctcagttaattatctatattcctccttgtacattaaattagaaaattactaaaaagtatattgtatatttacgatgaattacaaaactcacgtgataactgagttgatttcctaccttccaggaaacaaaacataacaaaacttcgcttaattcattccaggaagaaaaatatctatcttgtttttgattatttcaagagaaaagatccattattcctcagcatgttcagaattctttgagacaaggaatggtttcttataaataatctatatcgcctcccaactgtatatagtatttggaatatatatgtatactctatatatactatttaggatatataatactatatgtattattccaaaaatactatatgccgtgaacaatatagtatacagtatattcatacttagggccattttaaacacaaacagctaattgtctatggtctggtgattattatagaggtagtttttatgtaatacgcgggccttgcgactcagtgttgtaggcagttgtgtggtatatttgggcaatgcagaaggggagaaacacaggcagtgtattttgggattcatagctgaaagactagtttatgggtttacctgtgcatccttttattaaatccgagaaatagctcacaaaaagtcttattaccagctagatggaggctatcaggccaggatacattggggtacacttagtaatgcaatacaccttataagttcacatattaaaaatacataagcttcttcaattgataaagcatcaataacactgctacttatacaggattgaaaatacatttcccaggagtgatgtcagtggaaatggagaagacagccccaagagatggtctcgccacaaaacgtcaaaaaatcacaattaagcagggaccttcaacagcaaatttgatgaaactctggaaaacagtcacaggtttatagcaaccagatgaaggcagaatttgttttaaaaaaaggtaaatcaaatctggtagaagaactctgtggcattttgacttgtctttatcctaccatctcactggctcagagtggccttgaaaacatcagtgaacattcccagtgtgacactatggtctttgtttctggagggagcgagctatccttattcataaagaactgtgggggtctattctagtctgtctggagactgcctgaaggagtgattcatggcacttatctttgtttcatcaaacttggaaatcactcaaagcagaaaagcagtgggcattcctcagaaatattgtaaggcaggggatagcccacaaacacttgaggcgtataatagagtgccaaaaacttgccaggaaagtctgggtaaatagtttcatggaaaattcaggcactcaaaagtgtactggggaatacagaataataaatataattgagaattcataaatatacccacacatctacagtcatctgattttcaacaagaatgccaagaccattcaaaaggaaagaatagtcttgtcaacaaacggcactggaacaaatggaaatctatacgtaaaagaattaagttagactacttcacttcatacacagctattacctcaaaatggatcaacaatttttctaaacacaagaattgaaacctgtaaacaactcttagataaaaactagaggtaaatattcataatcttggatttggccatggattcttagatatgacaccagatgcacgggaagcaaaggaaaaaatagatatactgaacttcgtcaaaataaaaaaaaaaaaaccttttgtgcatcaagggacattatcgagaaagtaaaaaaaacaacgcatataactggagaaaatacttacaaatcacatatctggtaagagtcttatttccagaatatataaaggattacataacttaacatcaaaaagaaatcccaatttaaaaataggcaaaagactcaaatacacattttttccaaagaagatatacaggatatacaaataatcaaaaagcatatgaaaatatgtcattagtcatcaggcaaatgcaaatcaaaacccacaaccaagtatcacttcacactcactatgataattatatttaaaaaaagaaacaaccaccattactaacaacaacaacaaaaaataattgttggcaaaaatgggaataaatcagaatcctcatatatttctggtgggaatataaaatgcttcaatcactgtggaaaatatttgacagttcctcaaatggttaaaaacacataattacactattccctagcaaatctattcagtatatacttaaaaaagccaaacacaggtacttaaatacacgtacatatatgttcacagcagcggtatttgtaataccgaaaggtagaaaaacagcttaaacgtctatcaatttatgaataggtaaacaaattgttgtatatgcatgtaatggaatattacgtagccatgaaaagtagggacctacttgcacatgttgcaagacagacgaatcttggaaacattaggctacaaaaaagaagctagacacaaatagtcacacattgcatgattccatttctgtagaatattcaaagtaggtaacttgatgaagccagtacgcagattggtgtttgccaggggctaagggaaataaggaatagggagcaattgctaaatgggttcaggtttctatttggagtgatgaagctattttagaactagacagagttggtaggtgcatgagttctgaatctcctaaacaacactgaattgttcactttaaaatggttaattttgtgctatgtgaattttgcctcaattatataaattatattgcagagtattttccatcaccaagcttttgggctacgttcctgaaacatattatgcttggcatactcaattattatagaaaatagggtttgcctaactataaaaatggtgttcaaacataatttaaaaatttggccaggcgcggtggctcacgcctgtaattccagtactttgggtggctgaggcaagaggatcacaaggtcaggagatggagaccatccatcctggctaacacagtgaaacactgtctctctctttttttttaatgtgcacttttttttttttatttttttgagacagagtctctctctgttgcccaggctagagagcaatggcatgatctccgctcactgcaacctccacttcccaggttcaagcgattctcctgcctcagcctcctgagtagctgggattacaggttccctgggagcttatttaaaagctctgtgccatcagttttcccttctgtcaaatgggaaagtgaaaccccatctctactaaaaatacaaaaaattagccgggtgtggtggtgggtgcctgtagtcccagctacttgagaggctgagggaggagaatcccttgaacccaggaggcggaggttgcagtaagccgagaccataccacagctctccagtctgggagacagaacaagactccatctcaaaaaataaaaaaaataaaaaaataaaaattatcacctgtagtcccagctacttgggaggctgaggtgggaggatcacgtaagcctagacttttgagactagcctgggcaacagagtaatacccagtcttaagaaaattcaatgatgtaaatagaaagtagcagaggatatctacttccaaacaaaacaagctaccgaatttaaaacctgcttctataagtaactgtttttcaaaattccgttattaggaaataccgatgcagcatcattataaactattatctcacatatttcatgatgtataggctttgcttatttaaaattttgttaaaaattctacagcttgtgactgaacatttacacttggaggtgtctgagcctttgacagatttatcacattgcttttgggcactgagtttcaggctttacaatgatatttaaagagattagagtatactttaaaatgtacagttgcttcaagtttgacatggcatttcatattaaatagcaattagcaattaacaaaaacctactaataaagggagctaggtattgacagcagtttggggaaaagatgatggtggcatgaactaaggtagtagagtgaagtgtgagaaatagtttgatttgggtttaatattttgaaagtagagctgagctgtcagggaataaaataaatatctttcttatatattatttaattttcaatataatcataaaattcaaactgatatgaaaaatataattgagcattacatgtaatgtcaaaacaaattaatcaccaaagaaaaaattaaaatgcaagtgaagaaaaaaaattttaatagaatttggaccagagatggagataatttttgaaattctcttatttagcactgattttaagtgttggcatcacagaccccatgcttcagtgataacaatccataaatatttgagagatggcatttcctcaacctcccttaataaataactataccattaggccatcatatttataagggaagttgccatatatcttatttaaatgtgtacttatttgtggatgattgctgagtgaatatttgctaaatcatatgccactatcaagacagacactatgaaaagatactagaaaaatgcattatattagaatcatacagatatggccacttaatacatgacactgaatgatttgtattaccaatgtttgtgatttttaaaaaaccaaggctttttctttaaagacccagtttctttcttggctgtgtgactaagccaatttattaaaataataattcagtactttgtaaaaccctactgacattaagatgattattcattactactaattttttaaaagaaatacaagaaaattttggcatacttttatttcattaaaggaaagtaatggtattataatgatgcgtattgagagaatttgcattatagcataaaataatatggtatttaaagtatacaatagacatgtaaatattttttcattttgctttaagatataaaatataacccaaatagcatatattgaagtgtctgatgaggtagaacattgtttatttttttagcgtacctgtcttagtccatttgtgttgctataaaggaatacttatggctgggtaatttataaagaaaataagtttatttgtctcacagttctacaggctgtataagaagcatactgccagcatctgcttctggtgaggggctgagagtacttccactcatggccaaaggtgaaggggtgctggtgtgtgcagagatcacatggtgagaaaggaagcaagaaaggaggggtggtgccaggctccttttttacaaccatttgttgtgggaactaataaagcaagaactcattcattacctctggtaacaagccattcataagcggtctgcctccatgacccaaacaaatcccattaggccccatctccaacatgagggatcgaatttcaaaatgaggtttggagtgtcaaatatccaaactatagcagtacctggattgttcatatccttgaaagttatagagaagtggtagtgcaaagttttgaacatgaatctcagaagtttcaaagaaggtggcagttgaaatgtcagttattgttctccatttcaaatgcattgaaatgtattgctagtggttcaggctactctataaatatcaatgagaacaacagcattgaggtggtggaaacaaagtgaccataggatagaaggcaaagggcccagtgtacaggaccctgaatcaagaatgatcatcaaaagggatcacacaaccattatagggacatgttctgctttagctttcctggaagcagtttgtgtcttaaggagatgtctgtccaggttgacctaagagctttaacattaagaatcatggtcaatttagactaaaaggattttgcattgacataatttacacctttaagaacctctgtgacccagccattatctttttcattccaaatgcagagatgagaggagcactagagatataggaaagcagtgcatttagataatttatttggcaaaactagtagctcactggatttcacaatcagcaattgaaaaatctcttggcatcaagggaaaaacaggaatagaaattcttaagagacctgggcttcctgcttaccagagcaggtgaaaacttcattgttgtctttttcttttgttgacagctttgttaacattttaattcagatatcataaaatccaccaatttaaagggtacaattcaatggtttttagcataatcgcagagttgttcaatcatcactgtaatcaattttagaacattttcaacaccatatctattaacagtcactccccattctctcccactcctcattttcaggcaatcattgatcaactttttatcttatagatgtgcctattatgaaaattttatagaaatgaaataatataatacgtgctctttttgcaactgacttatttcacttagcataatattttcaaggttcatacatgttgtagcatgtttcagtacctcattaccttttattgatgagtaatattatattattacagacaggcaacattttgtttattccttcctctgtagatggatatttgacttgtttccacttttgtaccattgtaaataattcttttatgaactttctttgtgcaaactattatgtagatgcacgtcttcatttctcttgcatatgagcagaatgctggcttatgcggtaattctgtttaccatttggagaaaaggccagttctccaaagtgtagtcatagtttgaatccatgtccttgcccaaatctcctgtcaaattgtcaccaatgtaggagataggacctgctggaaggtgattggctcatgggggcagtttctcatgaatggttgagcaccaccctccttggtcctgctctcttgatagagttcaggagatctgcctgtttaaaagtgcgtggcacttcccctccctctctcttcctcctgctcaggccatgtgaagcgctgactccccgctttgccttcagtcatgacttttaagtttcctgaggcttccccagaagcagagcaggtgccagcatcatgcttcctgtatagcctgcagaaccgtgaggcaattcaacctcttttcattacaaaatactcagtctcaagcacttctttatagcagtgcaaaaacgaactcacacatgcacattttacatggccacataaatttacgcagatttcagtatctccacattcttagtcatacctggttttgcctttctttatcactacagacacaaagtatgtatgaagtcaaatctctttacagttttaaattgcatttctctaatgacaaatgaacagtgatcgtgatcatatttccatgtgcttgttggccattcacatatccttttttaaagaaatatctattcaaatattttgcccattttaattagattatttctctttattaagttgtaacagttctttatgtattcttgagacatgtttcacaccatatacattattttaaaatattttctctgattgtaggttgtttctcactttaggatggtgctccttgaaatacatttttaaaaattgacgagacccaatttatcaattttatcgttaatctttgtgcattttgtgtcatatctcaaaatgtactgactaatccaaataatgaagatttacttctgtattttcttctatgtggaatgcagttttatctcatatattgcaatttatgatccactttgagttcatttttgtgaatgatgtgagataaaaattgaaattcattctcttgcatattgtcccagcttcatttgttgaaacaaagttctttcctgattggattatcttgacccctttttgaaaatcaattgaccataaatactagagttatttctggattcttaagtctgtccaggtgcttatatatctatctttatgctaatactacacagccttgcttaaagtttttaacatttttattttctttaatgatgattgtaaattgtagctaatttttgatttctacatccctatgagataaaaatgaaaacagttaaggctttttatttttcaaatagaagtttacttatctgtggaaaacactgttcttgtctatagtttcccaggcattactaactcatgtttgtaaaattctatttaacgtgaaatttcaggtatttctgggaagactaattgaccagcacatggttctcttgttttggcattatgccccacatgttcctgagtctgatgtggcaatgtattcatttgtcaaagttttaactttataatcattggccaagtttacatttctattccttctgaaagtaaaactattcacaggtacacaggaaatatcagggaagagccaagctctttagaaaccagccacatgtgacagcagaacagctaccttgctattgcaaaagggaagcatacagtctctctgaagccctaaatgcctccttttaatgcctgctcccagttttctcaatagttatcattagcaatatctcagatgtattcagagagataagtagaatgacactgatctagacctcaaagaagtttggcatgaacacgtattttatttcattgtgctttttttcttaaatatacctatgttaatctgaaattgaaggatgtgtttgtaacacatcttgcctacaagcctccctttgaatacacagtttggtgctaagtaaccctttgtagtaatgtccttgtcattatcagtagctgacaacattaaaaggatctaattaatcccagttgtgccttccaatgaaatgtttccacctcagtagattttacctagtaaaaatgttaaaaataaacagtctcctgggtaatatttctgggctcagaattatcctcccagctaccattagcattcatagaaaacagaaagggaagtacaactacaaacagctgaaagcctctgattagaagtctgctttcttactaacagtacgttgctgtacatttttttaaagtaggaaatcatttttaacttacgtttctgaaagattaaaaactctctgaggatctccattctcaatggcatatgttattgagtctccctctcgatcagttgccttcagagagaaaacataattcaattatcaagtaattgatatggcgcccactcattacagagtaatataaaagcttgaaactaatagcacagaatgtccatgacactgttaaagaataaagattaaagcatggcctaatggcaaggtgtaaaatcaaacatttcgtatctgatccatttctgaatatgtaatcctacctgatgtggaaataatcattttcccaaggtttacttatttaattaacttaattaatgaatttaatttcaatgtctgtttataatttaaataaaagctgctggctgggcacagtggctcaagcctgtaatcctagcactttgggaggccaaggtgggcggattacctgagatcaggagttcaagactagcctggccaacatggtgaaatcctgtctctaccaaaaacacaagaagttacccgggtgcagtggtgcacacctgtaaccccagctacttgggaggctgaggcaggagaattgcttgaacccgggaggcagatgtttcaatgagctgagatcatgccactgcactccagcctgggcaacagagcaagatcttgtctcaaaaaaaaaaaaaaaaaaagtgctaaactatgtttacagtgtcgataaagtgtttaatgtatattcttttctttttctgttcagaatatatcaagacaataattcaaatcagtctaactttctggttaaaaatcctgaatttatagccacaaagcatgacttcaaaaccgggctccaattgtcctatgtgattatttctgtgtatccatttctaaaacgaggactatacaacaatacaaatgttaatagatgttgagaggtttaattgaaataatatatatcaaggcacatagactaatatctggtacattgtaagctttcaataaatattaacctttttgttggtttttcttcccttcaacacccaagtcggagaagaaaacatatagtttgactttgagttccgagtttctcttgaccaaaataaagatgctcttgttttatggcactgaggtctggagttttaccttaaaaaacatcaaatcagttctttttccagtgagtcattcgatcctcttataaaagacatggataaagaaagaaatttggatgctatcagagagttgacagaatgatctgcctaagcatgatgctacagggggggatatatctgataaaggttcagatgtattttatttttaggtgactagcctggcagaaacaccagcctctccacagacaggaactgccctggagtcagcaggattctgagagaggaataagtatgtgagtttctgtcagtgactacataataactgtcccagccataagaggctgagtgtgaaattccctgtccagacaggcaggaacgtattgttcttagtggtagatcagttggctttgacatggattacacagtcctgctcacagaacgtccttatcagctaccacaatggattgatggccagaagcctctcttggaccacaaaaactacagaatcaagggaaactgaaaataatatttcagtcagtaataaactactgaatattgactatgtgctaggttctgtaagaaaatctttgcaagattatttaatctgtctctcataaaagtgatatacttccttcgcatggctcctatgacatcatattgtcctgctttcaatcctcacattatcaatggtagttcctcattttcctttgctgatttctcctcattttataagacttattttatattggattgttccaaaggttggtccttgaacttcacttatttagtcaactcattcaacagtgtagctataaatactgtctatctgctgaagacggtcatatctctaggctagccctttcctctggatttcagatgtgtatccaattgcctacatggatccacattagatgaataataataagcctccccaatttaaaaggttaaaagccccaaatctagatctcctttccatcttgacgtacctcaaaaaataaaagaaattcaaacaataatctattgttttcactgcttcatcatctcagtaagtacctgcaactccatcctcctactttctcagggctcatagctacactttgagggctcactcttacattccaatgcaacccatcagcagatcccaccagatttacctaaaatatctgctgtatctggctgtgtctgaatttcttctctgccaccaccttcctcatggattatggtagtaactattttactaacgtgttgcttcttcccttgtatcctcacaatagtcaattttcaattcagcagacaaaagtacttgtttttccaggccaattcttttatttctttggggtaaagtctattgctttctcccccagctccccaccctccccatgccatacacactaaaataaaatggaatcaaaaaaagtaaatgaagaagaaagtaataaattagccagggtaaaatatttttgaaacatcccatgttagtcaaaatccaaaattttatatttcattgagttagtcataatggaagcctaggagtagaaaaaaaagaagcaaacaaatttctaagaatacactcaataaaatggatagtagacgcttgatatttttcccttgcattctgttctttgctagataggaaccacaaataatgatactcagctaacattttgaagaatcagagaattatatctggagactatatcttaaccccaaaaagcttacagtgaactttttctgttgtttttctctcggtcaataaatttttcttattatgttgttatagatatgatcatgttcttttggtttgtttattgatatgtggttgctgttttaatttttttcttgagaaacattttataatcttgtgtttcataaaagccagaagaaatgcattctgaaacaagatagcttcatgtaaacaattttaagaccagattaatatcgaatcttttattatatcagatctactctaatatttaatatcctttatgtaagatgagaacactgtatttatatttattatttttatgttaattcctttcaatcccagaggtagcttgaaatatttcttcagttttatttgaccactcaaatacctcagtcttttaaggattgtgaatgtcaacaatttgcctacttcattcttatgtgaggttatgcccatattggaaactttgaagacttaggatttaaaagaaaattcttatttgattcctttcttcatttttatcttttcacacaatcctttattggtgttccagggtcgagggtggtataataattaggaagtatttatagtttttcagccaagaaagcaaaaggaaatggtgtaatctgtatcaaagttctgcaatctatgcattacatgagttagcacttgtatagacaatatcatctttctttgtcaatgtccaaaggtgagaaataatccataaaaagaaaaattggaaatatcaacagaagcatttacccttcaagtattaggatttgattatgtgtgtatatgtgccctaaacatatttctatcagcaatatttaaatgttttctatatataaatctaaccagccatctcaaaataattgcttataatgtgtcagaaactatattaaaattttgcatgtcttgtctcatttaaacctaatagtaactttactggtaaatagaaaatgcatatgacttcaattatattactatttctgccatcattccaaccagatttctctgtactttaattaattgaaagatgcatcttttttatctagagatagtaataactgtatcatcttgaaaatgggagcatagtgttattcagtattttccataatataagagatataaattgcttctttttagtgaaaaaacattttatgtgcttatttttgataaatcaagtcatatccgagtcccttcttcaaagcctgagaaaagtatgacagcagttatctttctggggcttattttgagtttaacgggggagattctggagccagctacctggattcagcctcagctatactatctcttctcagacaatgcactcaagtacaaaatgagaatactactactactacttaatcactcattaattcaacaaatatttattgagcatctacgctgtgttaggcactgaggctgcagcagtaaaccacacagacaaaaatcctgcccttatacaatttacatggtagtggaggaaaatgaagttaaaaattaattagaatattttgttttcagatctttatacgcgttgctcaactacaaaatatttcacaaaggacatatatggagagcagggtgaggatttacacttatagaagtgatcatgacagacttactgaaaatgtgaaattttggcaaatgcttgtaaaaggtgaaagagtaagtcacgtggggaagaacattccaggaagagggcagagcaagtgataaaggccgtgaggtgaaaacaggcctggtgagtttcaagaacaacaacgaggttgtcaggtctggaggcaagcagcatgtggaagaggagctcctcagtgtacttcgaccactttaatacctcaggttaaacgaataaatgatgtgtattttggatagctggcaagtaatgcactttagccactggtttgctaatatatggttaataacatggttaagattaaagccaatctttcctttaatttttatttaatttaatataattttaattttgcctgaagaacaaatgattcctttaaaaatcaaagcaattactctttccagtccactcaaccagattacttgcagcatctgacttagagtccctgatttttcagaagcaccaatagggaaacaaaagtatttatccaaggaagcagtgttcttagacactggcaaatggaaaatttggaaaagaaaacaaattttctctaaactaatcttctgttcatgttaaagatgaatacagccatcaaataccgtctgatagagtgcattttatgtgcaaggaatgattctacacatttcacaggacattaagacaaagtaactgcccttagggattctaaaatagataaaaatcaatggatttggatgattttctcacttaggcaaacaagttctgatttatgttattaaaccacttgagagcaacaaataaagctttcaattcagtacagcagtgtttcaaaaaatgtatacattcattcctggtattacattttttggcctttaacaaaatgttataatatttaaataaaaattaatgaatatattttattcatgtcaagtactgttattttgtcattcataatgataatataaaatgttattttgaagtaagtgtaagtaaaaggtcagttcattaaatattccaaacaatataaaatgaataatattatatagaatatacatataacatatatgaaacttggaaatgtagctaaatctacaatgacaaaaatataaatatgctcaaaaataaaagaatgttggaaaactgcacacaggagagccataaaacagctctttttcttacaatattggtatggattaatgatcttttgcccaggaagcaaaataaaatgccttatgctaagaaggcatagcagaatcactgctggtagtgttgaaaataaatggcatttggaagtgagcataaatttatttgtcacatccagagaagtgtctgtaaattaagaagtccttaataggaaaaatacctagacttccgttagatttagggatactctatgaaggcttagtcttaaaaaaattttgttgtacaaaatgggtaaccttggaatacaaagagatttaatcaattctaaaataagcctgcaattctaattttgtctagggctcaaggaacaatcaacaaaataaacttagaactaatgtaaatattcaaaatgacgcatccaaataatggttaccattatgtattaagcacttttaatatcccatctcatttaatcctcaaaacaatcttctctggagagcactacaatccctattttacacataataaaatcttaagcttaaaaattaaataatttgccaaagtttacaaactatagaatcataattcatattctatgccttttgaaactcattttctatcactagcaaagtcccctatgtcctaaacttatctcgagtttcccttcacctgcttgcttgaaccaacaccaagttcttcttaagaaccctaatttcccagtatcccttttgattggtgagcctcagagtagccttcttgtttctcaatgtcactgccagattattcttctggaaatgcatcagctttaattcttataccataagcattatactgcattaactgctactcttcattgttaaagtcatactctacactatttatcatacttcctgttttttgctcattgtcagtctctctctttgcctgtcattgctgtcattgtcaacttaatccaatatcaaagtttcaaataatatgtaaaatgctaatgacttcaaaattgtatttcagttctggggctgagagattcaagatcatggcactagcagatcccatgcaccttttgtggtctgcagacagctgtcttctcattctacacttacatagtagaaacagagagctctggtttcttcattccccataagggcactgaatgccattcatgaggactccactctcatagcctaagtatctctaactaccaaatgtcctacttctaaataccatcacgttggggattttggcttcaatatgtgaattttgggggaacacaaacattcagtccatagcagatgtcaaaaagtcttttcaaatacagtatggccaatattgaattactctttctctaacagtcttttaattttggctaatgacaaatcaatgtttccagttactcaagctgtatcttaatacctattcttaacttctatctccccttctatatccaattcattaacaaatcatgtagtttttaaccaccaaaatataaccagattgaaatgacttctcattatttctggaaagatcactccaggcctagaatgtgctgacagagcatatcaacaactctccataatttttcccaggcttcttccacagaccattttcaatgcagcatccaggattatcctttgttaaatttggttgattatgtcactgctatactcaaatttttaactgtacctaatttcgtgcagagtaattatatctatccctctcctattactgaatgatttcatctctactactgtctgtttcttttactttactctgtaaggaggagtatttttcttcttccttaaacatatcaggtgtgtctaaacttcggggtcttacctttgcacctgaaatacttttcctcagatacaaccatggctcatcctctcaccttattcaactatttgctgtaaggtcactttctttgtgaaataatcactatcaaattgtattttcccatgcacttcctctctagctttccttctttcattttccccataacatcttctaaaattccacataactcacatatattttgttaattttcttctctattagaatggaaccttcataaaagcagaaattttgtcttttttatttactattatatcctagcatttttagttgtgacaccataagaagttaatatttacttgtcatttggtccttgcaaagttataagccttaatgattacattataatgagaaaaatgaatgaaagaattttggaaaaatgaaaaaggaaggtattaagtggacacaggtctctccctgctcctgttttcactgggaggcaggaaaatgcacacctcaggaggggagggcatgggacattctggcttctccctgatttattagactgcaaggataaactaagtccaggaaactcagtcagagctctgttctgtatatgcacattcttcctcagtatcataaagggccttcctttgtacttcctatgactgggagcctaactttaatatactgaaggaagtacagcatttcaattgtatctggtacttgaagcaactgaatttacagtaaaacaaaacaaaacaaacaaaaaaagaaaccccacatgctttttacctattgtatatactctgtgtgtctctattaattgcttccaaacttgacagagaaaataaagttgtgtgtgtgtgtgtgtgtgtgtgtgtgtgtgtgtgtgtgtgtcctattctacattttcagaatacctgtcctaggttaaacacattccaaaagactgttagggaacagtttgttctgggcacactgatataaatatttcagttatctttatttataattattaaaaaatttgctatcaccttcatgaatattggacatgaatattcattgctaacatgaatggctcaagataaaggaggttatatgaataaactatatgaaaccaggaaggcttttgtcatctggaatgatgctgaaaagatgattccataagtatgaatttagcccaattattcttagtttttattgcccaatactaactgtaacattaccctgagagctgtctctagaatagtgtttggtttgcctaaattgaacttaaagaaaaatgttgtcaggcctctgaaaggacaaatcttacttgctaataaatatactgtgcatagtagtatttggcctgagacaaacttttccaacctttctatgaaggttgtgacagagaatcctagccctcttttactactacttattcgtggctattgatacttagaatctaattattgtggaaagacaattggctttggtcagtttacagccctcaacatttaatgacaaaccaaatagaaaaaaatcagaatcaacatttctgtcattaaaaaaatttcttcatgatacagctcttgtccagatttatataaatagaagtttatttgttctttgttttagaactatgaaaaactggacacctacgaagcaatttacttaaactcttagaatttagttcaaggttttctcaaagctttcctcagagcctactcacttttctaactagttagatttctcagccttcactagataaaaaccagatatgtaaaataataaagttatccggacacaggcaaacagtgaatgaaatcagtacacagtgaatggcttgacagctgtgagagaagtagacagaaagtgcaccttaaaaacaatagacacaggctgggcgcagtggctcacgcctgtaatgccagcactttgggaggccaaggcaggcagatcacgaggtcgggagatcgagaccatcctggctaacatggtgaaaccccatctctactaaaaatacaaaaaattagctaggcatggtggtgggcgcctgtagtcccagctactcgggaggctgaggcaggagaatgtatgaacccaggaggaggagcttgcagtgagccaagatcactccactgcactccaacctcagcgacagagcgagactccatctcaaaaaaaaaaaaaaaatatatatatatatatataaaacaaaaaacaaaaaaacagataaaacaagcatagttatcaaagatcaattgtccattaagccccacacatcacagcactacttatagataaaaatatgtaatccaatttaggaactattaatcacacaatattctgaattaaatagacaaaaacaaagcattaatttgatgcccattataaacaatatatgtactgctagaaatgagaaataatataaaactattcaatatagcccctaccttgagaaaatattaatctttgtgaaataaacattgagaaatagtgttcactatatgctggttaactgtgcatttgtaaaagtaatccaggtctagtatctacaagattaagaacctagtcttaattctctcacttttagccacctagggtctagggaactagcatgtatccctagacatctattctaaatcataaaatgaaataaaaaatacttcaagcatctactttatgtagtagatatagaatcagatgaggtaatagatatttaatacacttcagaattccattcaaatagaaggtattgctcagtggtcgggcatggtggctcatgactgtaatcccagcactttgggagcccaaggcgggcagatcacgatgtcaggagtttgagaccagcctgaccaacatggtgaaacctgtcactactaaaaacacaaaaatttgccgggcgtagtggtgtgcatttgtaatcccagctactcaggaggctgaggcaggagaatcgcttgaacccgggaggcagaggttacagtcagccaagatcacatcattgcactccagcctgagtgacagagcaagactccgtctcaaaaaaaaaaaaaagtattgctcaataaattaatttaatagttaaaatcttaggctttggagtgaaaagaaataggaatgaaatgggactctttcacttataagccacatcctctttgagcaagatttaaggtatttatatctcagtgacatcattctgatactcagataaaatggcacaaggctgtcatgatgatagaatgaaagagttcatatctagaattcagcatagtgcttagcatgcatttactaaactcttactattgatgttaatatttagaaagaagaatgcacaatagaattcaggcaaaaaaaatcgatttgtaaagcagtgtttcttaaagagactacaactctgttatcaataaaactctcacttctggaatactcagcaacatatagtaagtgatatgataccatattagcagagatagtacatcaaattcccggcaaccacttaaggtggggggggatttttttttttcctattcttagatacaaaaattttcatctgcaaggttacatgtatactttaagcactgcttgctcttcatgtccactttatatactgataaacagaaagaaagatctccagttaaggtctgaaaatgtgtctaagataggtagatattggttgatatggcttgtctgtgtccccacccaaatctcgtctttaattcccacgtgttgtgggagagacctggtaggagacaattgaatcctgggggcaggtcattcccatggctattcttgtgatagcaaataagtctcatgaaatctgatggtttgaaaaatggtagtttccctgccccagttctctccacttctctgccgccatgtgagacatgcctttcaccttccaccatgattgtgaagcctccccagctacatgaactgtaagtccaattgaacctctttcttttgtaaattgcccagtctctggtatgtctttatcagcagcttgaaaatggactaatacattggtcaactatattggcagtggatggtggggaggggaacataaataaatgtttataaacctggccatcaacactttgagctaaaaaaatgacaaatgagtgaaatacacaattcacaactaatacttagcatgtattattttgagcaaattaatagatcaaacactaacataaccccttagtatattttcagttgatacatatatcaaaaagtaaaaataagcaggattggagcatacagcagagacacttctccaatgacaaagtgaggagctacactgaccatctcccagtaaaacaatcacaactgctaaaaaagaaaccttaaaaattaaagtctcagctaggcgcagtggctcatgcctgttatcccagagttttgggagactgagaccagaagattatatgtggataggagtttaaaaacagcgtgggcaacatggtgaaactcatctataccaagaaaaaaaaagataagaaaattagctgtgtgtggtgttgtgcaactgtagtctcagctacttgggaggctgaggtgggaggataacttgagccctggaggtggaggctgcagtgagccatgaccacaccactacactccagcctgggcaacagagtgagaccttgtctcaaaataatattaataatcataatagtaatataaataaagttttaaaatagtctctaaatactgttctaaagacatatggcaagtggaaaaaatatttattcaataaaacctactaaatctcactaagaattgtgaaaactgttcttagtgagttcactaagaacagcctgtctttctccctttccaaaaacctattcagcacagcataatgcaggcatagtcaagaacatgggaattcttcctcacagcttcagtctgaaactaggctatctgcccatgaaggcaggccacacaatttcttatcacccccagcaatgtgctgcagtggctgagaagtctgatgtttccggtgggccttatggacaggaatggagaaaaaggcatttgccaagtcaatggctgtatatcaggtaccaggagatgtgttaatttgctcaagcaatgaaaccacatctggtacggaagctgcaattggagtcaccacttcattaagcttacaatagtccactgtcattctccaagatccatctgttttatgctcaggccaaataggagagttgaacagggatgtggtgattaccacccctgtagctttcaagtccttcatagtggcattaatctctgcaaaccatccagggatgtgatactgtttttgatttactatttttctaggtagaagaagctctaatggcttccatttggcctttcctaccataagagccctccagtcagggagccaatgtgggggttctgccagcttctaagtatgcctatgccaattattcattccagcactggggaaatgaccacagcatgagtccaaggacccactggataaccactataagacagatccgagctgaaaccccattaattatctgacctctataagcccctactttaactagaggaccacagttttgggtccccaagaatcaacgtcagctcagagccagtgtccagcagtccccaaaatgactgataatttccctttccccagtgcacagtgaccttggtaaaaggcccgaggcctccttggagaaggatggaagaaagattaacagcataaattggtgggtagtgtaatgggattcttcctcaaggggacctggcctccccttcattcaaggagttctgggtctgtaaactggctcaactctggaaattgactgaggggtcatgattctctgtttttataattcaaattagtcttttgtccattctacatagaagttttctgcttaaattaagtaggaatgcagtaggcttcctattaatttcacttctaggaacaccctgattaattagccaatgtcagagccttacatgagtcagactactctgatgctgctttgcctctgctgtccattatggtaactacacccaccttgcctttgatggttgagcgccaccacttggcccatgccaccttgggatccaattactcctattgtatttaaattttgtagttgagtgactgtggttcacactgtttgatctgacatacagagaagagcaattatagggctcttcaaagatgcaggtgctgccctcataaatctcttttgcaaagcactggtcaagggtatatcttcaggacccacccagcagggatgagtaggtctaaagtgactagtccactccaccatcccaaactccctaagcctttagatccctttctctgcattaaaccaagagagatccggcatttccagcaagctcagagttggctctcttttaatccatattttagctaaccagacaaataaattattataacctttttttaactcctgaagctgcaacattaaatgcagaatccctacttggtgggcccagatcaataaattcagcctgattgaactctatgtttcttccaccattatcccatacccataatatccattcccatgcctgttctccagatttctgcttatataaattaaaaaaacataacaaaacaaaataaactcgagcagttcttttcaagtgtagcacacttcctcatgggtcacactctgaacttacctctaggggcccacaaggactttagtctagttatagattcagaagcaaacaggagtgttggggctggctcctgaggagaatcaacattatttttcctggcaactgccttaggggaggccatcactgttgcttcaggcagtgcaaggtttctctcctcagacaaaagtggaaaggctgatggcagcatggattagagagaggaggtttccacgactaggaatggagaagccatttcttctgacaaaaaagtttcatcagagtttacaagctcagtgtccccagccttatcagggtcctcccacacatccccattccaagttgcagggtcccattcttttccaatcaatgccctcactttaacaggggacacctggcgaggctgtgattacacctgttgttgcaggtcagccactagcatgataagagtttgtgtctgattttccacaattttagctctttctctacaggagctaagactctcactcgggaaaatcttagcagatttgaggctcagtatctgcttctgaagccaggagttagaatccctgagttcagccgggcgcggtagctcacgcctgtaatcccaacactttgggaggccaaggcaggcagattacgaggtcaggagatcgagaccatcctggttgatacagtgaaaccccgtctctactaaaaatacaaaaaattagctgggcgtggtggcgggcgcctgtagtcccagctactcaggaggctgaggcaggagaacggcatgaacccaggaggtggagcttgcagagagccaagatcgcgccactgcactccagcctggctgagagagtgagactctgcctcaacaacaacaaaaaaaaaaaaaaaaaaaaaaaagaatccctgagttcatccttttctttcatcactttgtccagtaaacttaggagcaaccaaccaacttcatagtcaaaggtattatgtatagagtcactaaactctttgcctctcacaagtggtgaatcaggagtgtcaaatgcatttattttgcataactgtctaaataattcagagcaaggactatcattgttcaccatactattagaagtaaagtacttagcattttttgatctaatcatattaaacagccaactccagaaaccccaaaaccaatgaaagaactccatccttaatattcagttcctctagaaccactcctggcaccaaaatctgtattagtcagagttctctagagggacagaactaacaagagatatagatatagatatagacatatagatggagatatatatatatatatatatatatatatatatatatatatacacacacacatacatatatatacacacacacacacacatacacaaaactaataggatatatttaggagtttattaagtagtattaactcacacaatcatgaggtttcacaataggctgtctgcaagctgaggagcaaggaattcagtctgagtcccaaagctgaagaacttagagtccaatgttcaagggcaggaagcatccagcacaggagaaagatgtaggctgtaaggctaagccagtctagtcttttcacatttttctgcctgctttattttctgattagatggtgcccacccagattaagggtgggtctgcctttcctagcccactaactcaaatgttaatcacctttggaaacaccctcacagacacacccaggatcaatactttgcatctttcaatccaattaagttgacactcagtattaaccatcacagtatcatataacacagcaattccattcttaggtttctgctcaagagaaatgaaaacttatgttcacacacaaaaatatatgtaaatattaatagcagtattattcataatagtcaaaaattagagacaatccccatgaccgtcagctgatgaatgtataaagtgtagtatatgcagacaattgcacattattgagaaataaaaaataatgaaatatcaatatatgctagaccatgggcattaaaacgttaaactaagcaaaagtaaccagatacaatagatcacacattgcatgattacatctaaacaacatgtcagaatagacaaatttaaagacacagaaagcagactggtagttgcctaggactggtgactctggagtaaatgaggagtataggctttttttatggtgtgatacaaatattctaaaattgactgtggtgatggttgaacaactacgtgaatatatactaaaaacattaaattgtgtactttaaattggtagattttagggtaaatgaattatatcttaatatagctgctaataacaagcaagaattattccacagagatgatggagttagcacagcttccttgctgtccacactcagtagcaatctatttgttttcctggagctaatgagcttcttgtggcttacagacagggaccagagagaaacacagaaagtgtcaggtcatgggatgtcttaacacacaggtatcttcctaagggaaatgttaacataggtggatcctataggagtgagtctggtctttataaagcccaaaatcaagaaacagctaaatagaatggatatggaaagcattcctcctgttactgaagccacaaaagtataacgagcataaaaaacagacttgcttcaagtggtataggattagacaattaggttcgtacaatatgaagtgtggatccacacacataagaaaatttcacacacaaaaaagagagttgacagtacaactagttaggaaaaagcaaagtccttcatatatgatgctgtttggtgtttattcagacagaagaaattgaaattgatttcaaatttcattatatacacaaaaatacatgttatatagcttgaaggcttaagtgtaaaaaataaacagttaaaacattggaagattattttgtcaaatacacatataatccaggtcaagagatcagtttattcaagaaatattgaatctggtgatatgaagatatatttgactctatgaacttggataccttgcctatcttccttccttcttccttctttctcatctatctcagctgtctatctcctagaaccagtaaccaaatgtttatacatggtattaattttcacgtattaatattttattaatagaatcaatagcattgatagaattttctattttgttatgttctgttctcttatatactacttgatttcattaacaagagataatattaacaccaaaaattgattttgtgatccaaagtatggcttgaaaatctgctgtagagactttgaatgtttgcatctctttagtgtcataaatatatgtatgcttcctgacttcttccttcctgattttcttcttgaataagtaatttcataaaccattacaacgcttagtatgataaccgtttgctcctattgcgggtatgggctgtggtctggtagagagaatcagaaccccagagggggaggaacatgcagtagtatttgtggcagcaacgtgcacagcaggaagtattagagccttagtcaaatgagaaaggcatctgagagggtgggaggcaaatgtggccatgtttggaagatgaaatgttttggggagccaaatggactggcagtgaagggccagcaagaattgttaagagtctaatgagggtgagtagggcatgcccatgaagtgggggacagcagcagtgtaatttggggtgtcctagactgagtgatatcaggctatctgggctgggtggggtgttgtggaagtgatcaatgtaaagaatcagagcctgggtggggtttcagaaagtaaacggtgtcaaaaccttggaaaagggttgccacagcagcctggcatggggtcatcaaacccaagagaggaaaaggaggtcattcaagatgtctggaatgggaggtcagaacccaaagcaggtaagcagaatgtttaggactgggtcagaatgggaatgatgatttggtgtgatttcaaagcccaaagatggttacaagggcatttgtgtagactctcatatgtgttgagttagggaataatgagggtaatcatggtgtctgcatgggaagggtgtcagtaggacagcagtctacagtgggatgtcaaagcaagagtggagagagtggagcaagatggtcccccagtaatcatcccctgaaacaaacaactttcataacaagaaaatgtcaggtgagcactcacagtacctggctgtaaatacatatcactgaaagagtcactgatgaggataggaaagaaagtcttgaattgctgatgccacccctcccccatcccctggcagaagacacatggcaagaagagaggatctgtgcacttgagagagggagagtgcagcaattgtgaggctttgcattgaactcagcactgttctgtcacagcagaaagcaaaaccagaatgaattcagctgatgccggctcacagaaggagtatataaaccaatcctatccagaggagaataacccaaaccagcagttgaaacttaagttccagccagccttcccaccacaggctaaagggctctggggttctaggtaaacttgaaatgcagtctaggccacaaagactgcaactcctatgcaagtactagtgctgagctgggcttagacccactggactaggatggcatgtgacctacggtgacaatggctggagcagctaagggagtgcttgtgcaacccctccctcaaccccaggcagcacaactcacaggtcagggggatactctttacttctgctgaggagagaagagggaattgtaaagggaacattgtcttacatcttgaataccaggtaagccacagtaggataggacactagtcagtcatgaggctcccatttcaggttctacctcatggctgacatttctagacacatcctgggcaaaaatagaaacctctgccttgaagagaagaacccagtcctggtaggacccatcaactgacgcaacaaacaaacaaacaaacaaataaacaaaaaaccttggtccctgaataaccagcagtgatacccaggtagtacactgtggtgagatttatgagacttgctggcttcagatgagactcagtccagctgtggtggctatgggagagactccttctgcttgagaaaactcttgcatgctgttcgtataaatgtaaatcagtacaactactattggcaacagtatttgaaattcctcacaaaactataaatagaagcatcatatgatccagaaatctcacttctaggtataaacacagaaggatgaaaatcaaaatatggcagagctatctgcactccgtgtttattgcagcactattcacaatggccaatatttggaagcaaaataagctcaataaatggtcctgggaaaactggatatccatacactgaagaataaaactagacacttatctcccagtatataaaagaaaatcaaaggcatcaaactctgaatctgtcatggtaaattgtgtatgcatccacaatggagcattattcagccataaaaagtgacattctgtcattttcaaaaacatgattgatctggacatcatcaaattaagggaaataagaaaattaagggaaataagccaggcacagaaagacaaactttgcatgatctcatttattcatgtgagctgaaaaataaaactattgaattcatgaagatagagagtagagggatggttcccaaaggcagggaagcgtaatgcaggtttatgggggaagtggggatagttaatgggtacaaaacatagttaaaaagaatgaataagacttagtatttgttaggacaacaaagtgactacagtaaaaagcaatttaattgtatgtgttaaataacaaaaatagtataatcagtttttttgtaacataaaggatagatgcttgaggtgatggataccccattatcctgatgtgactattatgcactgcattcctgtatcaaaatatctcaatatcaccccaaaatatatgtacccacaaaaattaaaaatgaaagaaaatttaaaaatacaagtacaagtggaatgaagaaggcaatagtttggggtatggtatttgtggcatgtagtgtgaagtgttggactttgaacttggtaataagtttgtctgcgtggttgtcggtggggtgagggctgcatctgtgctgcgccagtggcagccaggcgtgtggtgtcaaagcatgagtggagtgaggagaccatttgtatggggtcataggcaggagattggtttaacccagtgacatttacttagtacataaatacaatgaaggtaagaagcaggtttcctatcagagaatagagacaaaagtgtggaaagattaaaaaaaaaaaaaaaactagagtaaatggtatgggatcagattggaattgaagttttagtgtgaactcataggtatatatataagtaaacaaaggaaaaataagtataaacaggtctttttagcctgctatttggggcattacactgtgaatttttcatctttactcatgaagacagcttctgattccaaatcactcagcacacagtggttaaattaggacaactgtagcagcaatcaagttttgctgtgctttctaaccatttatttatcaaaatccgaatgaactacctttattttggaggagggaggtaaggaatggctcagtccacttctattgctagataattgtgtctttgtgtctgaaatttatgttttttaacctggagctttctttaaaaaaagctttgttcttatgtgtgggtgagacaagtgtatgactgggaaaatcagagacgaagatgacattttttcccttattttcttttaaaaactggttttggatttaatgaatctatggtttttaaaaaagtatttgaaaccacgagacatataattgaatttttcagttttcttaataactcttccaatgtaaatattctttacttttcaatttaaaatacattgttttcttagctccaaatcaactaattcttggtagttaagtatagaaacaccatagggactttgcaggatcagttgagtctcccattgttctcactagacaactgatacttattagcagtttattgagtatacttcactaacatggtttttgttcctttctatttatcaaaatctcagaaaaattacagcctttatatacttacactttaatcaacaatagctgacagcatgtgaagcaataaatagcttcaagacatgcaataaactctgaggtttatttacaaaacaacacagtgagaatcatttattgccaagttactaaaggtaatagtgattactgctattaaaataccagaagctattaaatagttgcccaagcaaatagtctacattcaaacccagaattcaaattagtcttttttcatttaactttagaaaaacagaatagtttaactctgttcaattagaaaggaaaaaaaaaataaccaagaaacaacaaaaattctccaattcaaacaggtttagaaattgtaagcttttctttgggtcatacaatgggcttttggcctgaagcaaatggaagttttcactttctactatagtcataaacttttgctgataggtcatttataagaaggaatgaataaaagtaggtctctaccatttccataaagatagactaacagagaacatgcagtatcagttgattatcacttaggaaactggaaagagtgtttcttggctttaaaagagacatgatagaaatctaaaagcacagcagataatagggaataaaggtctatttgaagtgtctcttccccagaactccaaaatacacctttattatgacatataattccctagtgattgcctataaaattctattaaagataaagatcttggccaggcgtggtggctcacgcctgtagtcccagcagtttgggaggccaaggcaggtagatcacttgaggtcaggagttcaagaccatcctgcccaacatagtgaaaccccatctctaccaaaaatacaaaaaaaaaaaaaaacaaaacttagcttagcgtggtggtgggcgcctgtaatcccagctactcgggaggctgaagcaggagaatcacttgaacccaggaggtggaggttgcagtgagtcgagatcatggctactgcactccactgagtgacagagtgagactctgtctcaaaataaataaataaataaataaaataaagatcttctattctacctcattcctctggcgaccatattcctctaagtcggggttcctcagtttggtaccaatgacatttttgaactggaaaattctttgttggagaggggatttcctgtgcatttagggtgttcagtagcatctctgacctctatcccttagttgtcagtatgatctagtccccagtcatgataaacaaaaatgtctgcagatattgccagttgtctccaggtggggggtgggggcaaaattgtatctgacagagatccattgcttttatcaatctcaaaatgcattatctgtcatagagtccaattaaaacaacacatagtttttgaaattgagactatctcataaaagctgagacatatgcttcctgaagtcagagttattgtaaccaaccacttgttactcatctcaaaacacattcactgatttctacagtcctcccctgctctgaggatttggttttcaggcaggtggagacataaatactatttaatttctaatgcatcatttcccatgtctctcaaaatgttcccaatagaggtcacacatttttacatataagaaaaaaattcagagtgaaaatccacacaattttaaataataatatatttaaagctaatctaaactcacaataatcttggggatatgaaacctggggtaacagttcattacagttcaagaagtctcatggatgtttgaaacttcaaaggagagcactattgctgattagttacgtagactgaagttttcagtctcttgagaaaagtttggtatttcaaatctgaaaatgatttaagcttactggggaatgaaataaactgcaaaacctttctagcactctaaatcctgatatcacagagattacatctgatattagcatattttgtggtgcctaaagcagttttaggagctgacaattgccagggaaaaagagaatttccgggaagtttggtcctaggaactggacatgtgtaggcatttctccaaattcaaattcaaatatgtataacaataacaataggcatttgtataatagtgtacatataaaacaaatttatagttgaggggatatattttattatatttgtagtacagaggcagatactatattaccgaagatgttttgtttactccagataaacaataactaattcagcacgtttaagcattcatcttgactctcctcactttccaactctacatcattctctgaggcagcaaaacatgtacactcagtggcctcactacagcagtctctccatcttagaacagtgtgaatgtgctctgggcaatatctgtagtgtgaagaaatgtggcttgagtttgttaatttgtaccgtgtcctcatatgcacactttctcaaagggagagtcccagagtccccataacagtcttttaaataaatcttgttctttatactgtgttctgcacttctctaccggtccttctcccaacacagacacacacacacacacacacgcacatcttaatttagaaagaatagcaatcattatttgtaaagacaactgttgggacagcaacaattctctggagaaaagtctaaaacatatcttcttaaaatgtattcctttactattaattatatttgtattagtttttttcacactgctattaaagaccccaaactgtgtaatttataaagaaaaaaaggcctccacatggctatggaggcctcacaatcatggtggaaggcagaggaggagaaaggcatgtcttacacagtggcaggcaagagagagagcatgtgcaggggaatttccctttataaaaccatcagatcttgtgagatttattcactatcatgagaatggcataggaaaatctcgcccacatgattccattacctgccacctggtccctcccacaacacgtggggattattacaattcaaggtgagatttgggtggggacacaaaaccaaaccatatcaatattctgtctgctttttaaatatttttttattttttgaatttctatagtgtatttattatacttcatcacttgggtttctttttattttagaaaaccctgaatccgccatttcctagatgtcatctcaaggctacataacactaagtcctcattacagagttagtaaaaaacaagatggttatcataactgtcttcattacagaggctgcttgaaaatgaagtctacacagagctaaccaataagaagacagtagaaagcaacacaccaaggcaccatttgaaacctcagttgcagcctttcttaaaatcagatccacatgatagtcaacaattttttattgattacatagtatattccaggcactgttgtagttactagggatataatagcaaataaaacaaactctcggtgattatggacctaatataatacttggcatgacaatataacacaaaataagcacaagtgcatataggattacagcaaagaggataaagttaacagaaagcacagcatgttggaatattattattttttataaggtgggtaggtaagaccacttcactccaaggaaatgtaagcaaagtctgcaggaagggaaaaactaagtcatgagaatatctgaacaaggagcctttcaggtagtggaaatagcaagtgaacggttccagaggtaggaatcactcagtgttccaggaggtcagtaaggctagagtggaatcagtgaaaggatgagaagtaggagatgaggtcaggtagctatcagtacaacatttgtttttatcttaggtaatctgagaagccatgtcaggaatttaacaaaaatgtgaagtcattttaggtaatttttttaaaaagtattattctgttgcctgcaactgaccacaaaagggcagggcggtgggctggagcagtccagtagggaagctattgcaataatctaagtaggaggtaggtgatggtggctaggattagggtgaaagcagtgggaatggtgagaaattgtagaatcatgtaaatatctttggaccaaccaaatttattgattcattggtgacaagggggcctgtggataaagagaaaggtcagggttcacttaaagggttttggcccaagaatttggaaggataaagttgccatttactgggtagggaaaatgcagaaggaccacctgttttcattaagataatggaaagtaagtgtcaagcattgagcatgggaaatactaattttgagatgctctgataaaaaacaccatgatatgcttcacacatcctccttcaaggaatgacgggattattcccttatacattagaaatgttgcacactgaaaggcttcagctatcagtcctattcagagaatgcctcatctgaggaaagcccaaggtcaagcagctttctgaggcaacctgcgtctaatgaatattgatgcagacatataaacagcctatctccttgtcacagccttacaaccctgaaggaccatatcacatccataattttccctgtaggcagctgaaagctttacttggactgcactgaagtttaacttctccatacatacaatactgctttcttcccctcccttcaataggagttgataccccaaacactccctaataaagatcctgtaattgaatcttaatttcaaagtctgcttcccagaaaacccaacctacaaaagatgtttctttagtaaccaaagggaaatactgttgttacagattgacatggatctatagttttgagacagagagctaaactagacatttgaattagaagttatgagcatataccacttaaactcattagatctgttgaaataatctttggagtgaatggaaataggaaaagaagaggttaaagttgaaagaagggtgtttcaatttttaaaagtcagggaagttaaggggaagaagtatcaaagaaaacaaaaatagagcagcctgggagtatggaaaaagtcccaggagattggggtacactgtaggtcaactaattaaatttttaaataaagaagaaactatcaattctgtcacatcatgaggatgggttgagtaagatgagaaattaagttgtcaatggaatgggcactgaaaatgcaaaaaaaaaaaaaaaaagccatttgagtggattaatgtgactgaaatcctggttacaatggagtcaacagataatcctggaaaggagaataaccacaactttcttcaggccagtataaacaatatatttgagaagtttccacagtgaagggaagcacagaaatggataaattgctagaaggtttacgggaccaagagaaattttgttgttgttgctttgtgttcaattgcaagatataatggcagtattgcatgctgatggaaatgatcaggtagagcaatggatgcttatgatgtaagaagcacatagggaaattatgaagcaacatccttcagagtagacatacatggaatcagtagaattcaatcagatcagagtcagagtaaagagcccacaattagaaggtgtgtgttttagatttgcattgggccttgccaattacatttccagtcctaagtgctagtgaggtccaataaccagtgtcattctgcaaagtgattatggatcatgatgagacattaaatactgagttgtgtttagaaaattttaaagtgatttgacagtaattttatatatgttgaatctaacagttaaaatggctttcattttacatcttttgtatttcatttttctagtaattcatttaaatgcaccctttataacagaaactttaagaagcactgatctagcatgcaagtgaaagaaatggtttatacagaaatgaggagtgcttatttttaattactgaagtacaagtatcacaggagctttggtgttgcttcgccagctggaaacttctgcggccaatggcaccttctacctgaggattgcctgtgactgctgggcttgttccacctatgcagcctgacaagctgtgctcggtttgtgctactggcccagatcccacatctgccaagtgtgagccaaaagcagagtggcaaaggggtgtgaaggtgagtgaatgtggggtccagtcactgagcacagccaggcacactggctgctacaagagggcaggcagctccaggtgccagtataggaggaaggtccatgtaagcctgtggttggaccagatgcaggcacctgcatctggatgaggggaatatggtggcttgtggaagcttggagatgccaggaactgcagaaccccaaggagggtgtcacagccctggtttggggagcccttagatctgggttccataaagggccacagctcttctctccttcctgttgtctgcattgtggtgtcggggatggggtgcctgtttccgtcctgtttgtgttacagctcttcttttagtcctgcccaaccagcaggtcctgagtttttttcctacatctaggaagaatgaggtacatagacaaatggagggtgagcaaggcagagaggagtttcactgagtggcagaacagttctcaggagacccaaagtgtgtagctcctttcctcaggcaggtagtcccaggtccagcttgtcagtggagaggagatccacagtgggtggctcccttctgcaggaaggtcatctcattgtctgtgaagccctcgtggagaggagacccagggtgggtagctcctatctgcaggcaagttgttatgtcatttgctggagtctggctgagtctgggggttttaatgggcctcataggggaggaagtacatgctgattggtccatgggcagccaggggcaggcccaaaagcagcaccctaaattctcattctgatctgccgaactgacagctgggcccccaggctattactataaagctaccaatgtcattattcatagaactagaaaatactattccaaacttaagtggcagtgaaaaagagcccaaatagtcaaagcaatcttaagccaaagaacaaagctgaagccatcacactacctgcattcaaattatactacaagtctacagtaaccaaaacaacatgctactggtagaaaaacaaacccatatactaatggaatatattggagaacacataaataaagccacacatctgcagccatctgatcattgacaaagtacacaaaaataggcaatgaggaaaaactccctattaaatcagctggctagccatacatagaagaatgaaactggattcctagttttcatcatataaaaaaaagtaacccggctgggtgtggtggctcacgcctgtaatcccagcactttgagaggccaaggagggcggatcacgaggtcaggagatggagaccgtcctggctaacacagtgaaaccccgtctctactaaaaatacaaaaaattagccaggcgtggtggcaggtgcctgtagttccagctacttgggaggctgagtcaggagaatggcatgaacccaggaggcagaactggcagtgagtcgagattgtgccactgcactctagcctgggcaacagagtgagactctgtgtcaaaaataaataaataaataaatattaaaaaaaataaattaacccaagatacattaaatacttaaactaaaaactaaaactataattcctagaagaaaacctaggaaagttttatttttatttttttttgtcaaaatgatgaattagagactttggtgcgcctcagccacttgaaaatagcaaaataaatcataaaaatgaactctgtgaactttaagaagaaaaacgggaatccaatggaattatgaagaataccccagatcctggagaggaaaacaccagcaaacagctcccacgatggtgtccagttgataaaaagaaagaaagaacaaagaaaatatcccacctgcatgaaaaagttacagaaattaaaaatcctagtgtctccagataagaaaacatcagtgcaagaattctggcatcatgaaaatctgaatgtagtgataccaccaaaggattccactagattttaagcaatggtccctaaccaaaatggaaactcagaaatgacagataaataatataaaacatggattgcaaaaaaattcaataagatccaaaacaaacttgaaaattaacacacaaaaaaattctaaagcaattcaggaattaaagaaaaagataaacgtcttaaaaagtaatcaattacagcttctggaatcaaaaaaactcttgaaaaatgttaaaatatatcaaaagctttattaatagactggatctatcagataaaagaatttaagagcttgaagataagccttctgaagtaacccagtcagacaaaaataaagaaaaaagaattttttaaaatgtacaatgtcttcaagaaataaaggattatgtaaaacaatcaaacctattaattattggcatttctgagagagaaagagaaaaagaaaacaacctggaaattacatttgagggaaaaattcaagaaaatttccctgatcttgccagaaaggtagacatccagaaacaagaaatcaagagaacatctgtgagatactatataaaatgacttcactagggcatacagccacgtgactgtccaacatcaatacttaagaaaatttttttttttagcagtaagctcaaaatagcgaatttcattgtttttttaaattattattattatactttaagttctgggatacatgtgcagaacatgcaggtttgttacataggtatacatgtgccatggtggtttgctgcactcatccacccgcgatctacattaggtatatctcctaatgttatccctcccctagctccccactccctgacaggccctggtgtgtgatgttcccctccctgtgtccatgtgttatcattgttcaactcctacttaaaggcagatagagaaaaaggaaagatcacctacaaaggtaaccccatcaggctgaagcagacttctgatcagaagacttacaagccaggggagcctggggatctattttcagcatgcttaaagaaagcaaattccaaccaagaatttcatattccatcaaattaagcatcttaagcaaatgagaagtaaaatattttcctgacaagcacgtactaagaatatttgttaccactagaaagccttcaaagaaatcctaaagtagttctaaacatgggaaccaagaaccatatctgctaccacaaaaacatacttaagtacatagcccacagaccctataaagcaacaacaaaatagaaactacaaagttaccagctaacaacttaatgatagaatcaaaatttcacatatcaatattaacctggtacataaatggcctaaatgccacccttaaaaggcacagagtggcaagttggattaaaaacaaaacaaaaccaagatccatatggctgctgtctccaagagacccaccttatatgtaatgatacatgaagtaaagtaatgatgctcaaagtaaagagatggagtaagatctactatgcaaacagaaaaggaaaagaacagggattactattctcatatcagataaaacagagattaaactaacaacactaaaaacaaaaaagaagaaagaaagaaaggaactacataatgataaagggttcaattcaaaaagaagatttaactatctagaacataaacacaccccacattgtagagtctagattcacaaaaccagtactctagacctatacaaagacttagccacacaataacagtgagggagatcaagaccccactgacagcattaaacagattgtcaaggcagaaaactaacaaagaaattctggacttaaactcaacacttgagcaactggatccaatatgcatctacagaatactccacccatgcaccacagaatatacattcttctcaactgcacagggaatatactccaagatttaccacacgctgagtcataaagcaagtctcagcaaatgaaaaaaaaaaaagaaatcacagcacccatattcttggaccccagtggaatgaaaatagaaagcaataccaataatatttctcaaaaccccatgattacatggaaattaaacagcttgctcctgagtgacttttaagtaaacaacaatatcaagccagaaacataaaaaattatttgaaataaatcaaaacagaaacacaacataaaaaatctctgggatgttgcaaaatcagtgttaagaagaacatttatagtgataaatgcctacctcaaaaagttagaaagatctcaaattaatgatctaacattatactagaggaagtagataaacaagaacaaactaatcccaaagctagaaggaaaataagacaactctaattagagttgaaccaaatgaaattgagacccaaaattccacacaaaggataaatgaaaccatagtttcatagttggttctttgacaggataaacaagatcaatagactgttagttagattaataaagagaagaaaagaaaaattcaagtaggcacaatcagaaatgacaaaagtggtgtaatgtcacagccgatcacacagaaatacaaaactccctcatagacaactatgaacatttctatgcacacatactagaaaatctagaggaaatggaaaaattcctggaaacacacaacctctcaagattgaatcgggaagaaattgaaacactgatgaaaccaatattgagttcaaaaagtgaatcagtaataagaaacctaacaaccaaaaaacagtaataataagccccagtccagatagattaacagctgagttctaccagaggtccaaagaagagctgatagtaattctattaaaactattccaaaaaatcaaggaggggtgattcctaactgattctatgaagccagcatcacctaatatctaaaccgggcaaagacacatacacacacacacacacacacacacacacacagagacagacacacacacacacacaatgaaactactggcccatgcctctgaagaacacagacacaaaaattctcaacaaaatacttacacgtcaaattcaacaacacatcaaatatttaatttacgatgatcaggtagggttaattcctgagattcaaggttgtttcatcatatttcaacatatacaaatcagtaaatgtgatccgatcacatgaacacaatttaaactaaaaccatatgatcacctcgagagacgcggaaaaagctttcaacataattcaacatcccttcatggtaaaatccctcaagaaactaggcatcagaggtacatatctcaaaataataaaagctatctacaacaaacccatagccagcatcatattgaatgatcagaactgcaagcattcctcttggaagtggatcaagacagagagatcttgtctcaccactcctattcaggacaacactggaagtgctagccagatgttaaactttttttttcatatatttgctggaggcaagaggaagaaacaaaagcatccaaatagcaaaaaaaaaagaaaaaaaaatcagactatctgccttcactggtgatatgattttatacctagaaaaccctaaagactctctcaataagttattagaactgatcaacaattttagcaaggtactaggatacaatcaatgaacaaaaatctgtaggagttctatacaccaataactaagagccaaatcaagaacacaattcaatttacaacagccacaaaagaagtaaaatacctaggcataaatctaaccaaggaggtaaaagatctctgcaggaagaactacaaaacactgctaaaaaaaaaaaaaagggaacccttgacaaaaataagcactgtggaaaggactccctattcaataaatggagcttggatagctggtgagctatatgcagaagaatgaaactggatacctaccttttactacatacaaaaattaactcaagatggcttaaatattttaatgtaagaactaaaactataagaatcctagaagaaaacctaggaaacactattctggacatcacctttggcaaaggatttatgattaagtcctcgaaagcaattgcaacaaaaatgatcattgataagttggacctaattaaactaaagagcttctgcacagcaaaagaaaccatcgacagagtgaacagataacctacagaacaggagagaatattcccaaaatacgcatccaacaaatgtcttatattcacaatctacaagtagcttaaagaattaaacaagcaaaaacaaaaaattccatcaaaaaatgagtaaaagacattaataggcacttctcaacagaaagggatacaagtagccaagaaatatatgaaaaaaatgcttaatatcactaatcatcagagaaatgcaagtcaaaaccactatgagatacctactcacaccagtcagggtggctattatttaaaagtaaaacaacaacagatgatgggaggctgcagagaaaatagaatacttatatactcttggtgggaatgtagattagttcagccacagtggaaatcagtttggagatttctcaaagaactaaaaatagaactaccatctgacccagcaatgccacccaaaagaaaataaattgactgaaaagacacaggcacttgtatgctcacagcagtactcttcatgatagcaaggacatggaatcaacctaggtgcccatcggtggtggagcatataaagaaaatgtggcacatatacactacggaatactacatagccctaaaaaaggaaattgtgtccttcttagcaacctggatacagctggaggccatcatcctaattgaattaacacagaaatagaacaacaaatattacatattctcacttataagtgagaactaaatggtgcatacatgtagacataaacttgggaacaaaagacactggggagtactagagggggctggctgagagggagcgtagcaaggctggaaaaaccaactgttgggtgctgtgctaactaccttggtgacaggattaattgtaccccaaacatcagcatcatgtgacatacccatataataaacgtgtacatgtaccctttgaatctaaataaaaacggaaaaataaagaatggcaaaattaaaagaaaaacaaacaatacattttgctaaatgaaataagtcagacacaaaaggacacatgctatatgattccacttatataaggtagctataacagtcaaattaatagagacagaaagttacatggtgggtgccaggagctgtgggctggtgtttggggagttagtgtttactgagtacggagtttcagtttgggaggatgagaaagttctggaaacagacggtgatgatgttgcacaaaaatgtgaatgtacttaatgccaaagatggttataatggtaagtatcgtgttccatatttttattacaactacaataataaaagatatgtaggaatttgccagatgaacaagatgaaaaagggcattgccatgaaataaacataatgaatctgaaaaaaataaaagcatctttgattgcaaaagagcaaattgcaaatatccaaagtaatccttgtaatacacgtgacattataaattttacgatgcagtgcctatgattcacgcacactgtacctgaaccagctgtgaaacattcatgaatcataaactcctgtatcatcttcagagcaaaaatgcatcctattttacaagaaatattcatcaaaaaagggaaagagaagtaaaaaccctgaaatttctagaacctttcaaagatatcagaaaaacaaatcaatacctctgacaggacctgttaattcagagggtcatgctgtaagacagcttgcatttaattcaaactgttttggaacaagatcaattctgtagtgagatcaaggcagcagaaatttttcctcagggctaaaaataataattccttgaggcccagacattaaattccatggcttcttgaaactattcaaaaatgagaagaatggataaagattaaaagaaaacacatgctgcaagctgacaaaacacctttttagacttacacccaattcgttcattagtcaaatgtgtggttttttttttcccttcaggtaactggaggtgtcaacattcaacttcttggtctgtttctcgtcattttctattttctcctgctatttgtctctgagctgttatacctgttattgcagtttccaacaagaaaaagccaggaaaaggaaagagaatcaaagcatcagagcgagtcacctcactgggaggtggaaccagaagttttaaagcagtagcaaaatttgtatgttctgggtgtcagtggacactttctgtataataattttattttacttttgttaagaatcatgaagcaaccacaaaaaattaaatcaaggcttatcaagtagatgtttgaaagagaaacaatgattcaccttataggtagatgtactttgctattgaagggattgtgggcaagtctaagcaaagctgaagggaataaggaaatttcattccttagagaagacagcatagaataatagtacagagagtgtagggtagaacagcttgcattctaatcccacatctgcaacaggattctctttgacataggaaaagttacttctgctttgttgggagtattaaaaatggagaagttttcaagtgcttagtgtagttcctggcttatgatagcatcaattaaaattaggtattgatgctattattattaatattgatctcttagccatctatatcttcagcatccaaagtgtcagtttgttctttaaattgcaattgacccttttttctcaatagaatagctagtaaaataataaagtggaatttcttggaatgtatccattctcctcttttacatttcatttttttattcattatttcaaatgcccagtaccttcttgttcaccctaaaatcttttatgagtttatgagttaacaggaaaacagattccttttagaaaattggaataaaaagaattaccattttttttttttttttgagaccgaatctcgctctgtggcccaggctggtgtgcagtggcatgatctcagctcactgcaagctccgcctcccaggtgcaactgattctcctgcctttgcctcccaagtatctgggattacaagcatgcaccaacacacccaggtaatttttgtatttttagtagagacagggattcaccatattggccagatgggtctgaaactcctgacctaaggtaatccaacccctcagcctctcaaacacttttttctacatttcaaactctttgcaatttacctgctatctcatttaatctcctcttccctacactgaagacaatcaacctccctcctattaaccaaccacttatcctgcctccttatgtaccttaaatacgaaagataagatagtccccattattttaataaatatttattgaatatattcttgacaagtaatcctgcttgtatttttagctagctaatgtgagatacatctttgacatggttaaatgtatgatcccttaattaatttaatataataaactaatgctacattataggggtataaacacttttaaaaatatattttctattttaaagttggctttatacttaacataaatataatggacactttgtttatttttgaatgattatcaatcattcaaaggtcagtacatctgacctttcacaaaaaaagtaaaaggtcaaatgtaaaaattgtaggttttgtggttcacatatagactctgcatattattctttaatttttgtttttggttccatatttttgtttgtttatatgtttcttacaaaccttttaaaatacaaaaaatattctatcttacttgtctctcaaaacataggccatttaacccaggaactgtatttggtcaatctgtgcttcactgtaaatgttctttgttattttaaaagcaatacggacatatttcaagtaaattattgttttcactaccactcattttcagatgtaagtccacaggttaacataaataagaaagtagcagccaaaaacaaaaaaaagagagaacagtaagaaaaacattttaagtcaaaggaaaattgccagcttttatcttctcctaaatcccaatccttcactcctaaaggaacacattaagtgcaaagggggtcatacttttattccattgcaaaaagggtcatacttttattccattccccatgtatacatttgttatccatttggcaaattgtggttgaatttctcttgggatgacctcgccagcagtaggtgaatggatcatttgattcaacactagttcgtaagtgattgttcttttcaatcaggcacacactcactgctgataactgcatattttgactatttgtagaagtgttaaaggaactaagaattttatcgtaaataagccatgttggaacaaatatcaaggccttgagaataatatactttatacctttgctcaacatataatgtaggaaaatatccaattaagagtctagaaatggagtgaggaagggccagctgagtattttgtttaatttttaattgttaactcttatagtaccttcataaagtttccaaatcttttcctttttcttgcttttgctgtaaatacaaaagtccaagcctgcattatattatactcagtttgaataaggaatatcagctccttaagaataaaatgaaacagttttattcttcccaagatcttttcaggcttttatattgatcatcttcatttctgctgtgtagctggcttcatcaatgatgtctcaatttatgtctataattgttattttgcaaaactgtctcattttaattaatatgatgccttactcattatttttaaattattttcttcattattttaaaactaattttatttctaaggactgggaacagggtgggtggatgtgataatctcacacatgttcttgtcttttttccttttattttccctctggtgctgggatagagaggatgaagaaagaaaaatgtattcgttagatgaattatctgtattgaggttgttctaggattactgtgctagaggaaggacccccaataaattccaccattaagaggctcaatatcaagcaacaatcctgtgatctagtggcactgtatggaattctaacgtatcttttagctaatgtccaggtggtagtctgtgttacatcttgatatgcatacctctcttcttcacatgcttcagtatcctttattttatttataattagaagcacaaactctgagatttacggatccaggcaggactgatctcacctacaatactgggcaagatcttcaaggggacagttgatgctttcttgccaactgcccactccaccaccacatttctctccaatgttctctcccttgttttagttgtactgactcaaatctaagcagctatttgattagagtattgaatggtgatcttccctgttttgtgtgaatttctttgggattttcttctctcaatccttgccagactttttttgtaataacactggactagcaacaatttcaacctcacctatttataaaataatgttatctagtactatttgagacctctcttacttggattttttggagtattgtactcagaatcaggaactttttgagataaaatctgagaaatgaataacttttgctcaattgtgctttattcaggttcttatctgtattctattctataatctccaagtgaggaaaatagtcaattcatatttctctaaagtgtttcttcataagagccttaaaataaattgtatatattttaaacattagtacatttaccccaatataacatcacaaaattaacctttggaaaatacagaactaatgtaatacaaaacattcccatccctccaaaaacagataaaataaaatataatagttctctacagcctaatctaaaagaatgtgatgtaatggatagagcactgatttattaatcaaagggagaaaaactaatgtggctcataaacctttccatttctgagtctcattcttttcattttcccgataataatgataataagatcgacctgtttgttagggtcaggttaatgaccaagtgaaatgatgcgttatacatatgtcaaagaaatatagcctcttaaaagaaagttaacgcagctgacattcagtaacatatctcggtttgtaagtaaaaaattagaaataaactcaaataaacgatcaatacatattatagtaaaaagtaataatttgaattaagataacttgttgaacactgatttatcaaactctattgaactaacccattttttaaatttatacttttgtttgtttgttattagaaaaacatttccctagatagaagctgctccactattctgaagggaagtagaaacgatgaaaagcagaactggagatgatccatgatggacatatagtgtgagtaagaaatatatattatttgttttaaatcactgagattttgagtttgtgtatgtgtccataatatgagctaactatccttaatgataccataagtaaagaatttaaagtaaataagatgtgcctgaccgcatattaagtgccacactaagtgttaattatagctccctggcggtaaacaggggactggttccagacttctgagtatataaaaaatccacacatactgaagtcccacagtgggtcttatggaaccctttgtatacaaaaggttggctctccaaataggcaggatttatattatatctctcaaaaaatctgcatataaatggatctgtgcatttcaaacttgggttgtgcaagggtcaactgtgttactattttatgggatgagacggcagagatgatacatggaaattttgtgtttaaaaaaggagaaatatgcaaatggtggtggggtgggccaaatggaatgtgagttacatgaaagggtaatttggaaggaaacaacgcttttgtgaagaaaagaaatacttgaatatttgagtataaaacatagttttatttagtacccttgcctcatctttagtatgataaaaatagataaaaaattcagacagacaaagagggaggaagctgcttgagtgaacatactctgttgatgtaaatactcgaggaaattagctctatattgggtggtgtgctgatgaatgcttaacaaaaaaactttgaagtgaaaggcactgatttgttgtatttgatgatttctgtggcataaatatgcccaccatagcaatgtttagctggtaacatgacatagctgcacagagtcaggaagagatgcacatgactggctctcacgatttcggcgcggtctggctccagcatttgactgtgacaagtttcactggccggtgagaacgctggaggaaaaaaatctacctataactgacccttattagcataacaggtttgagaaagcagagccctattttcctcaagtgaatgccatcaatacagccgtcaggcaaaactgcattcatgcactgaggaaaatcactgcttctcaaacaacttttggataccataaaaggcccgttcttaaaaggggaagtgggaggaggggaaacaagaattgttgcctgaaaagaaacgactttgatctccatcaaaacagattagtttgaagccaatttgctgctatcttcaaaactatatttcccctcaaattctgtcttccaaattgagcagtgcgtcagctgtaggtagtgctagagtgtgaaaaggatgaggatggaggcagccagggtacctccaatgcatcttgttattagaagacttttgaagagtaatttgacgggagcttttcaacttttaggtcactagtttaaatgtagtctcagttgatcatgaacaaaagtgggtggttagtggcctatgaaaagtaccttcatggtattacccttgttctttctaatagagactgccactacagttggcatcctttcttttccttctaccagaagcacaaagggtgaatagaaatgtcatttcaagtattttttcagcctttgtaccagagaaatttgaaatatgaaaaaggccaacttcttttcatctttaactcacaggtagaattattgaactataatatgtttcctagatcttcctggattttattaaaatgaaacctgagccactttacaagtaaaattatgtcttacttcatagaaagttaaattacataaaggcacatacttgacaaatatttaaatataaaatgtataatttcttgacctgaatcttacacatgtaaaatttattttgttttccttttctttctcttatttttttcttgcttcaataaatgagttcccatgaatgtaaagacaaagatcttattactccattaaatgaactatcttaatatttgattttttctattctttatcattacaatactttgacttttttttcctcctaaagagactgtaggttttattccctttcttttaattatttcatgaaaatcctccaaatttccatattactaatatctctaccttcatataattttgtttcaatattaaatgatcaattaaagcaaactttctctaagtacctggagaaaagcaacagaataaatattagagtagagacacaaagtagtacttggtaatgccaagaaaatttcagcagctatcagtaatcagtaggatataacagaaatagccctgttttagaagtgatgaaaactcaatcaactgattttaagcagcagttactttctatggggttagctttccacatctcaaaaataagattgatgtgttatttttgcatcattttcaatacaaacattctatgaaatcttcacttttatatcatccgaatttaagtgacagggtgttaatattcgaatgggatttaagcgagatgtagctgtgccttatgtcacgtcagctgatggtaaagattgatgctgggattttcctgggttagtcatgttaaaatctcccctaggctttaaggccagcttcatgaattctcatatcagcaacttctgcaattaccacataacaccagaagataaactctgttctctgaacattcatatagaaaatagtacgtcatcttatgattcttatgattggcatagcaaagtgaaaatatatcaacaccgtatttagcccaacttgaagctgcatattcagtcaaagatagagcttttcctggccaaagatactttggtcagaaatatataaacagtgaacaccaagctatcatcttgcaagtaacacatatgctcatgaatctctagctacaaataaaaatatcagctaaaactacccccttcttctaaaggaataaaaaccacagcaattacaagatttgcctatggccataaaatgaagtggggtttgtctcagaattagaatgcctaccatcagcctttgagtacaaagttaattcccctacacaagactgcatcaaaaataaatccagctggacaaaaggcatacaagacagaaaataatagtcagctgcagactctttggatccaaagtataaaatattcaagtatgtgtttccaatcccttcattctctcctgtaatgattgcagctaatccctgcctgccaaacgttagttcttcaattgtggcgatcaatagaatagattagctgtggaaaccctccatccatattacccttgctttcctttccagatggaattttcattcactagagtggaggcaagcatgtgaggtttctccctccatacacaaatataaactcattaaatgccaagcttgtcactttagaatttatacacacacacacacacacacaccaaggaacatacctgtagatttaataaaacagcaccaaccctcatggcttcactaatttcaaggctatacatcagctgtgggaagcgaggagggctttgattatttggtggaagcacttcaatatacacagtgcagatggagttcctgcagagaaagagaggaaaagaagatggttacgaatctgcatcacatttaatgttagactgcattgtttattcagttgttgggtttacaggagaaaaaatttccaaattttatgaaaaataatacaatcaaaatgaaaggatagaaaaaactaccaccaaagtataatggttttatgaaattatcttagtaaaagtaattgactccagtatctgtttttcctacttagattaatagtatgaattaaaatggaatagctatacaaataaagctaataaattaacttgccttgacttctgactttgtttttaatgcttctctaatagcaaaatcattctataaacatctggtaataaaagctgtccttggggcttttttgctgttaaaccagcagagggagtattgattacaataactcacaaaacaaattatgggctgcgttttatcagttctgttgctgacatcaatggcttaatgtaagtgcatgtgaggagtcaggatcataaagaatcctacgtaaaatagttgcaaacaaaactaaatacgttttaaaatcttctctaaaaagcaatatatgataagctaggaattagatttaataaagcccttataatgacaggagcttttcttgaaggacaagataccttatcattacaaggaaaaaaaattagcattgacatagtcaacttctttgatatctctgaactttgaatttgttttataaaacaaaaactgaagaagcatgttagtcaaggtttgtaaggtggaaacattagctgaaatatatcaatgagatctgaaaatacataaggttagccctctatcgtgaaaaaacatatatatgtatacatacacacacacacacacacatatatacacatatatacacacacatatacacacacacatacatataacattttgtacaaacataccaccactgcctaagatgtatgctttgaatttaacaaagtcatgatttagttcaaaacacatttgttataatttctatttggggatgagaatctttatttatttatttatttatttatttgagacggagagttgctctccagcccaggctggagtgcagtggcatgatctttgctcattgcaacccccacctcccgggttcaagtgattctcctgcctcagcctcccaagtagctgggattacaggcctgtgtcaaaatatctggctaatttttgtattttcagtggagatgggttgtgccatgttggccaggctggtctcgaactcctgacctcaggtgatccaccctcctcaacctcccaaagtgctgggataacaggtatgagcaccacacctggcctagaatctccttaaagtagtcccaaactctttataagatgcttcaattaaaagacatggtcaccaaaaatatttgtctgagtttattaactacaacattctacttttcaaaaccttttgaaagaaattcaggctgggcacggtggctcacacctgtaatcccagcactttgggaggccgaggcaggtggatcatgcggtcaggagatcgagaccatcctggctaacatggtgaaagccggtctctactaaaaatacaaaaaattagcttggcgtggttgcgggcgcctggggtcccagctacttgggaggctgaggcaggagaatggtgtgaacccaggaggccgagcttgcagtgagccaagattgcgccactgcactccagcctgggcaacagagcaagactccgtctcaaaaaaagaaaaaaaaaaaaaagaaattcagatcataggcactaaaatttcgttttatagcttgtcactttataatatacctaaattcaagttgtttctgagcatatcatcagtagatagataccaatagaatagtaagcataaaagctacagtgacttttaaaaatttcatggttgggtgcggtggctcatgcctgtaatcttagcacttttggaggccaaggtgagcgatcacaaggtcaggagttcaagaccagcatgaccaacatggagaaaccccatctcgactaaaaaacacaaaaattagccaggcatggtggcctgtaatcccagctactcaggagtctgaggcagaagggagaattgcttgaacccgggagacggaggttgtagtgacccgagatcgtgccattgcactccagcctgggtgacagggcgagactctgtctcaaaaaaaaaaaaaaatttcatgcttacatttatcatgatattgttctaaagtaatctcactttaaattaaaatattttaaactttcatagttaaaatatctgtattcatttctgcctctgattttatctatttagtatcaaaatttgccaatacagttaatcagattatatttcttaaatgggttcaaactgatgatgaaatgttgcttatatacttataattattaatgtaaacatgaaacaatgggaagttacaaaatgtattgtatactgcaaagattcccacttccgtgttgtgagaacaaaagaatcgtcattctgaggtagacctaacatccttccaggtggtgatctgactccagaagcagccccaagatgtaaaacattttccctgatattacccttgaagatcttggcttcttttagggtctgttgttgatcaagtttttaaaacattttatgaatctccttcttttctctgatagcacattctctatgcataacaagtcctacaacgttattggtaataaaagtaggtgagtgatgttgaacacagaatttgtaaccagatattcctgagttagaattttgacgctgccctcaatgatctagagcaaattatttctttcagcttcattatttccacataataagtgggaataataataacatctaaggtcagcataaagatgaaataagtttatatatttgtatatgtaagtacatgtatacatatatatgaaacatacttttataacttattttaataaattactcaaaataaggcttaaggtttcttattccactctatgaatagtgcaaacgatcttgcattttccttagctacatcctttataatactgtagatattttaattgaatcctttcacttggctaaattcctacaaaggcttgatactccttcacccctcctgagcatggggtatgttggtgttagaatttgagcatgttgtatcataatctttagggtaggatacaagaatctacaattttcacaaatttccaaagttctacttatagaaactagactttgaagaccactgcttcagaatctcatgaaaagtacaatatgtagactcacctgttttttttaaattacctcaggagaaaaactctacaaagtcacttaacgtcttcaataaccctggatccaagagacttcctcactgtttaacatttttttttttttgacctggaacatatctgtactgcagattcgaagctttctttcaaaagctaggccctttctgcttcgatattctttagatcttcagtttactggtcaagaatactttataaaggttttacaagaatatcagtgtcttaaagcttgtgaaagtatagttaaactacacttattatactttttgtatttctttattcctttccctttcattatcttcccattgtagagggttaaagtgagacaatgctacaataaggaccttaaactcgtatgagttacttggatacttgtcacagagtcgaaaactttaaaatgctgaaacaaagaggactctagtctcagacaaaacacagagacaaattttagcccaacatgaccgtctccttgatccgtccttactcctttgcttcctctgttcctttccacaataattcaaaagctagaattgctaattgtgttcccccacccccttggtcttgaatgttagttatttggaggagatcatatattaaggtcttgtatttttcatcttcaacatcctggcatgtccctataatgtgtttaaataaccaccaggcttcttgagggttactgccttttaaaatgctatctcctttttatccctgatgtcagcacagtgtcagagttagcttttctaaaattaaatacccatagtattaacaataaaataatagtatttatgctgtaataaatagtagtatttcaacagcatcatttaagcacttaataaaatagggcagtcactatataaataacactttacgcaagcattttgtattcatattttatcgctaaatgcataaaactgagcatctatataagaaaaattttatttttgtaatatagccagtatgatgcagataaatctccatttctaaaaacgaatctcataaagctttattatatttcacctggtaataaaggtcaaagtagcacaaaagaggtaatatatttcttatatactcttgaaacctacccaatagttccataaatataaatacatatatacttttttttgataaacatagaaattgacccttctggtcttaaagcttgaaacttaacatttgttttatctgagctccttcctcaggaaacaaccttcaggcctcccaaaaaaggtatcaaagaactgaaactcaccagatcaccacatccgatgagatgccagacccgtcattcattatgattgcttcctagcccctccctagttcctgttttcttacatattgttacatttcttccctgctatgtaaacactaactgtagtcagtcagtgagttggatttgagattgtcaccaatttccttagctgcagcaccagattaaaatcttcttctttgacaattgttgttcagtgattggctttttgtatgaccagctgcagaatctaaactgaacccctggtgttcctgtgacagattttcgttacctgaccaagaacacattgcttgtgtcttggctgccttgagccaagagtcttagaaggcctcctaagcagttgctcacccaattttcactggaggtgttttggtttttttctggccccacagcagctacccccaactacattcctgattgtctagtcagaacagcatttgaaatttgacatctgcacccggataggtgagtgtcaggttctttgtgggcctggacagcatgatcccctcctctcagtttgagaattttttaaagaaatttttatttgtcagttgaacaagcccaaatgactgaaagtgggaagcatcctgtgttagtatggacactttttgggggtttcagtatgaacactcttgggggcttgtttgtaattgtgaggtgtgtgtgtgtgtgagcaagtgtgtatcttttgtgggactagacagtgggattggctcctctcaatttgagaaattcctaaggaatttttctttgtgggttggtcaagcccaaccagtagaaagaagaagcaccccgactgtttcagtttggatgctcttagggctcgtttattgtttcagcagtaggattgtgttggcgattgtgtgtgtttgatatagtcatagcaaagtagaattcagtaagctaatattttctgaaacactgtttggctccaatattctttggaatctggagtttgctattgaatgggaaagcatgacagagttccatgtatccagacttttgtgctactgctctaaccatggtcaggcctggtcagtatgtgatgttctcttgtgatgctgtttggttccagtgttctttggagtctggggaggtttagcctttaaaaagcaaattgccatgaaaactattctacccaaaattttgattcacagccttcaatggattacctactgaggtcaagaaagtgtggctatgtaaaccagtgagtttctattgctatatcatggctataattttgaggtaaaatagattggatctttatgtgtgtttatatgcgtcttaatggtttatgtatgttcatgtattacgtttttttttgtctaccaaattggtttataaataaaagaatacacataagtaagcccaaagtatttttcaagttcaaatgagttaagtcaaccacaataagcaagctggctttaacatttttgataaaataaaaataaaaatgcctttagaattgtcagcatacatttttgctgagttttatatatgtctctgctagatatgattgaggtgtcatggtttggcatagaaggttatagaactataaacccagctaacataaaatgatcttggtttgtgtaccttctttgacaaatgagactaatgtaatgttgttagttgattcttgtgagttaatggcaaaaatacccatatctttaattttaagatttagttgaggacctgacattcatcagctattaaaaaaaaaagtaatgaacaaggaaaaagctaactttaaatgatggtgtctaatatttcagttttcagaagaaatctggataaactattaaaatgaaataatcaagtacttgtaaattgaataaatgttgtaggtacactttttgtgtaatataaaatttttaaattgtttttggtgctcattgggtgtctgggtcatttccaattaagaaaaagttatggggaaacatatttctaaaaattgtggaatggttctcatctgtaaaatgctaatatctgatagtcagctcagaatttcttgcttctcagatgttcactaaagttttgttcactaaaatttaaggctactaagaattctaaagaagatgtgtttttattgagaaaacgaatctgtttgtctagttcagaagttatctaaaggctaattaaaattatgggcttgaaatggttagttatgaaacaaggcagaagaaaaccaataagtagaagaaagagatgtgtaaaaagttatagatacgaaaatatattttaggaaggtgataatgaaaaaaataacaatttttataagaaaagattttgtatggtgaatgtttgtccaaaattaaaataactggttattaaaaaaagaacagaaagaaaatctaagacaaaacaaaagtccaagcatgtcatggatggtctgtgtaagtcatatgccatttttcctgtttctctgtgtgtctatcttcatgcctgtacaaagaaaatacaaagttgaaaaagcttagataataaaatatcctttaaaacttgataaaataggaatgctttggctaattagcattgttcatagttaaagctcatatcttaatgaatgtaaaatataaattattgtaaagaaatacattagcagtttggcaattttttaaatatagttaagcccaaagctggatgtaacatggagccaaatttcatagtatatttgctattctgcatcacatacctaaagtgaatttcttagttacagaaaatgtatagtggtactgctggacttaaagacagtaaatatcaaaaaactgaatcaggaataaaatatccatcaggttaattttttttggctctgggtaacactgtaaagccaaagttaattgagtagaagataaattgagggttggactactgtttatttctgcttttttttttttcttgagacagggtcttgctctgttgccaggatggagtgcagtggagtgatctcagctcactgcaacccctgcctcccgggttcaagtgattccccttcctcagcctcagtcctcagctgggactacaggtgctgccacctcacctggctaattttttgtattttagtagagatggggcttcaccatgttggtcatgatggtctcaatctcctgacctcgtgatccactctccgttgtcaccaggctggagtacagtggcacaatcttggctcactgcaacctccacctcccaggttcaagcaattcccctgcctcagcctcagtcctcagctgggactacaggcatgtgccacaacacctggctaattttttgtattttagtagagattgagtttcaccatgttggccatgatagtctcaatctcctgaactcgtgatcccctctcctctgcctccccaactgttgggattacaggcatgagccaccatgcctgacctatttttgcttctaattttcatttatttgctatttgttctacttaaatatacaaatatatacacatacacatatttatatgtatacatatacacataggtatacatatatgtatatatatttgtatacatatatataatatataaaactattgatgctttttagtttctaatggaaagcttttatttggttctatgaatagtcattttgttttctatgtatttccaacaattcaccatttgttctgtttattgaaagttcctaaactacctttgtcaagcttcaaaacattgatgaaggacagcagccatttaaatttgattggtttttcttacctctgagtatattgatagctatgataattttaaggttcttggcaaaaatcttataaaagacttatttttatgagttctaaacacaaatagtacattatatattttgtaatttggaaaagtagatgagaatagaagtgtttaaatgatgtttatttccaatgtaattcaattcaatcaataatttcagttggttcagatcctttcctttagtgaagaaaaactgtgatatgggttaaaagttttaatgttcaggaaagactgggctgtttttttaagaaaaattttattgattgggatttctctgaaactactttcattgtgtttaccactattaacattaagtgacactcaattgaattaggtagtaattgctttaaaaattgtgacactttgttgtaatttttgatccaaatccatttatctctgatgggcattcatgtggtacttgaaaacaaaatatgcacaagtgttgcactggtttgaagagtttggtgtgaaagttacttaatcagttgtaagtactgtatctagaagtaaatcttagaaatgtgtgatgatgctcttttaagtagctgaagagagattattatgtggttttcactttgtccttgctttgttgtatagtatttaagtgaaatgagattgcttatccttattctgaatttccaaagctgatatttgcatttgccatttttcaataatggaaaaaaaaacaacattagttgtcttgctttcaaaagtttgtcaaaggacctatcaaaactttgatgcttttggtcacagttctgtcactaaaatgctagcaattagacatatggaatgagtaacctaactactttaacaccgtggtcagaagtgctataagtagtatctgctaagctccaagccactgtgttttaatttgtgacattttagaataataggctttctgtagtataaatatcctattaactaatccttgtgctgttaagttacaggtctttgaatcctcagtctgaagaaagcactgacttctgttaaattttgagcattgataccagtcaaagcctcatcttcagacacaggagaaggtgacaatcaaaatgaactgctttcatgagacacagggccagaaattaaaactattcaatccctctagacccaggaactattgtggaaactgtaggtgtgtgagatggtgagggacaattttgagggacaaactcagttcagagtttctgtaaattaaacgttaatgtcaaaagcacaatgatgcaaggtcagtgtctgggcctatgtgtcagaataacagggttttcttggtgcattgatctgctctttaatagataatcgtaaaaggctataagaactttgtcaaactgattaaaattagatagatttgtttataaggttttattaaaattagatttaacattaataatataccatacaaagatacaattttgttttctcttttgaacaaaaatttcatgtaagaggaaactgcagggaaaaaaaggagaggggagagacagaataagttggcctcatgctatcttaagtattaggtcttattgcttaagaaacagagtctcctctctatcaaaaggtaaatgtttttgttttattattttggctaaataaatgaatattttatagtgacctgtgatcctattttgtgatatcgagtgtcttaaacctttgatactcgacagaatttccaacagcaaaatttcaagttctaaattcagtctttgtgaactcaaaccaacctttttggatattagttgccctgaagttcaagagagacatgtaaggcttattaggcttagttgttatgttagaattatgcaggagatattgtcaaatctgaggtggtgctaagtttcctttgggtgatatttatatggatgggttgttaaaatgtgtttgaggattatatgagattcctgtaattctgatatgtcttaatataagttgtcagtaataattatgattattatgttacattgttgtatgccacagaaataaccaaatttctttatctactgtgcctttaactatgactctcttaagacttttgtcatctacaattattgttttgctttgatccttctcaaaaagtgacttataatcagctacagtctagggattgcttctttggtgttcgtgaaaagaacttttcaatgcaggttactgataactttggagattgtgccattaggttagagaggaaaattccagggcactaattgaaaggctgatgtgttcataaagattgttaacccaacatgaagcagagcaataattgattgcatggactaaactaatgaaggactgaaataatttttgtggcttttatctttggaatattgctgatttttttgttttgtttttcagagtctggataattttttagatctacttataagctttaagttatgctttaagtatattaagtagagtatacttttgtaaacagaacttgaggcatattttttctctgcctattttctccggaattatattcttaattcatgtgtgttagtttgcatacatttaatgacaacttgttttcttgtataatgggacacaattggaggaagtggttattttcttagggctttgaactgaaatgggcttgggaaaggttccagaaaagccagtgtaggtcctatataaacaatgaaccttgttgcactttgggtggttaatcaggctaagtatatgggcctgaagcttcttttgcaagtagatttgtcctgctatgacttgcctttgttggaagttggggggctgaagagaaaatgctgtgtttcagaagaaaatgatactattagattagcctttgatttctgggtggccgtgaaatcacctgtagtatgacgctgcccacgatgcccctcctcagtattaagcagccagaaagactgacaaccagtttccccatgattgaaaattgataaatagaaaggggggactgaaaccgaccaaacagtcccatagatcactttttcgataaacatagaaattgacccttctggtcttaaagcttgaaacttttgtgaattgttttctgttttatgtgagttccttcctcagaaaaccacttgcagcctctcaaaaaagtattaaagaaatgaaacgcaccagatcaccatattcagataatgagatgctagacccctcattcatcatgattgctttcttgcccctccctagttcttgtttttttacacattgttacatttttttccctgctatatattcccataattttagttggtcgggaggatggacttgagactgatctcccatcgcctcagcggcagcacccaattaaagccttcttccttgcctataattgctgtgtcagtgattggctttctgcatggttagcagcaggacctagaccgaaaccttggtgttttcgtaataatcttataattgaaaaagatccttaaaacaatgtaatttaagtctcattttacaaaagaggattttaaaaatggaaaagatttgctgactgaatcaagattataacattaattagcaacagcagataaactaaaatacaaggcttctgaattcaaaatctgctttccatttctccctacgtcctacaagaacaaatatgtaaaataaactggagaatttttacttatctatgtgtgaatataaaacatttttggtttgtaataaaggatgttaccttacaggaagccataaattatttcaagtctgaggttcagactatgaagtcacaattttaaattattaatactgtgaatcaaacttcatctataacacttattgtaagaataacataaaatatgaataaagaagagggttggaaaatagacttaagatactttaagtttgggaatgatataattataaaaagacaactttttcatatgacaatagtaattagtagtaatgagataatgttgctagcttatagaggattgtattatcttattattattttctattatatatgtcaatatgtgctacaaggagtctatttgtaattctgcatttctagcttatttctaagatgaaggttacagatatttatattgctttttctggtagatttcagacagattaattactgtttttgttttcctttgtcttctaccaatattgtgctagaaaagctatgtttacagtttgatgttcacagattgtattctattatttttgaaatacatatagaaatctacaagagcaaaaacttcacattgaaaaccaatataggaggacagagaaaacttttctggagaagttacagggcagagttttaagatagaagatgtatttatatataaataccacagaacattaatagacagaggaaaactcacatgtcaatttacagaagattaaagaaaagaaatgtatgttttgtggaactaaagagaagggtgtaagtaaagcagtagtaagagttaaggtacagaggtgggactcatgggctatatctgttgatataaacttcatcttgacaatgaggctcagctggtaaagtttaagcagattagtgattataaccaaaagtgccaagtcattcacagttctttaacacactactttgttttgtttcttttgatcttcttgtttcctctgctgggatattccattatcattcttgcccaggtaaaactgcacttgtatttatctactgctatctgtctagatttacctgtgcctgcatctgaatcccatgtgggcagagatctcattttacttgttttatatttctagtacctccccaagagactaatatttgtgggaacttagacaatttttataaaaataaatgaataaataaatagcctcatcattttttactaatgataaacttagcatgtacatttgtcactagtaaaatgatcttttaaagagaaaattgtattttaaaaagaatgtataatcacaatgggaaaataattgtatttcaaagtaaattatttcatctcatattaattaaacatagccttgcattttatgaaaagaatgggaatttaaaacgtatgttagcccatgcatcagtcatttttatcgtaattttattagaagctatttggggagagagagtgtctcttattatctaattatcaaacagtagtgctttattcatgttaggatgaagtaaatatttacttaatttaattggataacgtaagtataagttaaccaatatacacgactaaagaatatcccaaaataacttaagtgttttttaaaagcttttggtttttatttcttctgtatgcttatcaaagtctcaaaaaaaagtaaaacaaaacactaaactatgtactattccttctctcactctctgaatctttagctggtttactaaattagaataacacagacatacgtatttcattcatattggacttattttcagtcaatattactacatttatggatgaaagctgtcaattttaaaataataatatagaaaactgtctaaattctgaagcctgctgtcattttttgatgttattatttagttagcttacatgccatggttgctggctgggtcgatctgtaaaaaaaatcactatatatatagtgtgtgtatacatatatatatagtgtatatatatagtgtatatatatataatgtatatatatagtgtatatatatataatgtatatatatagtgtatatatatataatgtatatatatagtgtatatataatgtgtatatatacaaatatataatatatatatttgttcataatctttaaatataatcttccttataaaagaagtctgaaagcaaagcctcataacttttcagttcattcatcaattcaatttgaaggattaactcctctccagaaaatagcaaatatgattatcctacagtgaacatgacattatctcagcaggtagaatggaagtatatggattttattctctgcaggtcccacttgatatttcaccaaacattctaaggtgagtttttagtatccaagacattatttaatgaaaataaatgtgaagctaggtcaactaaatttctgatgtcacagaaaagacgtgtatactcagaatctgaagatggcactttgttttctggcgtggaatacaattttacttaagtaaaaaacatttattgtattgataattatagacaatatattatccaggaaaatcaatgatatgtcttacaaatagaaactgagcaaaaagaggaatataagatctcattcattaaataatcaataaagtgatttaaaacacttcaaatgtaatatattggccacatatagatcagaccagatttatttagcacaacacaatcttcaatgaaaaatatgtatatataataccaacttgtggttggttttattttaatattcaagactaataaattaaaagtcttgaatattaaaagactttaataaaatcaaaataaaaaaacaaaaggtgactttgttcttataaatagcattattatcattgctactaaacaattatagttttcctccacaacagtaactacaaagattatagatatgaaacagtggaggaaaaagctttaaatctaacaactctgagttcaagttatggtcctactacttgtttactaggggagtggaagtgggaaaggggactgctgagccaagtcaattatcctatttcagcctcagatttctggtgtgcaaaactaaattatgcaaaagtcatgatgctattgttaatattagaaattatatatataaaggagctagcaaggtatctggtcctagtgtatgctcaataagtattatcaatcatctttaattcctcttcagaataacctagcacagatgaagctattatttaaaacgcactcaaaccttacttggctcttattgtagattctgtaactactcaatgtataaaagtattctatatatttcttctaagaaggagcccttagctgtttatcaggttcaggcatacagagtcctccctcagcatccatgtgggattggttccagagcccataaggatactaaaatctgcagataatcaaggccctgatagaaaatgagacagtatttgtatataatctatgcatattgtctcatacactttaaatcatctcgagattacttgtaatacatataaaatattaatgctaatagttgttatactgtagtttagagaataatgacaaaaaaagtctgcgcatgttcagtacagatgtaatgttctccccaaatattttcaattgttgcacttagttgaatctactgatgtggaagccgtggatatggagggccaagtgtatatttgctttttggatatattaagtttggccacatccaactaaatgtgtccaaaattaaattgatgtcctcacccaagccatgtgcacccctattgacatcaacatgacgtcaccttaagcaaaaccctgggaaatattttatcttatttttgacaaatctatttctctattcttcctaacatacccagttcaaaacattagcagtatttcctgtagactcttgtgcctctgctcccctaaaatctgcctcccacagagacaatcagatggattttacaaaaacatgttttctcacttgactttctaatttaaaagtctttccaagaattcctcctattgactagataagtctaagtttcttataaaagaaaattaaattttctgtggcatggccttttaattttccagccccaccttgaatcagtttatgccccagtaacactgactaataattatctataaacaagaagctatttcagacctttgaggctgtgcaaatagggtcacatacttctttttcatttggtcaacctcatcctcttattgtgggatgacttcttggtactccttcattatcgtaagttccccatcaataaccccagaaagcccagaatttaccttaatctcaaaattgctatgctaaactcaatttaatttatattctttatatactttactgtattttgggggctttcaaatgatggtactgtagttatctttgttttccagaatgtagtaaatggtagtatgtaataaatggtttgttgggctgaaaggaaacttttcctatcacagacacctgaaggaaatgaggccattgagaaatctgagaaaagatccatccaggctgagagaagatgaaaatcaagctcaaaagcatataggtagctatgatcctcagagatagagaggagactggtgccacaactggaatggactaagaaaagcagagttgagtaggagatgaaatgtataaactgttgacatgagggagtgtcctacctgtagtgatagctgacaaatttcactgagcccttttgaatttattttaatgatttgccttttactcagagtgaggtgtgaaagcactggaaagcttgagtaatggattgagatgttttccatgttaccaggatcacccaggctattgtgttgagaagagattgaagagagcacaggaagacttgtaattggaagaagttttcaacactctagactagagattgcagtggcttggactggaatgctaataaccaaagtggcagcagttgttgctttctgaatacatttttagagtagaacacagaggagttgctccaggttatgtgtggagttggggaggaagaggggcattgaggatgactctaagggtgtttggtcagagtgactgcaagatgggagacgccttaaacctcttattggatataaagtcaccaataagtttgacaggagtactgttgaaatgaatgtcaggcatgtaggaagtaaactcttccaagtgtgacttccagtatgtagatgacaataggatatgaggttagaaagaagaaaatttattgggaagagacctatcatctgtcgatgacagcaaggaggggtaatgggcgttataattattttttgacacgagattcaaaggaaaacaaactattgaggaggaggaaatctagtttaaaaatgtaaatgagaatctaatactccaccaaccgtatctctgtgattaatgatgatcacacaccctgcaaagtttagttacagtccatcaagtttcctacacctggtgtagtattgagttatctgacaagtttgatctcgtaagattcttgagacttccttttttttttgaactaatattagtaaactgtatcttttagaagaatcatccatttctgttttcaaattttgcatacatttaagcaaagttgtctctgaatcctactttttttctatttatatgtagtttcttcattagattttattgtatacagttttacttgttctttttttcttgattaggttagatagtattttatccaattaattatgtctttatttttgttgtttctttccagagaaccaaattcagtctcatttatttgttttatatatgtttataatacattcatgtctgatattatagttattaattattttgggggatttcttgtgtttttatttgtttcttttatgaagtattatgacaactatacataatcttgataggatttctcaaaaagaaaagtacagactaattttattaaataaaataacagcaagcatataatatcagcttatttcaagagaaaaaaattatgtcctaatagaatctacaccatggatgcaaaatagatccatctaagccatggatgcaaaataggagctatagtaagatcagtcattatatcatcaactcaagaagaaaagtcattactgtcctcatatatggtagctatttatttgatctgagaaaagcaccattactattttaaaaagtcaataaaatagaaatagatgagtatttttttaacatattaatagtttttaaaaccatagaccaatctaatggggaaacactgaggcagtctcattcaagtcacaaacgagacaagcatttttattggaagtataataggaaatgaaagtaaagaaagaaaatggaggccaggcgtcgtggctgatgccagtaatcccagcactttgggaggctgaagtgggaggatcagtagaggccaagagcttgagacgagcctgggcaacatagcaaaattctgattctacaaatttgtttttaattagctaggattggtggcctgaacctgtagtccccactactagtgaggctgaggtgggcagattgcatgagcccagagtttgaggcttccattagccgggattgtgccgctacactctagactgggagacagagttagacctgggctagggggaaaaaatgtaaaagaaaaaaagcctatttacaataaaaacaaaagatgtagaaatagatcaagtaagaaatgtacagaacttacataaaaagaaaaacaaaaagcctgctaaaaaacacaaaaaaatgcatggacaaatgcaaatgcaaaatgttcttggatagaaagattcaacatcaaacatatataatatattcctaagtaattaatatataaatctcttgtgttcctaataaaaacacagttaacaacaaaaacactgaactagcttatttaaagtcaaagagaaaacttaacagaaggagagggaacattttggagggaaaacagcattgaggtaagttagtagcaccagaggatagagcatactatgtaagcttaatcattaaaattgtgtggtaataggttataaaatataaataatagaattgaatagaacatttagatcaaaatcaaaacacataagaaaatatatgatataataaatgcaacatctcaaatttgttcatcattggatgaatatcacaatgtattgtgtggggaccacagagtatttgactggaaagaactatggctgcattaatacctcctactgtgtactaagatacatctcaaatacaataaagatttaaatatacaatatgaatccacataaacactagtagaaaacgtagaataactgtaatctgggcttaacataccaatataaaaaactgatatacttgcacatattcaaactgatgcatgttgagtgttaaatatttctccattgtcaataaaagaggataaatcgaaaagtttatcaataatagacttcttctacagttttatacttattaaggaatatgtttatcaataatagacttcttccatagttttatacttattaaggaatattacataactgtgaaaaaaataatctgaaggatttatctagtatctacatggagaggactccaggatacattcattgtgaatggaaaaaaaccccagcaaagtgaaggaatatattaatatttattcatattttcttggaatgatactgaaaatctggaaataaacaataaattaacaaaagggatttctcaggtgggagactagaaagatgcaattgtaatagcaggaaatcttttagcttgctgtgtgtgtgtgtgtgtgtgtctgtgtgcgagtctgtgtgtgtatacacatatttaaatacatgtattattttacataactattttaattacctatacactcagaagtgactttgaaaccctgagacattacatgccactgacacatctgttaatttctttgaagaaaagagcctttctctgtctgcagccttacttttccataataaatttgaaatatgcctctgatattgtcctcttcccaaaatttaaccaaatcagaatatgcatgcagttcctgagaatctggtctctctgattttctgatctaatttagatgtttataggataaaagaatacttgccgcgcttcttaaatttaattacagggttaaacgggcccgatgaaaagactgcattggttctaatataaattaccttcgctctgcaggaggagcattatccgctgcttggaccgtgagtgcgtaagtccgcccgactatcatttccacccctggagcgatggtgataagccctgttgttttattgatgatgaagtctccctgagccccaacaaggatttcatatgtgatctccccatttgacccttcgtctgcgtcgactgcagtgagctggaattgaaaatcacaacataaatcctcttgggtctcaacttttcaccaccatgtcgttttttcccccaacaaaagaagcttgctttcaaagaaaaaaacacaggaaagtttccttgacatatatactgttttttgttttttgtttttttaactgaggctactgtgtcctgttacaatactaaagcaatcacaaaaataagagtgattttgttttttgtgagagtgattaagaaataaactttggatcttgaaggcttatctttattttaatttaataaagggaaaaagaggaaagccctaacagaaaatctaatatccctataggaaatttatttttcctgtcttgccttgcattcttgacacataaactcatattaaaacagactgaacctggaaaaaatgaaataggcatagtcggcctttgttactcccaaccttccttttactctcatttttccttccataatgttctcctccctgtctcccagacactctcatctttgtgtcctttttgtttacaattgctctaggaaaggttattaacttgcacaccctgatttataaaggactgataagtcgtagagtattaatgtgtcaacaatcaaacaaatgcatctcccattgtagaatatcaagggtaacatagcccaagaaatgtttctttggggaaagaaaatctattcggagcccttgaaattaagcatgtaaacatctgtatagccaatttacatatatctataatcattttgaaggaactggtatctaaaagactttatttgggatattatatgaaaagataacaatgattaacttcatcaagcaacattaaagcaacagtgatttattatattaaaagtggctccttgacttgctgataaatataaattaaaggggaaaaagaatataaagggattctagcagaaatcttatagtaagcattttacatacatcaatagtattttctgtattcatcatacaaaaagtgaagaatgaaagaaagtggtctcaatttacacatgagggaatataattaaaagttttctgtggaataaagaaaacacatgtaattgtagtaaattaacctacctgtagaaatgttttatttacttatatttatattttcaatacattacttctaaaaatagtagtttttatagtttgcagactcctttgaaaatacagtaaagatgctggtataccttccttgatcaaatgtaaacatacacatttaccttgaaacttgaattcaatttcagaaacatcatattaactaatttcccattcaaaagttcatgtttaatatcctcaataaatgtaaacaaagtactttatacactgtactgtgctgaaggggttatattatgcatattctattttttattatatgtcatgcttagagtgataatgtccatagacatagcagcaaaaaataattgagaatgaaaaaggaaatgacattaatgcaactaagtcctgagactggctatttgggggtggacagatgtggttgctggaaggaaaggcattttatgacatgattctgcgacttgtataagcctgacagacatattcctaaaggcaaaggagaaacatttgcagaaacagtcaaaatgaatggcatatatttatagagagctattcaagccagacaaactaattctgttttgtgtatggataaaattagaaaattagaggatggggataacagaggagatatcaattttgattatacttaaatcacttaaaatgtctcaggaaatcttaattaaaatttagcacaaattggattcaatattaacattcttcctgggacttaaattggctaaaggaatgtaatgataaatggcaatgcatcaagttaagaaaaggtgttaaggagtgtgcttcagggatgtcagcattatagctggtcttatttaacattttcataaatgatgttggaagggaggataagctggatgataattacattgaagaaggtacccacctgggagatgctagaaataccaaatagtactgcaaaacacaggagacagaaacacccactaaattgcagagatagtcaaccacagttgagctaaggtattcagggaacacaattagctctgcagaaattattaggaggtagaaagcttaacaagtacacaaaataaggattctatgtttaagttacctagataacactatttttcagtcttttactactaaataataaaataatgggttatgagtcaatataatttgtttgcatgtatgctaacaaagatattttaaggaaattaatcgtagtccaccgtcagaaaaataagctgagacactgattctgaatacccaaatcataatagtgtcttccatgtaagatcccgaaaactcaagacctttttttttttaaacctcaacattagcaggagaattgcttgaacctgagaggcagaggttgcagtgacctgagatcatgccactgcactccagcctggcaacagagtgagactcttaaaaaaaaaaaaaaaaaaaatccaaaacctcaacgacattacacagtagatgtccccttctgaagtctattagatgatgttgaatggagttgtagttgctaattttggagctaacctatggcaagaatttaattcaattatagttcaatgactctgtgaccagtagatagtgtctatgagatggaaatatatgaagctcatttctaatttagcagggaaatctgcttcctaaatgaaaagggcatttatttacatggggaggccaatattttgcttacaagtttcagatgaaagtaaaaacaatactataactttaaagtgtttattgaaacattgtgatatctaaaaggtaagaaattgtgagctatttgttttttttatttcttttcgatgatgttttatagttctattcaggaactttagccctaccctttcataattccttcctctcagtgtttcaacatgtgcatattccaaatgtccccatctgtattagtctgttttcatgctgcttataaagacatacctgagactgggtaatttacaaagggaaggtttattggaatgccacgtggaattccacgtgggtagggaagcctcataatcatggcagaaggtgaaaggtgcatcttatgtggcggcagacaagagaagagagcttgtgcagggaagctcccctttttaaaaccatcagatctcatgagacttgctcactatcacaagaacagcacaggaaagacttgccccaatgattcaattacctcccactgggtcctcccacaacacgtgggaattcaagatgagatctgagtgggaatacatccaaaccatatcattccaaccctggcccctcccaaatctaatgttctcacatttcaaaaccaatcatgctttctcaacagtcttccaaagtcttaactcatttcagcattaactcaaaagtccacagtcaaaagtcccttccacctacgagcctgtcaaatcaaaagcaagttagttacttcctacatacaatggagatacaggcattgggtaaatacagcctttccaaatgggaggaactggccaaaacaaaggggctacaggccccaagcaagtccgaaatccagtggggcagtcaaatattaaagctccaaaatgatctcttttgacttcatgtctcacatccaggtcatgctgatgtaagaggtgggtttccatgctcataggcagctctgtccctttggctttgcaggggacagcctcccccccaactttgtttatgggctggcattgagtgtctgtagcttttgcaggtgcatagtacaagctgtaggtggatctaccattctgggctctggaggacagtggcactcttctcacagctccactggtcagtgccccagtagggactctgtgtgagggctctgactctgcatttcccttctgcactgccctagcagaggttctccaggagggccctgcccctcagcaaacttttgtctgggcaaccaggtgtttccatacatcctctgaaatctaggcagaggttcccaaacctcaattcttgacttctgtgcacctgcaggctcaacaccatgtggaaactgctgaggcttggagcttgaaacctctgaagccacagcctgagctctatgttggaccctttcagccatggctggagtggctgggacacaggacaccaagtccctaggctgcacacagaacagggaccctgggcctgcccatgaaacaattttttcctcataggcctctgggcctgtgatgagagaggctgctgtgaagacctctgacatgccctggagatattttccccattgtcttggggattaacattcagcttcttgttacttatgcaaatttttgcaggtggctttaacttctccttagaaaatgggattttcttttatattgtgttgtcaggctgcaaattttccaaacttttatgttctgtttccattataaaactgaatgcacttaacagcacccaagacacctcatgaatgttttgctgctaagaaatttattccgccaggtatcccaaatcatctctctcaagttcaaagttccacaaatctctagagcaggggcaaaatgccaccagtgtctttgctaaaacataacaagattcacctttgctccagttcccaagaagttcctcatctccctctgagaccacctcaggctggactttattgtccacatcactatcagcattttggacaaagccatttgacaagtctctaggaagttccaaattttcccacatcttcctgtctttttctaacactccagactgctccaacctctgcctgttactcagttctaaaattgcttccacattttcaggtatgttttcagcatcaccccactctactggtatcaatttactgtattagttaattttcacattgctgatatagacatacccgagactgggcaatttacaaaagaaaacaggtattgaaattacagttctatatggcggggaggtctcacaatcatggcagaaggtggtagcagataagagaggagagcttgcgcagggaaacttccatttttaaagctatcagattgtgggagacttattcactatcatgagaacagcaagggaaaatcttgcccccatgattcaattacctcccaccagatccctcccacaatacttgggaattcaaaatgagatttgggtggggacatagccaaaccatatcaccatcaatcacccatgtgaccacaaaataatctaagttgctcctaatgtttccttttaaattttggctgcagtttactactctctttaattgctctttcctggttctgataaaaaaaatacagcttgatataaaaggacaaatataaagatgattgaattgtgcataagctgaacaaaaacattcaaattggagtctcaaaaatgacacagaaagccacagttgatataaaccatatgcaagaatataaattgtaatgcaagagtgtaaacacggtattttatatgaataaatatattttttattagaagtgaattatgggccggaagctgtggctcacgcttgtaattccagcactttgggaggctgaggtgggcagatcacgaggtcaggagtttgaaatcatcctggctaacacggtgaaaccccatctctactaaaaatacaaaaatattagccaggcgtggtggcgagcacatgtagtcccagtgtttttgggaggctgaggcaggagaatggcatgaacccaggatgtgaagcttgcagtgagccgagattgtgccactgcactccagcctgggtgacagagtgagagtctgtctcaaaaaaaaaaaaaaagtgaattatggcttaattgataatgcatgaatgtgttgatcatttgatgtttttgcctcttgggcatccttggctcttgcttccagtaaaagtcccttattttcctttggggagcaattggcaaaaaaacatgtcaagttattcaagttggtatagtcaaggtgactcctagaactactgtaaaagagtgtttttttcttcctctagggctaaactggtaaatttatatctggtgtttctgctggctttccagtcttcattggatgtacctaagactgagacccatacagaagaagacatgtcaagaaataagcagaaaatatcgctcatgacatggtttctgcttatgcctgaaaccaaattcaccactttctgatagattaaaaattacatattttaaatgctaatttattttgaaattatgtctttcaaccgtaagaaccctaaatatataaaatagttttgatgcttaactactcttcttggtttgctttttgattatttttctaggattattgtgcttcgagattttggtttgagataccatgtaatcattaatacaataatgtaatatataattattcattacaataggcaaagatattgcttgaaagtggtagaattgtccctgtatagaaataatattgaattactcaataagtaaaaaaatacagataaattagctggtaaatatttccatcaagagaggacagactcgatttcagggaaatatttaaatgagtattgctttgttttttcttcttcataatttcatggatagaggattcattcttacatagatatgagcaacctcagcatacaatttttttcattattaagatgagaactttcacattttaacttaaaggaagcactttcatagcttctctttgatatatatgaattgccagaatcactactcctgtgctttgggaccattgttatgtaaaataagggtaccaccacaggtaatctaataacagagatagcttctaagtgactcatgggcagggagcatagatgtcctggagatgctggacaaaaggatgattcatgccccccccaacaagctggggacagagtaggacacctcaagatttcatcacactactgaaaatggcacaaaatttaaaactttggaattgttgatttctagaattttccatttaatgttctcagaatatagttgaccaaaagtaatagaaaccatggaaagcaaaactgaggacaagggaagaatactgtaaaaataaacatgaactgagagatttacctcacagcatatgtaaaattaactcaaaatgcatcacagacctaaaggtgaaagctacactatgaatactaggagaagataatataggagaaaatctttgtgaatttggttggcaaattttcttaaatatgacagtaaaagtatgatacaataaaaaataaacttcctaaaaattaaaagctttttctctaccaaaaacataagaacatgatacataaaatacagattatgtatttgcaaaatatttgcagatcatatatctgataaaggacttgtatttataatttatagagaatacttaccagtcagtactaagaaaacaaacacaaattttttaaatgagtgaaagatttgaatagatatttcaccaaagaagatcaataaatggctaataagcacatggaagtatctcaaattaatttgtcattaagggaacacaaaatcacaatgagatactaataagcatctgtataatggctttaacaaatgaactgacaatactatcagagaggatgtagtgggtggtaaaatggtacaagccactgttattaaaaagcagtttgacagtttatttaaaaagtatatatttaccatgtaatctagcacttttcgtaagatatctatatataacaaacagaaaaataaacatatatgtgtatatatatgtgtgtgtatatatatttacatttccaaaaagtgacttatatagaatattcacagtcacattaaactggaaacaactgaaatgcccatcaactggtaaacagataagcagaatgtgttttcacaagatggattctattaagtaactcaaagaaacagatatatagcattgattcatgccacagcatagatgagctacataaacattatgctatttaaaaagccaggtaaaataaaagtaaaagatacatactatgggactccatattttttaattcctagacaaggaaaacttttagaggcagaaaccaaaacagggggtgtctacagctgaaaatgggagtgagcattgactacaagtggtcatgagtaaagttttggggtgatggaaattttgggggtgaaagaaatgtatagaactagattgtggtcattgttgcacaactgtctaaatttactaaaaccagcccaactctttcatggaactgatgtttactggtctttgaataaacacagaaattgaccccccacccccaccccaccataccctgtcttgaagcttgaaacttacatttgtctcatgggagtttcttcctcaggacactaaccctcaaccctcctagaaaccaaggaactgaaactcaccagataactgtatccagaaaatgagatgccagacctctcatccatggattatgattccagtttaccaattcctcttccttaccctaccctaatatttgtttttgcacaagtattttttccctgctatataaacccctaattttaatcatttggggagatggatttgagactttatctcccattctcctcagctgcagcacctgattaaagttttcttctctggcaatatttgttgtctcactgattggcattttgtgaagcaagcagcaggacctagatgaaacccttgatgttttggtaatatacatacatgaggacatgtaaattataccttaataaagttatcgaaaataacaaagataattccacccacacatctgacctttttaatgatatttatccatttttttctgctacattatagaatgcccttcaggctacttgttcatgtattgtttcatcatttgagtaactttcttccttcttcctgccttcttatgcacctcacaaagtttagatcttgattatttgtttctttctttctcttttaaaccactgtatgttcctctgccttcagagactttactatcaactccatgaactccatgctacctttgtaaaactacttcttcctcctatgaatggacaggtatgaaagctctggcaagcaaagaaaagccagacccatggaagaaaagcagaatgtaatcagctaatccaactatgaaaggctgtctgtgttgagaaaagtaatcagtagaagagaaggtgaaattgtggaatatagaatggagagcacacaaacaaagatttcaagataagataccttcatattttcctctgagagaacattttatagcaagagtataatcttcttagcagctcccttcagatgtggtaatgattaatggccaatgctggagaattgcacagatttggcagaaatcaaggtacaagatatacttgagaactctactgggatcatttggggttaatgtctccttatgacatgccagaatatgagataggattgtatcacttgggcctttttcgttggttatatttatcctaattttacatttgaagccttgagttaaattctaactttgaccttatctgatatgcagtggctggcagccatagcttatacatgtatagatatgtataaaaatgacatcacttaaggcattcttcggtggtttcctagtatgacagagtcgatttttcttttttgcctcaccagatgtgtttaagtgtgggatgaaatataaacaaacgtttatggaatcagtattgtaaacaagaaggtgaacagtaaagttatatggtgaccccatatcctgatgatttgttcctagaaattctcaagggcaattataaggatccttttgcacactcaggttgaacttcacctagaagtagaatatgcctaatctacaagcttctgggagaaacaatacttctgtatgcacacaatatacttgaatcgtattcatatcatatatacttagaggaaatgtatcagtctattttcacactgctataaggaactaactcagactgggtaatttatgaagaaacgagttttaattgactcacagttccacaggcttaacaggaagcatgactgggaggcctcaggaaacttacaatcattacagaaggcaaaggagaaggaagcaccttgttcacatggcagcaggagagagagagagagcgagaggagaagtgccatatacttttaaaccatcagctctcatgagaagtcactcactatcatgagaatagcatgggagaaatttgcctccataatccaattaccttccactaggcccctactccaatactaaggttcacaactcaaggtgagatttgggtggggacacagagccaaaccaaaccgaggaacaatccttgagtcaccttaatcaacactggacataaagaactaagagggatttgaagttcaataaattagtttactgaatcaagtagagatggcttttaggcaaacatattaacctaaataagcagagtagggaacattctttttcaataacttggcattactcaggaatgattacagagtaatcaatgattactgaaataacaattataataaattctgatgtatttaaatggttctagttggctatactagaagatcaagtcaggagggacatatctctgggaactacggacaatctaaactataccaagatgtcatttgtaagtatgggcattatcaatcttctattacagtcatatttctatgaactaggaaacaaacatcttcttcatggtacctttggcgaagtttggacagactaagaatcaatgcattgctttattaaagaaaagtgactggtgtgctgcattcatatgcagaagctttcgctagtgaaagtttattcctaggggatggtttatagttatgctatcagaccagatgcagaattgtcggagaaagagtatctaatgactactctggtaatgtaaaatgtatgatatgtaggaaaagtctattttttgctaggaaagttgagaaaataatttggaaatattaaagtgtattgtgttaaatatttcatctctctgcctcagctctatcgtgtgataagggatttttaaattcatttatgtagttagataaaaataaaatctgagtgcatactgatctctaggacagaaagattatttggatgggcaacataaaacttacaactaggtaatccttatgtagaaggatttgccagagaaagaattgaatttacgtgtgtaaactaatatacccagttgaatgtatcaacacttataaaaaggcagaagtaatagaggataagggggaaaaattgtctttcaaatgttaaagaaatatcagaacagttaagtgaatctatctatggttgttaatttgctttgtagagggaattccaacttcttagtgtatgaaatatgctctggtgatagccagtgttttaacatctatttttaatgcactagatattatagaagttagtgtaacaaaaattttaagaagattcctcagaaatgtgtagcaagtgggtaacacataatgagtgcagatgacttagaagtcataagatattatatctaaagttacaagacttctactatgctattgccatagaagctatattgttgcctgcctggtatccttaattaaagctaaatcaacttggagctgtgtaaggtctactgggtctctccaggttggcattcagtctgaacctaaggctgctgctcattaaactatcactggaaattcactattcagtgtgatttctgatggaaaaatgatataatgggtttgcttttatgtttgttgatttcttcatgtgtcaataacattcaggaagttcttcaataactcctgctggccaagcaaattggggattgcaaatgtatttattttcagatttattctctgtggccttaatgtgaacaagtgatgctttaaagccaaaaagcataacaggctcccagttttcccccttctcttacgcatatcctagaataatccaagatgatgggcacctcagtagggtaggtggctggcaaatttatcactttggttgtataatttggaaaaagatattgataacattaataataacatgatcattaaatacttatatgaataattgtcaccgaagatgaatctcccatctatgcatttttcttcccaaaaaaaggcaagaaataaaacaacaagaagatgactttaaagcatttcttttcacagcctgactatttaaagggcttgtttcttttctgcagcaacttcatgatccttttgtaaaggttcattggttctaattactcaaactctgagactggaaactggaaccttaagtgctctaatgctatcaaattctctcatgcccaacttacactctcaaaaaaagatttcctcaaagttggcttccattaatttccatctcattagctttaacccatcgatttaaggacccagtctttcatacttcttcaagaaatctcacgttgtatacaatgccaaatctaaactactctacatgcaaggtagccatcttaaattaatttataaataattggatccatttattcagaccttaatttgtaccaaatgtctgactccgaaaaatgaagagtggaaaagaaacagaaacaataacttctgtcaaacagaaggtgctctaggaaaggagatgagagagaaacctatctttaaatgaaatgctgttacagaaacataaaaatactttacaaaagtacagaaaagcctgtcatgacaaaggggctgggagaataaaccaacatatatttgacttagtaaaagaaaagcaaatctttgagcattcagttcctcttctctccaatgccagttaaatttgtatctttaatgcctcatgaaattactatgcctttggccgtatcatttcatcttcaacatcatattatcttcacttgcctatctgagtactctaacagatcatcatccccactcacttttgatgaattctcgttagtgctcttagtctttctcatcaaatttaacaactcaataattgtgatgttttctgattatttcactgtgaagaaggattatttcttgcaaaatatagtcaactccttgaggattagggctgtgccttactcgttctacgtatttttcagagcacttagtttagtacgaatcacctaaaaatctgtgtagattaaattataatctagccaagaaagtaatacaacatgtagcatacatatattaggacttgcacaatagtgcttttgtttgtttgtttgtttcctttgccaaactggatgagcaagtttactagggttttaagaaatccctactgctctatttaaatgtttgttttttcccctaagatctcctgtatttgaaatatctcaatacccaactatttttattttactcagatgactatgcttggacattataactgtcaggcctctgagcccaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctcgctcatcctggctcaaaaagcacctccactgagcaccttgcgaaccccactcctgcccgccagagaacaaaccccctttgactgtaattttcctttacctatccaaatcctataaaacggcctcacccttatctcccttcgctgactctcttttcggactcagcccgcctgcacctgggtgaaataaacagccatgttgctcacacaaagcctgtttgatggtctcttcacatggacgcgcatgaaatttggtgccgtgactcggatcgggggacctcccttgggagatcaatcccctgtcctcctgttctttgctccctgagaaagatccacctatgacctcaggtcctcagaccgaccagcccaaggaacatctcaccaatttcaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtggacccaaaactccggcgccggtcacggacagggaaggcagccttcccttggtgtttaatcattgcagggacgcctgattatacacccacgtttcaagggtgtcagaccacacagggacgcctgccttggtccttcacccttagcggcaagtcctgcttttctggggaaggggcaagtacctcaaccccttctctccttgtctctaacccttctctgcttttctgggagaggggcaagtacccctcaacccctcctctttcacccttagcagcaagtcccgcttttctacagggcaagaacccccaatctcttatttccgcaccccaacctcttatctctgcgccccaatcccttatttccgcaccccaacctcgtatctctgtgccccaatcccttatttccatgccccaaccccttatttccgtgccccgaccccttatttctgtgccccatcccttatttctgtgccccgacctcttatctctgtgccccaaccccttttcccacttttctggaaggtaagaacccccgaaccccttccctctgtttccctactctctcttttctctaggcttgcttccttgactataggcaaccttccaccctccattcctccttctactcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccaatgcaactcgtcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctataatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatgacgtgtttggcagcaaccctgagacactttacagccctagaccctaaaaggtcaaaaggccgtcttattctcaaaatacattttattacccaatctgctcctgacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacaaaagaacttccaaatgcctgaaccgcagcggccaggcgttcctccagaacctcctcccacaggagcttgctacacatgcaggaaatctggccactgggccaaggaatgcctgcagcccgggattcctcctaagccgcgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagacaatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctctgaaaactccccaactctgttgccaacttagaccatactcttttaagcactcctttttagttatccccacctgcccagttcccttattaggctgtgacactttaactaaattatctgcttccctgactattcctggactacagctatatctcattgccgcccttcttcccaatccaaagcctcctttgcatactcctcttgtatccccccaccttaacctacaagtataagatacctctactccctccttggcgaccaatcatgcaccccttaccatctcattaaaacctaatcacccttaccccactcaacgccgacatcccatcccgcagcacgctttaaaaagattaaagcctgttatcacttgcctgctacagcatggccttttaaagcctataaactctccttacaattcccccatttcacctgtcctaaaaccagataagccttacaagttagttcagaatctgcgccttatcaaccaaattgttttgcctatccaccccgtgctgccaaacccatatactctcctatcctcagtacctgcctctataacccattattctgttctagatctcaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcagcataattctcataaaaacacacgtgctctccctgccaatcgtgtccgactgatctctcaaaccacagcaacttctacaaaacaacaactcctttctttcctaggcatggttagtgtggtcagaattcttacacaagagccaggaccacaccctgtagcctttctgcccaaacaacttgaccttactgttttagtctagccctcatgtctgcgtgcagtggctgccactgcattaatacttttagaggccctcaaaatcacaaactatgctcaactcactctctacagttctcataacttccaaaacctattttcttcctcatacctgatgcatatactttctgcttcccagctccttcagctatactcactctttgttgagtctcccacaattaccgtcgttcttgacccagacttcaatccggcctcccacattattcctgataccacacctgacccccatgactgtatccctctgatccacctgacattcaccccatttccccaaatttccttctttcctgttcctcaccctgatcacgcttgatttattgatggcggttccaccaggcctaatccccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagttcgaggatttgccccacccaggactggcaaattagctttactcaacatgccctgagtcagataactaaaatacctcttagtctaggtagatactttcactggataggtagaggcctttcctacagggtctgagaaggccaccgcaggcatttcttcccttctgtcagacataattcctcagtttagccttcccacctcaatacagtctgataacggacgagcctttattagtcaaatcagccaagcagtttttcaggctcttaatattcagtgaaacctttatatcccttacggtcctccgtcttcaagaaaagtagaatggactaaaggtcttttaaaaatacacctcaccaagctcagccaccaacttaaaaaggactggacaatacttttaccactttcccttctcagaattcaggcctgtcctcagaatgctacaggggtacagcccatttgagcggtatagatgctcctttttattaagccccagtctcattccagacaccagagcaacttaagactgtgccccccaaaaaacttgtcatccctactatcttctgtctagtcatactcctattcaccgttctcaactactcgtacatgccctgctcttgtttacactgccggtttacactgtttttccaagccatcacagctgatatctcctggtgctatccccaaactgccactcttaactcttgaagtaaataaataatctttgctggcaggactatgctgaatctccttaggcactctctaatcagatatcctgagttgtcccaattcttagaccttttatacctgtttttctccttctgttattccatttagtttctcaattcatccaaaaccgtatccaggccatcaccaatcattctatatgacaaatgtttcttctaacatccccacaatatcaccccttaccacaaggcctcccttcagcttaatctctcccagtctaggttcccacgccgcccctaatcctgcttgaagcagccctgagaaacatcgcccattctctctccataccaccccccaaaaattttcgccgccccaacacttcaacactattttgttttatttttcttattaatataagaagccaggaatgtcaggcctctgagctcaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgactttaccttgtgaaagtccttttcctggctcatcctggctcagaaacacccccactgagcaccttgcgacccccgactcctgcccgccagagaacaaaccccctttgaatgtaattttcctttacctacccaaatcctataaaacggccccacccttatctcccttagctgactctcttttcggactcagcccgcctgcacccgggtgaaataaacagccatgttgctcacacaaagcctgtttggtggtctcttcacgcgcatgaaaataacaaaatttactaccagtgaaagctgaaaagaaaatgagctcttttttggaaacaataggtgaataaaagctaaaattgatcaaagaaatgtttcatttattggacatatactaaagaaaatagtataaaatatattgtacattttgtttcttctagagcaatatcatatttcaagtcaaatatctagtaaaccagcaatatatagaaccataagtatgagcgtgaatatagtcaaaattaaaaatacacaatttacatgattgtaaaaacaatcacatacaaataagcagaagcttcataaaaaatgcaagcacctaagcattaattattgaaaccggaccatgaaattggacaactttcactatgacaaccaaaaaacatgatacagaaatataaaagtaaataattgtgtttacaaatgagttttctttaaaaagctacactgttaagtatatcaaggaaaggggataacgtctgaaaaataatataaaatctaaatattctgttttcagttacacaaattcaaaatgcaaggaattgtgattactataatgctagcattagtatttcttcaaatttatcaaatgggaaacctcagcctaaactacataagccctaaggttttaagagatactgaaatatgtgctaaacacttaataatgtttaatttgatgatctaagtcatatttgtcatgtattataaaaccaaaatataatttgcctttcttcattagtagtctagtaattacttaaggtcataaactatatgttgatagtttctttatttcttatgatttggcatcgtgcgcaatactttaaatgctctacacaataaatcattttcaaataaatgtgttaattattcaactttgcctctttaacagcatatatgattgacttatgttttcagtcagtttagcatctcaagagtctttttgaagtgattcttctgaataatcaagtttggaagtactacgttatagggatactaatataactgtagtttaaaatattttactttgtaaaaaatttaaaaatgaattaacctgaaatataagttatttcccatgactcataaataaattcctaatacatattttacctacatctattagttctttttatccatttattcatttaacaaataatatttattaaaggtcaatgtgctgggactgtgtaaggtgttaggcatacagtagtgatagaaaaagaagaaaagtatgcaaaaaaattgacaataattttattccatttgagcctataattaagtgagagaaacagatagtttaaccatataattataaatttttaaatgtgctgtgaaggagaaatcaggatgctccaagataataaaggggtaacattgagaagaggaaatcatggaagtcttctttgaggaagcggcatttaaattaagacctaaaagacggaaagcatatgaatgaaagttatctcatcactgtgggagcatcataacaaataagagaaagataaaatgctaagtgaagaaattgaacgctaatccagtaatacaggatatcgattatgggcttcatttttatagcagtagaaaaccattgaaggggtcaagcatgctaattatttgagtgatttcaaatgtaatatagcccactggctaatgaatgaagaagagggaaagaggagacataaataatactcatagaaggacatttcacaggtttaggtgaaagttgatggtggcagtgaaagaaaaattaaggccgggcgtggtggctcacacctgtaatcccagcactttgggaggccgaggcaggcagatcacgaggtcaggagaaccagaccatcctggctaacacggtgaaaccccgtctctaataaaaatacaaaaaaaaaattgccgggcatggtggtgggctcctgtagtcccagctactcaggaggctgagacaggagaatggcgtgaactcgggaggcggagcttgcagtgagctgagatcgcaccactgcactccaacctgggcgacagagcaaaaaaaagaaaaaaagaaaaacaggtagatgcattaaataagtatatgagaaaaaattggtaggaggtggtaatagattggagatgggagtaaatgagtatgtttcaagaataactttttccaatcaaatggaaggtgttgctattttcttttccttctttcttttttctttttcttttctttttttttttttttttttttgagacagagtctcgttccgtcacccagccgggagtgcaatggcgcgatcttggctcactgcaacctccaagagattctcccgcttcagcctcctgaggtgttgctagtttcttagattggggaatatcatccatttgaaaaaatgctgatagtgtaatcaaacttggaattcaattaaagtcctaagcatgagtgaataacctgtataagttcagaattacatgttggtgtatatatttcaattctaatacaaataggtttagccaagaaatggagtggtctttagaaaaaaataaaatgcttcaaatatcaaaaataaattaaaattgtgtactaatgtaaaaataggtccacatttttgtaagctttgctcatgaagactttatccggtatttgctgaaatactgaaccccctcaagaccttaagtaaatataaccctcaaactttaatcatgacattatacacacaaaccaaagaaaacaaaatcattatttgaaagaaattgtcgtctatggccataccactctgaaccctcccaatcttgtgtgaaataaattgtcaagagacattaaaatacgatgtagttttatcttaaacttgaatatttgaaattacaaaaacagaatttaatatgtaattttatatgttatgtacgtgtcctccacagagcactaaataacacaggacactcagaagtatatacagataaggtagcaacaaatattaataatcataagtgctttacataatttatgagaatggtacagtaataatagcaagttaccacatgcagcatttgctaagcatgcatgtgatagtagtttatatagttagtttaataatcacaacactcttttgaggttggtactattattatcaccattttaaagattggaaaactgaggtacaaaaggttatgtcatgtaatggtacaaagtggcagaaagaaatgcaactagctagcctgcctcccaattctattgtctttaaattggattctacttcatctctgtcacttaaaaccctcgttaatttggaacaatcatctgtcattatattaactcacatttttctataaaattaggctataaaaataattatgttcaaagttttttcctatgatatattacctatgatatagaataactacctatgatataggtatgataattacctatgatataggtatacctatgatatagaataactacctatgaataattacctatgatatagaataactaagaaattaaaatatttccaatttaagagcaggaaggggtagcttggctaaagctgtgaagttagagatcatctcgggaaaggactatgtgaggtgatacttagtgtgtgatagaattcttacgccaaatagaacatatatctaaaattaggtgttttctaaactcattgagggtacattagtcgagggaattaaattctatggacattaactgaattcctactgtgtgtaagtcattatactgaccactcgtggttagatcattaaaagtttttgtcttaaaggaacttacagatcagtaggggagacagacacgtaaaagttagccttaacgcaagccacaataaaacatgtgggagatacagttgatagctggtacgtggaagcaattaattttgacttgctaggaaaatatagcctttattaaagaggtaacaattgtactgtgtgttaaagattttcttttttaaagatacaacttggatcaaaccttcaacctgagagagctctcaatagttacagaataagaagaatattccatgctaaaaacaagtaaaacaaaaccctatatattattctcggattcataacatgaagggatgtagcaggagatgaaacaaatatatttaagagtattacatagatgtccttgactgtatgtgtggagctttcttccttccattggtaggttttccaggagggtgaggatctgttctgactcagtttcagaataatcatctgaaacagtgtggtaggaaatccattgaaatagccagattgcccaacatagtttactgtagtagcctaaattatggcagcacataggcatggaaaaggaattggtggtggaaatgggaatgcaaattggtacagtcaccttagaagacagcttctcagtttctaacaaagatatccatattcattctatatgatccagcaatcccactccttggtatttaccaaaaggatttgaaaatttatgtccatgtaaaaaaaaaaacttagcatggatgattatagcagctttattaataatggccaaaacttgaaagcaaccaaaatattatttcatggaagaatgaataaataaactgtgttacatctagataatggaatattatacagccctgaaaagatatgggctattatgtcatgaaaagacatggaggaattttaaatacgtattactaagtgaaataagccagtctgacaaggctacatactatatgattctaaacacatgctattctggaaaaggcaaaatcatggagactgtagaaagatcaatgattgtcaggggaaggaagcaagcaagggggagggaagcataggcagagcacaggatttttagagcagtgaaactcttctgtgtggttctataatggtggatatatgtcattagtacaaaaccataaaatgaagcaccgagagtgaatcctaatgcaaactacagactttggatgataacaatgtgcgaatgtaagttcattaattgtggcaaatgtatcactttggtatggggtgttaatattggggcaggtatgcatctgtggggacagtgagtatatgggaaatcactgtatcttcctctcaattttggtgtgtacctaaaactgctcaaaaaaaatctttaacaaaaaagatgaaatgatgatctacaaatacattctaaaatagaaattgcctaaactgaacaataatttggatgtatgcaggtaaagcagagggaaaacaaacaagactgcaaggtgcctatcctgctgcctgtggaacctaaagattaatggtgtgcatcatgatatagctgcctccaacacgactagatgcatgtttttgagtgtctgtgtttgtttattaaaataaagataattgattagttaatgtatttttggatatgtgcaatttgaagtgcttgtaaaagatctactttgtcatgtccagctgatatctggaatgtcagcttgctgcttgggaaagaggtcattacagggcatttaactttgggagacaagtatatatagaggtgatgattgaaaacttgagaacagatgaaaaagagaagaagtatatatacgtatttgaagaacgttaatttttaaagggtgataattgaacaaggggccagtaacatctctcagccaacagagaagtaggatgggaaccagggaagtttttcataaaagggtatagttgagagtttcaaaaagattaaggacttttgactttgacatgtagaaatagactgatgggatatctaattttatatgattttagtggtgtgatgtgagtgaaacccagagtatattctatacaagatagataaatacagatagaaatatagagatagatatagatcaatatatgtatgcaggcacttagattgatacatttttgtcgataaggaaaataatcagagtgggatagaagcatgaagaattatatctgggagtagggattagaccagaacctggggatgttaataatgttaattgggcaaagggaagggattagtcactggagagagattattgcatcaaaaaaatagaataattggtggagcacagaaattggaaggagtgcagtctaagacaggaaagaagagtaagaagcatcacagaagaagggaaggagaactaaaaaacaaaagaacaatgaaaagaagtggggtgaggatcagaggactcaactttatgtgggattccatcttaatgacttaagaagtaccagaatctacaatgaactcaaacaaatttacaagaaaaaaacaaccccatcaaaaagtgggcaaagaacatgaacagacacttctcaaaagaagacatttatgcagccaaaaaacatgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggattgtaaactagttcaaccattgtggaagtcagtgtggtgattcctcagggatctagaactagaaataccatttgacccagccatcccattactggatatatacccaaaggactataaatcaggctgctataaagacacatacacacgtatgtttattgcggcactattcaccatagcaaagacttggaaccaacccaaatgtccaacaacgatagactggattaagaaaatgtggcacatatacaccatggaatactatgcagccataaaaaaaggataagttcatgtcctttgtagggacatagatgaaattgggaatcatcattctcagtaaactatcacaaggacaaaaaaccaaacaccgcatgttctcactcataggtgggaattgaacaatgagaacacatggacacaggaaggggaacatcacactctggggactgttgtggggtggggggagggggcagggatagcattaggagatatacctaatgctaaatgacgagttattgggtgcagcacaccagcatggcacatgtatacatatgtaactaacctgcacattgtgcacatgtaccctaaaacttaaagtataataataataaaataaaatttaaaaaaaaagaagtacaattattcagtggtacttttaaaatattgttgtttaaaactgtaactctcaaaattggctgcatattagaactgtttcaatttcttaaataaaatctgtctaagtgagtccgttatgggtggccaaatcatttaaatacaaacatcttagaatgaagtgctggcatcaatactttaaaagttcctcaggcagaatgctaatagtcaattatcattgagaatcacagtttaagagaattgcagatgtttgcgaatagtgtttatggagcattaattggatagctagctactagtatttaaattgacatcttcaaaatattaaaatctgtatcctgtatagggagtaattgtcttttcaagaaaactagcaatgtgtggattggtattagtggagcatagtatttattagtttcaacctatacgattgcattgacatctgataaaacggtctgcatggaatgaaaaatgaaattatctcatgcagtaattttcccttaaacaaaatatgtgctaataatgtgattatacttcagctccggttacggaagatgatgttggtgctttaaggcatcactcctctaagtgttgttcatgacccatgtgcatgagaatcactccaggctttttgaaaaaatcaagtgtaagagacatatataaagtcagaagctcaatttataactgagaacttataacaaggatctggttaaaactttataaccaactcatttgctccttgcagacagggtagatacttaataagaaaaatatactgtacttaaaaaattgagtatgcactcacatcaggctaaaagagtctcatggctacattgaaaatgacaataattaaaacctgttgcccaagtgtctctttcctttaaagtgctcattgtcacttttgtttctgacactttcagtctttgacatcagtttactaaccacaaagtaaactgatgtatcctgtgtcaggtcaatggggaaaggcagggttgtgatgaggtgtagcatagggacctatgtcatgactcttaaagggtatatgtagatcagagttctgtatcaagtttctttgttttaaaaatattctctcaatgagaactagtttatgtctaggttcttggaggatgttttatagcgagaccattcttctaccacataccagaaataacattaaaatactaattataaagcttaatttgttgacttaaataatttttaaaattgtgggcatgctgacacaaacaacagtctatcttcataatctgcatagttcaggaaaatatataaaagtcttgaaaggcaaggaaatatctgttttacaaagagatacataagggaaattaacttttgtagacttcaaatgaggaaataagcctttgatcccctaaggcaaacatttttgagatacagtttctccatataattgctatgattttcttacttacactttgtagttccctgctggctgtttttctgtgtaaacttactttcatttccaattatgtcattatagagatgaaaatcagctctaattaaataagaacatgacaataattgtcattcatttatttatgtaaactatgatttttctacctgtgaaaaggtgatttagcaaagaaaaatgtagctctcatggtccatcaattgactggaactaatagtcatgtatctacagcttcccattctctcatatctttattcattcaatattacttgtctaagggtcttcctttctttcatcttcaaataagcatttattaagtagctacactatatttattttattttataattttaacttttatttcagattcagggggtacatacgcaagtttattacctgggtatattgcatgatgttgaggtttggggtatgattgattctgtcacccagatactgagtatagtacacaatagttaatttttcaattgtctcttctccctctctccctccatagtagtccccagtgtcttttgttgccatcagcagctaccgtattaaacatctactatatgccatgaactatagatacagatgccacagatacagaaataaactagttacagttttgccctgaaatcaaatgctttaaaacacattcattttattaatgtgacaagtaccataccaatatattaaaaaatttaccatagcagtttgaaacgttttttctctctttaccaaatacacagcagaagctatttacacatagaataaacattccggtgaattcccagtccccaggctatcatgtcaccccttctatagaactcaagaaagcatatcttaattcataaataaaaaataatagcattgaatgatttcttttttctttcacattttgcttgtttgtttgttttttgtgtttttctttttaagacggagtctctctctgtccccaggctggagtgcagtggcgccatcttggttcactgcaatctccacctcctgggttcaagcaattctcctgcctcagcctcccgagtagctgggactacaggcgcatgccgccacgtccggctaatttttttaaaaatttttattttagtagaggtggggtttcaccatattgcccaggctggtctcgagctccttagctcaggcaatccgctcgcctcggcctcccaaagtgctaggattacaggtgtgagccgccatgcccagctgcattgaatgatttctaattttaattaacaattaatgcaaagttggtgatgatttatccttggaataaatatttactgcatggctaatatgtctgccatgtgctggcattacagtggcaaacaagacagccaaagttgctaacctcctgagttttccatttggagtaagggaaagaagaaaataggttaatttcagatatgggctatgaccttgatgagagaggaaaagagagaaaaaaagtgtgtgtgtgtgtgtgtgtgtgtgtgtgtgtttgaaataacttatttaagtgtaataagcacagataatggtaaaaataagataaatcaggaataaagatgttgcctgacttacatgttttcaaagttaccatttactatctaacttaaattttctctgctgtaatgattatattttatctaggtaaccaatatctagtgggattatgcatcaatttactaaggcagttttttgtatttatctccaagtgaaatttaatcaatttctacagtagtgaaaagtaatttgaagatttaatatattcagtattttaataaaatataaactggtcaaatagctatgcttttttttttaaagtaacaaccaagcatttattcacttactacaaatagctatgtttacctctaataaccagttaagtctcctttagagtccatatagatatgcttttatttgtttttggttttttgtttttgtttttgtttttttttgagatggagttttgctcttgttgcccaggctggagtgtgatggcatgatctcagctcaccgcaaccttggcctcccaggttcaagcgattctcctgcctcagcctcctgagtagctgggattacaggcatgcgccaccatacccggctaattttgtatttttagtagagacagcgttggtcaggctggtctcgaactcccgacctcaggtgatccacttgccttggcttcccaaagtgctgggattacaggcgtgagccaccatgcctggcggatatgcttttatttgaaaagtaacagaaatttaaagctatttaaactaattatgctatacaataagtgtgaaatcaatttctgtttcttaagtaatttcttcatgagcatatcgtataatgcacatgtaaataacagctttgagtgtacacttatattatgtgagtagttacctgtatgacactgtccccaggtctcatgtctgtataaacatacacatcataggatatttcagggaaggttggcgtgttatcatttgcatccatcacttgaatattgacgatgactggctcactttcttgtacaccatcaaatgctgttatctttgggaggagaaaaatacacttagtagagatgttctgcaaatataagtagtacagagtttgctcttacagtttaacaagtttcttacaggtaatcttacaatttgaaagggtgcaaaaatattttgttgataaaaggacgtaatagagacgtaatattacatatattaaaagtgttctaatatggtaagaagcaagtattgaagattttgttttaaggtattcaactccaggcatattttaaataatcagatatgcaaaatatcatttaaagtgggccaataacattgctgactcttagggttaactacaatttaatccttaaaaacttaattggaaaatattatttgcatttacatattttgtatacaatagttccttgtacagtcaatgtgtttataccatcaggaaggtagacttcctagatgtactttgtatcacagtaattcacccaatggcaattttcaaaggactaagtggtatcatttaattgtgatattttatactttatcaatgttgataatgtatgttatactttatcaatgttgataatgtacattatcaagattttaacaattcctgccaaatcagtgctacagcaccaccatctttgtctaaatccactttgtatctaacttttaacaatcacataaactttcctggaagttctgatctttttctatgtaggcttctccagaaataatttctacatatcttgtttaacttgtgctttctcttagctcatctttctcctgtgactgattcaaaaattgggatataattagaagttacattttttctttatccaactgtcaaccctactatacttgttatttacgtgtttgtgtgcatgtgtgtgtatgtttatgtgtgtgtgtgtatttccctatctcatgataaatatttacaatcacaactttaataacctttactttttttcccccttgattagcctaacccatgatttatctacctcagtgctattgacaccttgggacagataactctttattgtgaggggctgttctctgtattacaattagcagcatcctttatgtctacctactagatgcctatagtaactaccccttcacaattgtgacaaacaaaaatgcctccagatgttgctaaatgttcactggagggaaaatttattccctcttgagaatcactggctcaaccttatgactaaataaaaaatgcaagaacaacaacaaaaaaggttaggaaataattctttatacctcaatttaagacaattatgactgtttagtaaagactgaaattctcactttcttttttttttgaaaagttttttcttctgtgaggaagaatgttaatatagctacacaaattacaaaaaaagagcaatacatgtaaataatttttcattgatcttctctctggtattgaaaataatgtatttttcccccaagtcattgattttttcagttttaaccagacatctctttcagttccatacaaacatacatacatacattcatacatacatatgtatatttacacaaaagctctttaccgaaaaggtgtaagtttgctgttcttccctgtccactggttgaagtaaggtgaggtagcgagtaataccagtctgtgtgacggtgaagactgaggtgtagtcattcagaaaaaggtgaagctctgggtcttttgtctttgaaaaaaaatgacatcgtttcaaacgttgaataaataatgtagctattagttcattacctagaagttaatgtttgaaatttatagcaaaaatccacgtgaaagtattaagaatttctaacgataaaagatatttaactagatatttactcaaatgatctaaactattcaaaagatggtgacctatatcgtggaatacaaaatactgaaatacaaacaggtataatcaatgtgggaaaaaaggaaaaataatagaaaaacagaaagaatataaaaactcccaattaaatatattcttactgattatttgttatcaatattttccaaaatagcattggactggagaaataagaaataaaagcaagaaaagaaaattgcatttcaaaattttagcaataagactttataattacttcatttatagtaataaactgcatatatacatattactatcttgttcttacttataatgcaaaatagaaataaaattggttatgtattattcattacctataaatatcatgcttactctttcttattttaatgctgtaaaattttccaaatggaaacatgtttactttaattaaaatatttcagataatttgatttaaaatatgcataaatttagcaaatgtgtctgatagaaaagtctagaaaaaatgatatatacttaaaaaggaagggatttcaaaattcaagtctgagagacaatcaacttagcattgaagaccctttgcaatttcattgccacccctgaaacagaagacaacatactctaatttagagaaagaacagcaatataaagtaagaaggctagcactgatgtctgcatagtaggaaagaaaggcaggtggagcgaagaaaaaaggaatattcagagagtggactattatgaaggctttgaaaaagagagaaaggagtgatacagggaggtaaggtgttgttctagattatactatcttttaaagtatgcatagcatgatatgaaatggatttaatatcataaaacacttctttaagtctgatgtcaaggactgaggcaagagcaaagaatagaaaattgttaaatgtgtttaatttgaaaataatagaactcataatttcaaaatttctatgtaaaatacaaaagttgtaatgcacactactataataaaatgtgaacatgatttgatccacaatatacttgaatctgcccatcttttaaacattgtgatatgtgtagatttcaaataaccttgaaataaatggtttcatttgaacctaaaacaagttatgtattcataatatctcattctgtagtagcttctatgttcaggattttgacttaaggtcactgtgctacatttatcctggaacaataagaaagtaatactacacataataattccaactggcgtatttattataaaatgatcaaaaatattgagaaaaagttcaagaggcttcacactctgatattttcaaacaggcacttcagttgtttccatttcagtgtcatgaacccaattactcagataactagaaagcgggatattctaaaaaatctaacatgttagttttaaaaataaattatgtatttttaaaagtcaattagaaaatgcatatgtctattctgaatgatattttaagcattcttattttacactttagagtgaattgtgattaaattcaattattagagttgataaaaaagttttagttaacatgcagtttcagtcaaagaaactctaagtatgaatgtctgccatttgttttgtgttcatcctggatttacctaatcactgggcttttaagcacatatacacttctctaaatgcaccaacaatggtgccatctggcatgccttaatttattcggacctttaaaccctaaatgcaagctgaggaagttttgctatgtaccttgtttaccaaatatttactttgttccttttgttcaaatctcatcattctctacttcctttataccttaattctctcaatttattttcttcctttcaaccgtaacctctgttaataaatttgttaggtatattcactcatatcttcacatttttaagcatttttgtgtgtcaagtatttcgataatgcaatatttcaataagtattgagttgtcaactagtgtgtccaaatgtgactgtagtataatatgtttgtgtcacaaagagcacttactttttaccactttcaagaaaacctctaggttttgtttgtcaaatgcttttcgtttgaagataatgcacacatcaatactccataaatagacttccttatattggataaacagaaacattaaagatcttttgttaatttaactgtctcagtttcttgagtgcttttataataactagctggagaaagataacatttcccagaactacagtgtatttgctttttgtgaagaagataatctatcacagaaagctagcactatacatggcatattatagctcattctgttttgtttagttaatctctgatcaaaatataacatttacatttatgtatatttaaaataataatcttgtacataaatgctactggtaaatatcctcgtattaatttaagtaaaaaaatttaggaagccagatttggaaatgttcaacaaattgtcactcaatgtttaataatttatattcatttttaaagatagtgcaagtttcaaatgttgtgtatatatttatgttccaaatattacagcatatcattttatgagttttatgaaaattttaagtaatatcaacataaaatgttaatagatacatatcagtaccaactaacctattgttttgattgacaatatttacagttcaaggttttgctacccttcacaagaaaggtgtatcaaaggtttggtaagaaacaatgtgcatttgaagtcaaatatccttctctaaatctctttataaacttaaattccttcttgtcaagctgcattccgatacagtttgaatttcacaaatatatttgaattttgcaattcctaaagagtaacttgagtcaacacttgtatatttgcaactcttttaatcatgttagagttaatagcttataagtttcatagactaggatgtacatggacaaataatgctctggcttaatattccaataggggtagcagactttaggtagctgttgtgtctataagtttatttaaaatgaatttaagtgttaaatcaataggtacacagagagttgattaaaaaccgttaattttcctctgacattaggtaatatttattttaccctaaaatatccagtcagtatataccaaaagtatgatatattaattcacttatctgcatattatattttgagatggtaaaataagctctgacatgcacacataaaaacagaaaaaaatgcaaaagtaaatgcatatgaaaacacacaggtaaacaaacatatgaatataaaataaacaagcattctatcatataaaactatgttcaaagatgagagtctactgtttaaacaccaacttggggtttctaatgggaataaatataggatatcacaaacacacaagaccatatgcatgcacatatataggcacatacaacacagacatgtatagacatatgtgcacatatatatgtatgcatatacaagagcatacatataaatgacaaagcataagagaaaaatgacaaaaaaatgttatctcctcagccagttttaattacttggtagtagttgcctgagtatttagttcaaaaaaattcaatttcaaacttacaatgttttagaaaaaatgccatgataaattaccaatgtttgttgtggactgagaaaacattaataattaagcagtctttgcctcagttgacaattaaatttggattttacaaaatttcatagtactataaacaatagattatgtaaatatttttaccttttttaactttaaaatatttttaaattttaaaccaatgaagtaagtatatttaaatttatataaagtatttgtagatatccttataagggataatgaagtaatacctacgtgttttagtgaagaaaaaaaagaacaaggaaataaaccacagcaattaacaaaagaacaatcacaagcttaacacctagtacctacaggaactccactgggtggaacctatacgcaaattaaacatgaaataaatattgtaaatgtaaatgatcacaaccgcacatatgaagaaaaagcaaaccacttccagcacactagactgacaatttttttcagagtatacaatttttttattagcattgtgacccacatataatggaataacgatatttatgaagcatataaatacttaactgctttatgagtatattgaattaaatatcaaagatacctcttcatagtaaaataacgttaagcagagaaacaaatttacatgaagttataaataagtatctttttacaagccaaatgagtaatctttattgattattattctttgtcattttttatgatcagcattcaataatcaatttttagcatctctgacactgaaaacctggtggtctcagacatgcctcttaacaccttgtgccttacctattctacttatattatgggttattttgaaattatgatgtggtacaagtactctaaaaggcataatgtataaactgatatggttcatatatgtatacatgcatgtgtatgtgtgtgtgtgtgtgtgtgtgtgtgtgtgtgtgtgtatgggtatatgtctacatctatatagcaataaaaagaacactggtgcaaatatttcttttcctttcttttcagtattactgtggcccttggaattctttctgacttaaaatctacactgtgaatactatcacaactcacattcctggctattgtttcttaaaatgtggcttcactttccactaaattaaagggagaaacacaacttaaattttacgcaaatggatccaaacttgtccccttcttggcatttaccatctggaatagctatgcttgaagcaactcttgagagccaagccctgcaatgacaacttccacttttatgcttgaggcttaatctctaatactatgctgatattgtatgaggtggcacactgtctctctcaaagagtttatccctataatgatgattgtcactaattctgacactcaaaagcaacaggattttgtttcattttgttgaattagggtcccaatttgtcatctagcctgcagtgcagtggtgcaatcatggctcactgcagcctcgaaccagtgggctcaagggatccttctgcctcagcctttcaattagtgagactacaagcatgaaccaccatgcctggctaagttttttgtttatttttgtagagactgcatctccatatgtagccaaggctggtctggaactcctggcctcaagccatcctccagcctcactctcccaaaatgctgagattatgagtgagccaccacacccagccaagagtggcatgatttaccttgaagtaaaattcatgcccataaactaaaatggctttaaagttttcttttcataatacagatcttttgaaaatcccagaaatgaactaatttactttataaaaataaatggtgctcggtctataaaaaacagatgtatcagaaggacataaatccatcttctaatatatgaatgactatttcatagatttattttgtgtgctggcaaatggaagatttaaggaataatagatgaattaaaagaaaactggtttcaactcagtatgaaaaacagctttctaagaattagagttgttcaaacatgggataggccatcttgtgaaatacttaatgcaacatcattagcatctttgaagcatctgttagataacctaattcattcaatagtgactgaatttatgagtttattgaagagttcccaaaccctattaagtgctggaaactgtgttagttcttcagcatacaaaagttgctaagatataggacctattctcaacagatgtaaactcatgagggagaaagacattattttcaagttggaagtatagaattagagaaatgcactgagggaggcatgcaactaaaattggataatgaataccgtggaaagattctcgaatgaaggaatgcctgaggtgagctctaaacactgagtataagttatccaagccagcctgtgcaacagatgaaagatttcaaagcctagaacatgtaatgagcaaacattagacaagatgtagcttggcacatgaaagaaacgacaagcagttgccaaatgttataggtgaattaggaagtttccaaaactcaggccacaaaaatgttcaggtatcaagatacagaaaattgtgtgagcttaaattttcttctctagaggaataggtgtcataaaagtatatcaaatagaaatgtgggccagacgcagtggctcatgcctgtaaacccgagcaaggtgggtgtatcacttgaggtcaggagttccagaccaacctggccaacatggtgaaacactgtctctacaaaaaatgcaaaaaaaaaaaaaaaaaaaattagctaggcatggtggtacaagcctgtaatcccagctacttaggaggctgttgtgggagaatcacttgagccagggaggcagaggttgcagtgagcctggattgtgacgctgcactccagcctgggtgacagagagaaactctctcaaaagaaagaaaagcaagggaaagaaaaaaaagaaaagaaagaaggagaaggaggggaaggaagggacggggggaaggaaaggaagggagagagaaagaaaaaaataatgaacggagagaaggaaggaaggcaggaaggcaggcaggcagaaggaaagaagaaagaaacaaaggaaggaaggaagaaagaaaaaaaaaaaagaaagaaagaaagagaaagagaaagaaagaaagaaaaagaaagaaagaaagaaaaagaaagagaaagaaagaaaggaaagaaggaaggaaggaaaaagagaaagaaaggagagggagagagggagagaggaaggaaggatgtagttagatgttagatttgagcttttgaataaatcactctaatggccctgcagaagatagacttgagtaagaaatcaagagaccaagaacatcaggaagtaattctaataacagaccaatagggtggtggttataaggatagagagaagaaaagagattaaataaataattaggggacaaaataggaagatctggaagatttcttagttgtggcgaataaagaaaacataaaaatcaagcaagacttctaggattctaggttgcatagcacaataaaacatctatcaatttctgggaaatgggttttaggagaggatttcatacagtactggaagtttaaactatttctaatattctatgagcttatttatattttatatatagaaactacatatgatatttttaaaaattttattactagaagactaggcatacttgttcactctctggacacctaatgacagtcactcaccatagattattttagaaagggggtgagtctaagtaataaacaaatgatcagttttgctgattaattacttgacacttttataaaagttatgaagcatgccaccctccatgtacatggcatcatctcagggaaattttctctccatgccctttcctaccagtcccaactaaagacacataccaaggcagcaatgattgctaccatatagatgactggacaagagggggcacctgatgagtatgaaactcacaatgttatacagctattacatgacagaaccaggagtcaagccaagatctgtctaaatccaaagcccaaactgccaaaaacacttcagagcatttcatagactaactggtactgtacatctccaagagttgaattataagtagtgtttctcaaaggttttagacccctgagctctctccactttatttcatcaatgccctgtgagtactactgtcttttacaaagttccttggaacacaattttaacatttgtaatttaaaagtgaacagacaatccagacaagtacggggtcacataggcaagcatagggcttagtgtgtaaccaatagataatatgaacacactgagaaggtataaatacataaattttgctattgtgtaaacttaaaactacctaactttagatttagatttttctaaccaccagttctattaaggtatgacctaagctatcatacactttcaaattgattagtcactacttaaaatatgagtatgtattcaattgaaaagcaaaatccgcactaaaatttgtgggacattagtagatctacaaaatacatttgctcagcctggattgaagttattaaggtgactctaggtgttttctagtggggattcagtagagacttttttcctgtgactcatgaaacccactatacatcagagaatccctaaattctcttgactggcatatgaaactgtgtatagattaatgtgttcacttttctaggaaaagaacctagagcattcttcagctatcattatagtcagactatgatcaaagtatataaaatatagagtgcttaaaattgagaactttgttttccataaaccttggcttaaggtccatttctactgtttactaacactgtgatcatggtaaggcatttaaactagctttaatatccctttctgaaatagggataattgcatctatcatgtttgttgtgagatttaagggaattaatgcaagaagaatttactgtattgtttgacatgtactgagaactcaatgacagatattgttaaaacttgtggtttaagaagacactaaatgtgagagaccaggaaagattgaaaaaaaaaaaaaagctagaatggaaaaagaaaacaaagcaaagagaaacaaaagaataaaataaagcatctggtgggaagaggtggagtgccaacaagaattgtcatagcctctgtggagtgttacaaaatttatttagaaagagaaaaaaaatctgaaagtgccttcctaatttcctgaagtgattataaagctatgtgtaatgagatattagggaacattctagagctctgctgccttatgagtgacatgtatttatatttaatttcattaatattaagcaaaatttaaaagttatgtttttagtccagttaaattttaagtactcaatagctgtataagactagtggctactatgttggacagtacagttacacagtaattccatcatcacaaaaaaatccatctatctgagagcaagcactgttaagggagaaatgaatgaatcaagaattatataacagcaagtaagaaatccaactatcttttacatatagttatgcttataatccaaacacagttgtatttacttgctgttttatatatatgtgtgtgtgtgtgtgtgtatgtatacctgtgtatatatctctatctatctatctatctatctatctatctatctatctatatctgtatgtgtatgtatacctgtgtatatgtctatctatctatctatctatatatatacacaaaacatatgtatacatatttatgcagtgaggatactgtggtagttcacaaactcaaaggaaaatctttgggaattagaatacctctggggaacttaaaacttaaaagacaggcactcaatgggactctcttttctgtgtgtatctctcaggcttcattctctcccactgataattggctttctcatgatgtcagcaaatgtggctacaaaggtttcagattcatttccacttctctaatacatgataccaaagtctttcagcccttctgttctccattgtaaattcctgggaggattctggctagcctggtatagattttctgtccctttataacattcactctggctaaggaggtaaagtgttctgatttgctcagcctggaccatttcccactcatgtagatagtgtgagtacaagaaaaacaaaagacaatgatttgtggagtgaagcgtaagcatccacatagtcactggcagaagtatgaatgggtcagctgcctcaaatatattttaataacgatgccctcagacttgaagaaaagtctctgagaatcacaatctaggggtgctttcatgattttttactcatgtagtaacaccattatttttgctttatcaataattatataaaacagttctcaacatatgttaataaaaatattgccctcgtcattaaataaacatcaagtaaaacattcattttcttacatatactgaatatctgcaagctgaaaaggaatagttattgaattcaaagatactttttaaaatatccttgttttggaattaaattataacactaaaactcacttacagtgacttaattctctcttctctagcttatgtagccatatctttgtcatatttcccattaatggaaatatgagatttgttacacaaacaagagcaaaatatgtatttaacttacatcttctatgtccttgtccagagctactattcttaaaggtgaagtcaaattgagactgtccgaaatggttgctcccactggggcagattccaggatatagccttgataactgggcattgtaaaatatggactttgattgttttcatccagtatttcaatgtgtagaccggcaaaggcaggaagaggatgaccattgtcttgttcagcctaaaattgaaaagaaaagaaaatatttagaaagtatatgtcgtgctatctttttggagtttcacttttcatgcaatatatagggttctctttttaactaatatcatcacataaggaaaaaatacgttaaagggccatttgaaaatataaatgaggaaatgaaaatccagtgaggcttaattgcttcagtcttctgttttaaaactcagtgtatattttaaaaattcactgtaataaattattattattttattttatgtttttattttttgagacagagtcttgctctgtcgcccaggctggagtgcagtggagtgaactcggctcactgccagctcttcctcctgagttcacgccattctcctgcctcagcctcccaagtagctgggactacaggcgcccaccaccacgcatggctaatgttttgtatttttagtagagacagggtttcaccgtgttagccaggatgctctcgatctcctgacctcgtgatccgcccgcctcagcctcccaaagtgctgggattacaggcgtgagccaccgcgcccagccaaattattgtaatttttattgaatgcagtaggagaggtaattgtgtttaaatacatttagtcagaaaattcaaatggagatacttgagtgtaccgctgataaaatatttaaataaaagaaaaaaagtaacacaaataaagaactatcgtatcgactttgtctcttctgtgtcttctcattttacactaatgtttaaatctctgctatggtctctgctgttgtaccccccaaattcgtaagttgaaattttaaccccaaaggtgatggtattaagaggtgtggcatttggaaggtgataaggtggtgagggcagagccctcattaatggggtgaatgcccttatagaaaagggtctagagggctccttttccccgcctcccaccacgtgagaacaagtaagaaggtggaaccaccctctgtgaggaagtgggccctcactagaaaccaaatttacaagagtcgaatgtccagcctccacgactgtgagaaataaatgttccttgtttataagccatccagtttatggtgttttgttattgcagctcaaagaaacgtagacaattcccaaataattcgtaattctatataaaattaataaagttatatttattgcccactgaccgtccccaaaagcttcttaaaaaggacagaaataataaatttcattgtaatgttgtagaaactgtgaattgcaatattatttaactagaaatgtttttcaagtaaaattaatattcttatgtataaattttcttttttttctcccattaagtttaagaagttgataaaaatttctgtttctaacacattttcatacaaaatctctacatggtcatgctgcacataggaaaatactaaccatagattttctgttttttaaaaaatatatattttattatatgtgtattggaaggtttaatttaaaggaagatttcatcacaattgacttctggaaaatctcctccaacttttatgagaaaacatggatataatttaatagcatatacatttattaaaatgaattcaaattctatctttaatttttgttatgttttccccattgggagaaaagttgtatttttaaatcaattaaaatgaaaataaaatatttgatattaaactctggtgtgattttctagatagatagtgacagtactttgtaagtagctcagctagagatctctaactgttaaaacgtgaggaaagaaatttggtctccagaagacaatttttcacttccttctaatagtaatttaacattttcatctgttaaaaaggtaggtaacaaactacagtgatattggtagggattgctgacttttcaccaagaaatattacaatatattttccttcatattatttatattgaagatttgttgaaatattatttatgtcaattactaatgtgaaattatgctaattaataaacccatagggaggtaatgtcatataatgcattgattaaaaaacttatatttgatttttaatatattgatatctctatttagataatatgctagattttcttagtaatattacatagtttaccttatgcatttaacttttcatttggcagcagaatgtcaaattagcccatggcacaaaacgctttaagatcctgctcagcactaagaagaacagtactggaataatgtttggtcctgtctgggattatgtatccatctcacataaccaggcatgctgctaataccatcagtatggatgaggtctttctgcatccagcagttgtgattaatttgtgccgagcgatggatgttcttttaggagttacccctgtgacacacatcaggctttctggagacagctgaccagggcaagaggtagagtctacgcctggaaaacattgttttttcactgtttaaaactaattggtccatatgggcttccaacccaatgaccttgaaatgatttaagcaggaatcctctgcttcactcttacaggctcagagcagttcatacatgcaaggcattttgaacagatttttttctctctttcttgtatctctccatctttctttaatatctaattattcttttttttttttttttttttttttgagacaaagtctcgctctgtcgcccaggctggagtgcagtggcgggatctcggctcactgcaagctccgcctcccgggttcacgccattctcctgcctcagcctcccaagtagttgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaataaccagcatgtcatatccaggacataaaaatgctatgaaaagtcataaattctacaacttttcctctttccccgatgaacacacccaaacacacacaatatataggtggtgaggaggatgaaaaaagcaaaattgtataataatgaaataagcttacattttacattcagatcatatatcattagtttttaccagcagctgtgaagccagtaaaaatatgtattatttgcatgatgaaaacaaagtgattcaatgaaaagagaaataaaattcaaatcagatctatgaagataatctaattcttaacttcctcatatctataaaaattacatataaaggctctgcccatttttactctaatattaatttagagttaataatgattaatatttttggattgctactatgtattttgttctatttgaggtgtttcaatttgctgaccagatatctgtctccaaagcccactttctttatgccatttatctgtccagatgtgaaaatgtgtatttttgaactgatggaaaaaaagaaaggttagttttatattcaaggccacataggctgtaagttacatacagaacatgggcccagactcaggtctcctgatttttaagaggctacacaggaagattcatcatatgtttctcaaatttacagaatgcaaatgaatatcgaaaagcaagagagatgggacaaattaacagtaggaaaaaatattgagataaatacttctgttaagtaagagttaaaatgttgaatttaaacaacaacaacaacaataataataataataataataataatatactttgctcgttagtgggcccatgcatcaaaactctgatacaattatcttttcttccatacaatataaataagggttctcaaaaatctgaattattctgttcccctgaaatccgtggtggatgaaatgagaaatattttaaaaacacctcagttggaataaggtggtattttaaaaatcatttactttcataaggtaaccttatttatatttacagagtctatagttacgagttaaacattatatttaagtgctaggttttgtttgaaaagcgtctgggcatgagtctcactttcagtaacgagaccaaagtaaaactgaagccaaaaaaaatgaagtataaaaagcacaccattttgttactttggaaggcaaaacattgaaaaagacaaaccactccatcttcaatattgaaaaaaggaaatactgataatttctgagcaccttgtaacggaggactgagactacagaataactttgttcttcctaactggtggcaaacaatttaacaatttcataatctctaatatgaaacctttcaagtagattcaacaatttaaaaaagacaatggtaaagcttatcaaattatttatcatttaaataaattctaggatagaagaaagaaatcatgttttccaggaattatttattgtgcatctacagagcccactttttttttttttttttttttgtattttaaattctgggatacatgtgcagaatgtgcaggtttgttacgtacgcatacacgtcccatggtggtttgctgtgcccatcaaccagtcatctacattaggtatttctcctaatgctatccctccctaggcccccaccctcgacaggccccggtgtgtgatgttcccctccctgtgtccatatgttcttattgctcaactcccacttcttagatcgcaagtgctcaccttcatctgtattcaccctcccaagttttcttaaacccacttcaatcatacttttgcctcagccactcaaagccagctgcttttgtcaaaatcaccggtgccttttacattgctaaaagcaatatttattttcagtccttatcttacttgacctatcttcagcattattcactatcctttcacggcaacagcttctcggttctcttcctattttactacccattttttctcattctcgtttggtggtttccccttttctcccctacttaattttggagtggcccagaagtgaggagttattcatcttttctttatactcactcccttgctcaatctagtctaatctcacaccttaaaaatgtcagtactattatgactcctaatttcaatctccaacctggatttctcctttgaattccacagtccatatccaactgtgtacttcgtaacactgcgtaagtatctaacagacgtttcagatataaatacctgcaacaatgaaattctgattaccctgcacgaacctcctccactcatggtcttttccacttctttaatggcagctacatagttacaggtaccgaaaacaagaaacttggaggcacctcttgcttcagtggatagatatggaaaaagtgaaaaccacttttttgaaaattgaatttgaagttccatcttctcatttcacaatacagtattagcagattatatatgccaagaaatattctatgttagtaaacttgagatgaaaaaatactcttatgtcaatgtagtgaattatggtcttatcctactgaagcattaaaggtaaatattgcaattttcaaagttaaggtaataccacattttaatttggataatattataaatttatgaaatatttttctatatttataatatgtaaaaatagaaatataatcatattgcttgtatagtaaattccactgttctatgctattgtaaacctaaacctttcttgtaattagtctgaatctcatttttcattagatttttaaattccatgagcataaacactgtaaatgtatcagtttcattcactgctaaaatttcggacaatccctggtatatggaagaaggtcaaatatatatttatttttacttttctgtatctttaattttaataggctttaaatatttttttaaaaattaagtgattgtgacatcattctaattcccattcgatagatatttatggatgtttttccagtgtgtgtgtgtgaacgtacacgaagtggaaattaattaatgtgaatgtacaacatgaacaccttagattatagaatgtctttattcacacattttaaaggtttgtgatatctgcaagtttacctatgggtaattaatactgatgcacattcttgccagtcttatgaatgggcctcacccagccccctcaatcatcaattatgattctatatctatagggatggtgctgtgaacagaataacgtataatcttctagaaggtttatgcatttacatgtaatatttatgcaaaaaggcctatttatatgcatttttgaatggacagtggcttaaagaatgagatgttagttgtgactttgctcttaacacatggcttagatacattttattgtcagaatggtgcaaattgaggactttagcatgattttgactgtgtgtactcttccagtccactcaacacattttaatttattaatttaatttacttgctttacttactgaactatagcttttaatacctagttcttagaacctgcttggccaattttcgcaaacattagatatcttaggaagagaaaaaaaaaagagggagggaggaagaaaaagagggaataaaggatggatagagggagtgggtaaggaaaacaaatggcattctcctttcaccagaggtaagggacagataaatgttaaaaatcatggcaaccacacaaggcaatcattctcaaactctgatgtacctaagaatagaatggaaggcctaataaaaagcagattccctgggccaggcgcagtgtctcacgcctgtaatcctaacactttgggaggctgaggcaggtggatcaccagaggtcgggagttcgagaccagcctgaccaatgtagagaaaccctgtgtctactaaaaatacacaattagccgggcatggcgctgcatgcctgtaatgccagctactcgggaggctgaggcagaagaatcgcttgaacccgggaggcagaggttgcagtgagccaagattgcgccactacattccagcctgagcaacaagagcgaaaccccacctcaaaaaaaaaaaaaaaaaaagtagtttcccacaccctatccacaaagattctcgttcatatgttgatgttagaggcaaggaatctccatttttatcaaactgtctgtggtggttataatgtgagcagaatgtactttcacagacattattctgggtgtggctactcaaactccaatttttagagaatctttctttttagccctattggttagggctattggttagccctattggttagtggaccagtctttactaatggatagtccttataatctggagcaaaaactccagataatacagtgcatccaagagccaatgttgtcacgccagaagatttggagtctagtaactgaaactgcatgcaattatacaattatcaactgtgtaggttcaacaccactaaaattgtcatgtgactctagcattaccaaagattgctcgtgtgtcagtgggaatactctacaagtaataagctcagtcttagctagtattcataggtcatggtcaaatcctcttgacattccattattcataattaattagaatttaggtatgttggtgtatgtgtgcacgtatgcctgtgtatacacagtatcaatatagttttgggtgtaagccaccacttttactttatcatttttaaataaaggaacctcagattgagaaaaaaagcagagagaaggtaatttgacatacagaaagtttttggtttctagtcagagtcagagaaagacaaacgcatatagaatgtacccggaaggcagataatgacaacattctgagtaatagtatattcctgttgctagtgactaaacataggatataaggctactatgtaattcaaaattttcttcttcctgtgttcccttcctggacaccacacctcttgctaaacagctcttcagtaaagccttcaatatacaagggtgtaatttttccaagtttcttcacccagcaaggtgcaggctgcatattgatctttatatgaggatgattctgaaaaacgggcaaattgaccgaactaccaatgattcacgcatatccctttattcctttattttcaattttaaattcaactctcaagtagacaaagaagattgtttgctttggttaattttgctggagggctaaattatatatcctgtctttctttatggatagaaattgcatttgcttaacattttaaaaatcactttagacagttaaaatatgtttacttaagctttcaaccaatttattttttggcaataacaatattattagtgtataaccttcaaatagcctgacatttggacatgtttgtcttgggattcaaacgtgaattacttgtacttttattttgaaatcaaaatgttaataaaagtctcagatttttctttagcagacaattcattgccattgaattttttcacaggtggaaagtatatggttgtggaacatatacatcctgagttggttacagtacagaaaaatagaaggaatcataaaactcttaagaatctgattaaaaacatcaacatttaatccaattataaagtgttgcaaaaaaaaaaagagaaaagtaatctatgctgttagaatcctatagtggaagtttgtggttgtgtcaggtggaggtaaggtgattagtgactaggaggaggtgtaggaggcgtatgggatgtttgtagcatctttttttaacaaaaatctggttgttagttacatgattaacttcactctgtgaaaattcatcaagatatacactttcctgtatgtcagcagcatgtcagcatttcaataaaaatgttactaaaaaaataagctatgaacttgctccccaaaaaagtgtacatagactatcccttcctctcctatcacagtaaactaggatacgggcgctcaagtccaagtggtaatttaatagcagctgccctaggaagtgacatggaaaaccaacattatgaagatacgtgaaaattaaagatgctcccctcttcaaccatctgtgttcattaaagatggaccccaaaagtaaacttggccttttgcactttcccactaagtgtttcccaaatactgtggtttccaaagccctgcttcttatctgctgccttaaaataatctaaggtaattgttaaagcaaattcccaggggctcaaccaaaatatctgacatgtatctgctgtattgcttatttgttttctttattagtttaattttatcatatcttcctaagttttcaagtaattttaatatatgacttgctctcaaaatttagcatccgaaaatcacatgtaaatcttgattctgtagggagagccctgaagtctgcctttccaaaacagccacatcccctggtcctggatatgtagaatcagtagtcgtttgggatcagttggatcaggcattttagcttctctcacacaggcttataggtagctgttacactaaaaaagcctagggtgagcagctgaggccaactctgttctagccttttatgtaagtcattatcactcttcttcactttcagcaaagtctcttaatttggacttagttggaaactgaatggaaggaattcatttatgtaagggaattctctgtaggatcctgcagctcactgaagctctacaaaagctataggtccaaagcaacagtaattggtaacaggttatcaggttatatttcctttgtgtgtgtgtgtgtgtgtgtgtgtgtgtgtgtgtaaaatgtcttagggagggatgactgtgaataacctgtgctccatgaatcaatgaacatattatcaactgactaaaaattattaggtttttgccattaaaagtaatggcaaacaccacaattatgtttgcatcatcctaataaaaataagaatatcccattgattcttgaccctacttataaaattaactgccttaaaacctacaggagcctccttttattcaaaatttaatactctaaaaattaaaggatgcatatacagtttgactttaagccaatttattactattactaaacatactcaaaaacttataaataaattcaaaaacctataaaattcatgagataaaatacaaataactgttgtatgctgtaaagtttgtttgcaaggctatacagcaaaagagtatattcttggttggaaacaaatacctttttttgtatgacaaaaaggaaaagaaacttcactagatagaatataggcagcacatattttataaagccttgtaatataacgacgaaataatactgacacatttcacacctagggaatatttttaataaaacgaaatactttctatcttcacttcaagtaagaatatgcccattctgtttataacttgttacaacgaacacatgaatcctcaaagctcttgtatacctttcaatgataaaaatctttctttttgcttagagcatgagatacaaatcgacactggaatgactaaaaggattttgaatgatttaaagaaaaaataaccttgccactctggggaagaccacagattctgaaaactctcacttatcaccgacatgttgaactatttagctggtgtttggaacgtgagaatcatcttgggtataaacagcaaggtcagccagatataaaattctgatagtgataaaggggtaactttttttctgtgaatcttccaacttatgttttatttttattattttatcctgccttttgccttccaaccagcaaagccatcttatcctacactgaggtctgatcccattcccagttttttgtcaaccaagagaaaaccacactaaagtaccttctatgaattagccaaccagaataatgtattttgtaataagcaaattttaaaaaatcattaacataaaaattatatctaaatcgtttatttttcagagcctagaaggtattgagggtgagaggtcaatatttctcctccacctactggaccgttcttgagacaaaaaataacaaagagttttagcctacaagtttttcaatatgctctttcattgttatatttctatggaaccaagaaacctatgaagaacgattactcgggaacatatgtgatagagtgctaaggatgtttatgtgtgtggggattgcagagtggggagacgtgacaagggttcagaaagtgcctttcctttgaacattttacaatgtttggtcttgctcttgtactcttacaatgacctttgcagacaagaaggccttggcaaaaagcaaggtactctgatgagaatggataaattgcctttcttcttcccaagcagttacaggtcaccttgtgaggaagaaaaaaggccaaataaaatgtcacctctgtgtgtcttttgtcagtttgtgctttttgacagccactatattcaactgctacattctatttctgttctaacactgctgcatgaataacgatatgagacaagaggacatcatacttcctttccttttattagcttccataattggcataatagttaattaatttaggccagtacttagaattgttagagacaaaccagtggaaaataaaaacacacggtgttctttctgaagaaacacaaatactgttttgttttgtgtgtgtgtgtatgtgtgtgtgtgtgtgtgtgtgtgtgtgtgttttggtattatttattatttcctagtaatggtagtgttgctcttcggcaatatttttgctttgattaaacttaactcattaaaacaaaagttgtaaaaggtaaagtttttagactgacttctttttgagcttctacatcctctgtgatgtatctcagtatgttatctgagtcaaattgttgctgttctcatgatgtgttgttggatatggtatcaggcaccctgtggaggaactctctggtgggaggtggtgtacaacgtcacactgtagcagaaaacctgaaggatactcttagctgccttctctggcatttgatcccttagttctatccaagtgtatcactttatccttaggcagattaaatttcatattatacctctgagctcatttacttactctgttacacttaaggtaaaacagatatagtcatttgtcttaaccattccctcttatttagtgatatgttcaaatttcctaacataaaggcttttcttcatcattaattagaagcattagtgatcttatatagagagtctcgtggaatatagttttctcccaaattcttcttggccctccatttttaagccagttgataacatccccttttgttagttggatgctatgacatatcatgacaaaaattatgctttgtgtggcaatctgctaagtttaaaaaaaaggagaacacaaaattaaaatacgaacacttagtgtatcaaaggtcaattgatttcagaaattgtaatatttgttggaaattcatggaaagattgctatttcattactaataacaagtaatgcctgaaatttctgtggggtgattttctctaaaatgtgtaagagatatttactttgccttaccttagagacctggctattggggtagaaaagataaacttattatattatttagtaacctactgaactgaggtgtggtgtgcaatggacttaatatttgtatctctccaaattcatatgttgaaatcctaatccacaatgtaatgcaattaggagaggtaattaagtcatgagaatagaggtctcataaaagtagttagtgtccttacaaaaggtaccccagaaagctctctcaccctctcaccctctcatcctctcatcctctttccaccaagtgaagatacaaacagaatttggcaatctgcaacccagaaaaggaacctaactagaacccgaccatattgagtatgaaattccagcctccggaagagtgagaaatatatttctgttgtttataatccacccagtcttttgtactttgttagagtggcctgaactgactagtacgtgtctgtgtgtgtgtgcgtgtgcgtgtgcatgtgtgtttgtgtgtgtttcattcttgccataagaataagagtaggaatatattgctagaatatttccagatatagaagatatgtcatttgtagcatttgtcttccttcttgtagcttggcaatagcagccctgatgttttttctcttgtcctaactctgggtcactatggaccctgttcaacctcaccttaaaggagtgccaatcgtttccatctcttgtctttttttttcctctctctctctcttttgtttgaaaactgatgatatacacattagagtagaaagaatataacttatatttcacatctccataacagatttaattaattttattagctttttcattttcacggtaggttccatctttttcattttgagaagtgatgactgatgatctttgacttgctactctgcctgacttagacacctgtgatctttcaacttgacaacatctctgtgggaaattcaggtagggggcaaattgtaaattggcttgaaggcaacatgcagcagcatgatctattttttgttgttttagcgatactctgttggcagtgtgaaaagatggacaagatgcacagaaatgaagcatgattttagagactgcttgtgtaagatcatgggccaagagaatgcgaaataaagaattgcagtagatgagcagagttgagatattcaagaggatttcaaaggtatcaggaagggattctatgagtgactgagtgggaacatacgagagaagagacctttgaggaagtggaagtgtctagcttgagtgggtgaccaactaaaatatgattaactgaaaaagggaatagaaaatagaaggtttggaatttttaaaggatgtatatagtttgctatatttttaatttgtcacaattaaataatactaggagtagttatccaaccaataattgaaaagatgtccgtaggcatcagaagtaaaatatgtctcctcagaccaagaaaaatgccaggcacctgagaagcattcaacaaggattagggaaattgaaaactagcaaatgtcatatgctttaaaatcattgaatcagggtgttctcttaaatttctatgaagtaaaatatgatttttatcattactcaaatagtgactaaacattttctagagttatgacattagtgattcatgtagggacaggggttgtagtagctgtcctcctcttagccctcaatcatttctcaaatgctgttttcctgtaactctcaaattactgaaggatgacaccttgccagggcatcaggcacatcagcactaagaatcaagctcactagttttaattccctggctaattttctatggcaaatatgtaatttttctttagaagaaacacattttttgacgcagtcataagtagctttagttgtgccataacaaaggtgtgacattttttctaggcattgaatttatgtggaaatctatttgctacatttgcatcttttttttttctggacagagatgcaagatcaaattgtatcaaatgcacacacattcacatgtaagtatttagatagagtgaagacgtaggtacacagattcagcagtctgaaaagatttactgtgccagggagaaaataattacaacaaatgtttattaagcagcttctatgtgctgtatataggtaggtgtaggggcatgggatgcagtgtaaataaatgttttgcaatctgccctcctgtaaaagttgggagaaaataaacaggtacattcaatagagtaattggggccactttaggggccaaaaggctgcaaaaaagcagcttcctaacagtggctatgcctttcgagggcaaatgtcttcttagttaaaaactgaaacatcagtttgaattagactgttgacaagaagagggaggaatgattcaggaagagggagagtatctctaaatgcttagatgtcagaaagagcatggtcagttgagggcactggaagcggtttagtatgtttggaacagagggtgtgcaagttaactagtgagagctcagggttagtgagctcatgagttggaaggaaaagaagttaaaaggcagcatgctagatagaataagtaggtcagtgagtaacaacatgaaaatcagaggaaacatgaaacaattatgcttctaatttcattgtgatctttgctcttcgttgttaattaaagggatttagattaaaacatgcaattgttatttgaagaactgagagacagtaaattattcaaaatttatccatttaattggccttaataattaatgactagtagctttgtattagatgcctgaagtataaatatatcaactaataatacttgaaaatatttcacttacaatactgaaagtgattttatggactttgtaatagatggtccacacgtgaactaattcactcttaccagagttcttaaatgtgctttcatatttttacatcacaggtggtttttattttatgagtgtagtgatcaaataacttatccaaactgggacatttaaaagagcaacagaggtattatgaataattacacaaagacaatggacataaacatgtactgccctgggtaaaccaaatctatgattcttgttcacagtgtatatcacattttaaagtatgcttaaatgattacaattatataaaatttaggatagtgttttggaatggaacaaactttttcaactgcatgttttaatcttttcatagtctaaagtttgtgaactattccattttgtcttccaagttacacctttacatttttatttgtcagcatgctgaataaatcactgggagaaaaagagaaaaaaatgaacatgagaaatctctaatttgtggcactcaccagctgttaaatacacacatagctttttaaagcagaattcttcttcaaaatgtaggagaagagacttcattttattttttctccgcttttgaaacataaattgggatctagtccaacaaaaacttttagggccaatgaaaaaatgaagtattattaaagtaaaaagagagagagagagaagaaattgaaagatttactatagaggagaactgccagattgtagcatttcaatggtcccctgaacaatgccacaatactcagttattattcaagcaggtggcacattattattacagttagatacctttgcttattatgcccttgacttcacacaaaacatagtaatttgaatctaatattgtctgttaaaacttccattaataaaagaaagtgctattaaaacaaaaaaaaaatctgtggcctattgtaattgattttttttctgtaattgatggactgagttacactgtacccaggtacaccaggacagctgaattcgataataaaggaaaataattgatttttggtttcacatgtgacagtttggaaacagtgctttgtcaaatttcttaattcccatagaaagcagcaccacaagagtcaggtagatccacaatagaaaatcagtacacattgtggagttttatatactctcataataattaacataaaatagtcaatgtaagaaggtgaatctcatgcatggccatttaatacaactggttaaagtggtgttttttgttgaataactcccaaacccttaataaatgaaatcccaggaaactgtagtcatccttcaggctctctccgtggtctgacgctatacctcatttccctgttaactgcttgtagcctgtgcattatgtctccaagcgtttacttctgtgcctccttatgttcaaacatcatttcccacttttattcattgaccatactctttcaatccagcaacatttagcttggggtgatctccagaaaatcttccctgagtttccagattaatttaaatgtccctattctgtgtgtcgttaccgctttttacacgtcttcctcttagcatttgatgcattttatctgatttatttgattatatgactgtttccctttctagactataagttttttcaaggacaaagatcgctgaataaacacaggttctgtgctaaggacatatctattaattgttaaactagacaaccatttctaagtatctgcatatttgtgaagtgaaaagagcatggctttagcgtatataaaactaaatttgaatctcaactctgccccttattagtaatgtaactctaaggtaatcacttaccttatccgaactttagtttccccattttgtgcaaatgagaatattactaaaattgcggcaacagttcaatgaaaaatgcacacaaagcagcttaaacaatgttcattctcagtaagcttccctaccttacttccttttcctttagtatgtttacatttttcaaaaggtaagaaaaataccatcgggatgcatttctagaggttttttttgcatgcttaaatatgagagagttatgtactatatacaaaacttatgctgaatctttgcttttgtcttttcttgtacttacaatgcccttttcccagtcccatctctgcctggcaaattcctgtttttccttcactgcttagattaaatctcaccatctcaatgaagtccatcgaaattaattagaagaatatctgcattttttcagtatctatttaatgattatattaaaatatagatatactattaaaccaaaagtgaaatgccaaatagattagcttagctttgaattatttcaagtctaagatcatctttcaatataaagaaaataatgagacatatattgaaagcatctttggataggcaagacctcttatttttatgttggaaaaatcattaaaaatacattagaatacaattaagtaataaaaatgaaaacaaaattaaaacaacatataaatcaagcacattttagatgtcttaattggtcatgtttttgtggtaaaacgctaattccttttagtagaaaaataatgttagaagacataatgaattgtgtagaattgtatacgcttgaccaaggcatttgttacatataagaatatttagtattttaccccatagtactataaaacgttattttagagaaaagcaatgccatgtattaaaagtgggcttcgcttattttctttttaacaaaaaattgactgactgctgtccacattaattttaattttataacataaaactgcctacagtagcgtctacagatttatctgattagcagttcataaacacaaggaaataagatattagcttaatttaccttaataaccaaatcaaatttctggtgaaagtctctgtttactggctccaggagactaagttctgctgtcctaggatgcatatggaaaaatcgtgggtaatcctcaggagtccctggaagacattgagatttcagtacataattgagaacaataagtaatatgtgtatctgctttttctatttcccttcatcagctgaggaacaaagctacaatttcattagtaaattaagtttcacaattatgcagttcagggaaagcagacacaaatgtggtatatagttattaataattagcatatcagtaagaaaatggaaaatgtttggatgatttttgaaattttttttattaagagggctctaattaatttgaatcttcatcacatgaaaatagacattaagtggagggagagtaaattttttattatgaaattttattttaatggtgcataaatcttaattataactgtttggtctttcaacatatattgtaataaatgattagtaatttgtaccaaatagtgagatgcttggaaattaatgtgaacatattttgttgcatatattatttcttaagattaatatcaagctaataatgttaatcatagtaaattaaatataggttctgatgatactcttaatgtctacacagggtatttatttatgtatttatttttgagatagagccctgctgtgtcacccaggctggagtgcagtggcttgatctctgctgactgaatcctctgccttcccggttcaagtggttcccctgcctcagcccccaaatagctgggattataggcgtgtgccaccatgcctggctattttttgtatttttagtaaagaaagggatttgccatgttggccaggctggtcttgaactcccgacatctggtgatacacccacctcagcttcccaaagtgctagaattacaggtgtgagccaccacgcctagccaagatggtatttcttaatgtattttaataatcaatatacatttcttcatgaagaaatgtcttctaattgtataatcttcctttgtgtactgcaacattcttttcccaaaatgaagaagtcaaatcataaaattgtatagtatatacatttgtaaaattaataaccataagagaaaaataatatagcttcctattatggaaacctactctgtgctaaatgctttatataactaatcatcaataactaaatcatttacattttacagatcatgacttgggagactggggagattaaatgacttatttaagttaaagggacaatctgaaacagagcttttattaaaaatccaggctgccagatgttaaaacacatccaaaaaggggcttattgttactacttattttcctcaactctgagacaagaagggaaattctactgggcagtaaatgagggggaaaaaaaacagaaacatatttcacaccattaaaaccgactgtaaaatctacaaatagtcaaaattatagatgaaatgcaatatatgataaagaagttatccctcctaataggagagtcatacagaaaatcatagagtttcatacattcttcatggaatatacatgagcaaaccccaaatgaagaagatattcataataataaaaaaatgagcactagtcatagatgaaaatgtggataaattttactctaatgtgagagtgagcaaacctttcctaactatggctcaaagtcaagaagtcaggaagaaaaagagataagtttaactatattgcaaaattgcatggtgagacacaatgaacaaagtaaaaccacaagtgacaaactgagaaaacatttgaaatttatgtcgagacggccgggcgcggtggctcacgcctgtaatcccggcactttgggaggccgagacgggcggatcacgaggtcaggagatccagaccatcttgcctgacacagtgaaagcccgcctctactaaaaaaaatacaaaaaattagccagcctggtggcgggcgcctgtagtcccagctacttgggaggctgaggcaggaaaatggcgtgaacccgggaggcggagcttgcagtgagctgagatcgtaccactgcactacagcctgggctacagagtgagactccgtctcagaaaaaaaaaaaaaaaaaaaaaaaagagaaatttatgtccagacaaaatgttcatatcccgaatatatatatataggtttataaattagctaaaaatagggccagtgagggatttaaaaagtgtggggctggctcggcgcagtggctcacgtctgtaatcctagcactttgggaggctgaggtgggcagatcatctgaggttaggagttcgagaccagcctggccaacatggtgaaaacctgtccctactaaaaatacaaaaattagctgggcgtgatggcgcacgcctgtaatcccagctactcgggaggctgagaaaggagaatcacttgaacccgggagacatggaggttgcgtgagctgagattgtgccactgcactccagcctgtgcgacagagccaaactccgtcacaaaacaaaacaaaatgttcggggctagagaaaaaactgttcacagaaagagaaaggcaaatgactctagatcataagcaaagataagcaaagatgcttatctcgatacataagaagaaaactacaaattattcctacattaagatttcattagtcacttagattagcagttgtcccagttggagactgtactctgttggcgagcctgcaggaaaacagacactttggacactggtggtgttaatacaagtgttgtaaaatttatgaaggagagtatgacataagctaccaaaataatattaatgtttactttttgacccatacatcccacatctggacattttcccatttataataacggaagataaatgaccacctaaatatacatcaatagtggtctgggtaaataaatggtgatacatcctaaagcagatgataattcaaatgtaatgataaatgatagatatctttagctattactatggagttattttcagctatattaagtaaaaaaaagcaatttggaaacaagggcctataatatgctaacctttaagaagaatacacatgcatatttacaaaggaatacatacacacatttaaaaatcgaagatagactgtaacataaaaaattgttacttatgagaaagagagggaacacgtggagaggataaacactgaaactaaatttcattacccatatcaagttttttacattttagagctacatatgttatatattattataaaactaattaaattcaaggacttctctaaaaataaaataaaataattcaatctaaatgtatatttagttgttggcacaagcacaaacaaaaagaactaccccaggtgaattttaaaagtagtactgacatcacacccacagtgtaatataggtgaagtaccagagaaattacaaaactcaaaaagttaagctatctacagtaatcatattggtggtatgttgtgattccaagatagttataggagtattttacaataaataagcacattattatgtgtcattctgattctattcttttcagtattgaaagctggattcttggcaggggatgataaagagatagaaattaaaaattaaagaggtaaaatagaacacctatggttttgattttgaattggcagtggaagtttaaactcaggttgtagtttatcttaagaaacaaaatgcatacaacacagctctgaatgctgaaacacagaactatatataatggccaatatagaagcgatgaatatttctaatgttcagactatggttttgaaatactatttaccaataaaagcacttaagatttctgagagagagagctgatttcaggtccagggcagaaaatcaacaaatagctgtgaaacatctgctcacactaagtagcaagaaagaattccgagactactaaactgatttgaaaagttttcaagagccaaaaggcttttttttgtttttttgttttttaagctaaagataagacaatttgagcatcaataaggatcatatcagtaatgatttgaaacagatcaaatatgtttaaattcataagtttacgagtgttgcaaaataacgtattgatcacttttggagcatgctagagaaatattttgtaaattagaaaataagaaaacagagcatgctttttccatatgagcttaacatggggtaaacaaataattgattaaaaagtgtctcattaagaaactatttcagctaataatttaagaagagtaatagtatcagagtgccatcattttacaacccctcataaatgaatggatcatggcattgagcactaaatgctgctaatatcacaaaaaaagagataaagccacatacataccactcaatagaagaattaattcaacatcatctgctatggcctgagttgtccccctcaccattaacaattttatgttgaagcccttactcccaatgtgaccattatagagagatagacccttttaagaaggtaatcagattaaatgagtctatatgggtgggctcttaaatctgatgggactggtgttctctttgtctctctttctttctatctcttccctctctctctgtccaagggcacacagaggaaaggccatgtgaagacacaagaaagcagctggagaagcttcatcaaataccaaccatgaaagcaccttgatctcaggcctccagaactgtgagaaaacacctttctgttgcttaagctactcagtctagggtgtttcttaatggtagtgcaagcagactattataccacctatgaaacagttttgagaaaacccaacaaagaaacaaacaaaatatgttatttgattaagtgtcaaaatttataggaaacatgggacagagtaacatgtaaaattaaaccaaggaaagtacaatcaagatgacgagaaactctataatataaacaacttgacttctcaataaatgaatcacaagaaaacaatttaaaaataaatggaaagagaaccactgtagattaaaagagacttagggctgggcgcagtggctcacgcctgtaatcccagcactttgggaggccgaggcgggaggatcacaaggtcaggagatcgagaccatcctggctaacatggtgaaaccctgtctctactaaaaaaaaaaaaaaaaaacaaaaaaaaaacaaaaaattagccgggcgtggtggtgggcacctgtagtcccagctactggggaggttgaggcaggagaatggcgtgaaccaaggaggctgagcttgcagtgagctgagattgtgccactgcactccagcctgggtgacagagcgagactttgtctcaaaaaaaaaaaaaaaaaaaaggagacttaggagaggctgggcgtggtggctcatgcctgtaatctcagcactctgggaggccgagacgggcagatcaccaggtcaggagatcgagaccatcctggctaacacggtgacaccccatctctactaaaaatacaaaaaaaaattagccaggcttggtggcgggtgactgtagtcccagctactcgggaggctgaggcaggagaatggtgcgaacctgggaggtggagcttgcagtgagccaagatcccgccactgcactccagcttgggtaacagaacaagactccatctcaaaaaaaaaaaaaaaaaaaaaaaagagacttaggagaattatcaatcccaacgtgtgaacttacatgaattctggtccccttgcatctctccctttccgagaaaaacaaaaacaaaaaaacagaaaagaaactaaaaaacaaaaataatatttgtgagaaagtgaaaataaacactgactgatatttaatattaaataaggattgttatactttttatttgtgctatgatattgtcagaatgctctaaaaatagttattttataagcataaattcaaatatttgtggattaaaattatatattttttcaaaataatgaggaaaaaaattgatagacatatatattttaataagtttggccaagtcttcataattcttgaaactaagtgatgccaaatggtgattttatttactatctcttattttatatatttttaaataagagttttcaaaaatgcaatataatttatcatttgctttggtttgcttttaccctagctttcatcagcatagaatggagcagggctcctggaagaatgaacccaaaatggtgaagataattgaataatagccgctgagctgggaaagattttcatttcccagagagtaatacttactagctgttaactagttactacggtgaaaatgttataatctctttatttgtaaatgatctatctcatctaagtttcaaaacaatcttatgggaaagatatttattgcttgatctgtgaagaaaccaacactcacagaagttaagtaaaatattctgaactctcacggctagtaaatgactaggtcagaagtcaaggtatctaaattcagagtgtaaactctttcctgttatgctatatagcctgagttcagtgaattagacactttggcttcatcggccatctgtttctggaaggttggtttttagacatccttacagaatatcaactcaacaagagtataactagcaattaaaaaatacatctccttagcactttgggaggccgagacgggcggatcacgaggtcaggagatcgagaccatcctggctaacacggtgaaaccccgtctctactaaaaatacaaaaaattagccgggcgtggtggcgggcgcctgtagtcctagctactccggaggctgacgcaggagaatggagtgaacccaggaggcggagcttgcagtgagccgagatcgcgccactgcactccagcctgggcgacagagcgagactccgtctcaaaataaataaataaataaataaataaataaataaataaataaataagtaaaataaatacatctccttggacaaagagtaaaaccaagtgaaatttatttccctgcatttcttaaaagtgtaatgcttttccagcgaggactaagaacacttaatgtttgtgctttcattatacacaatgtttacagtcaacctaaagctgttctttagaaacaaaaaattagccgggcgaggttgtgggcacctgtagtcccacctactggggaggttctttagaaacagctttgattgcctaaatttagatgtaaaattgataactatgtttattatcacaattataaataatacggtgaatttcagcattataattattagagccaacataattagtggttgccaaaacatttattttaatttttatatatgctaagaaaattctacgtttttcactttttcagtattatagaggaaatggcaacctaaattaatcccttggtgaaaagtttacaattttgaagattacgggttttctgtaggataaagaaaaaatgctacacaattatcttcatatatttaaaatgtagaattttaattacacgtgttgatcaagatagtatcaccatgactaagatagtaagcctatccataattgccagaaatttccttatgacaatgtctcctttctctccccattcatatttctcaccctatgcaaacactgatcactttctgtctgtcagcataataggaatgggatcatttatatagtatgtattcttttttttttttttaattttgagaaagagttttgctcttttttctagtctggagtgcaatggtgctgtcttggctcactccaacttctgcctcctgagttgaagcaattctcccgcctcaacccccagagtagctgggattacaggtgcccaccaccacgcccagctaatttttgtatttgtagtagagacggggtttcaccatgttggccaggctggtttcgaactcctgccctcaggtgatccactggcctcggcctcccaatgtgctgggattacaggcatgagccaccctgcctggccttacagtatatattcttttcgtaggtgtgtctggcttctttcaattagcataatgattttgaagtccatgttgtttcatttatcaatagtttatttatttctattgcctaggtgttattctattgtatggatatgctacaactcatttatctattcatacattgatgaacacttgagttgcctccagccacaaataaagatgctatgaactttcctgtatacctctctgaatgaatctatgctttcatttatcttgagcaaatatctaggagtggaatggctaggccatatgatatgtctatgtctaaatgttttattaagaatttttgggcagggaacaagtctgttaattttcagttacgtataggtttgtgtagtcaataccacaatcgggatatagaatggttttatgatcaaataactactttgtgttttccttccccaaagttaaatctttagcaatgactgatttgttcatcaccaccgtactttcatctttttgagaatgacatttagatggaattgtgtagtataaagatttggagactggcttctttcaactcagtataaagcattagagattcctccaagttgctgtgtatcaataatattatattttcattgttgagtaatgtttaacttttaaagaaattgccaaattatttttccaatgtgtctgtaccattttacattcttaccagcaatgtatgagcatttcagatcttccacattttcaccaacacttgatattgtcagtcatttaaattttggccattctggtgtgtatgtagtgatattcattgaggtattaatttgcatttcccaattagctaatgacattgagcaacttttcatattcttattttgtttataaatctgtaataatttgttaaaactttctgccattttataattgtctcatttttattaaattgtgttttcatatattccccaaacaagtcacttgttggatacatttcgcaaatacattctccttttctgtcagttctttttcagtctattgtcagtgccttttgaaaagcaaatgcgtttttactttgatgaagtcaaattttaaattttttcttttatagatttgcatttgttacatttaagaaattgttgccagccgggcacagtggctcacgcctgttatcccagcactttcgaaggctgaggtggggggatcacctgaggtcgggagtttgaaaccagcctgaccaacatggagaaaccccgtctctactaaaaatagagaatcagccaggcatggtggcacttgcctgtaatctaggtactcgagaggctgagggaggagaattgcttgaatctgggaggtggaggttgtggtgagccgagattgtgccgttgcactccagcctgggcaacaaaactacgtctcaaaaaaaaaaaaaaaaaaaagagaaattgttgccaaccctaaggtcataaaaatctttaccaatattatcttttagatgctttatagttttagctcttacattatgtatagaaagtctttcaagttggtttctatagatagtgtgaggtacggattgaagtttatttgtttacatatggctgtccaattgttctgcaatgttggttgtaaagattaacttttccttcttttaattgtcttttgcttcatattatttttgaagtgtttataccttaacagttttttctcatagctgtatttgcctatcatttattagcataatacttctgattccctacatatagtaaattgaaggaaatgtggatgcctgacctaaactatataattaccacttaatctttcaataatttttatttagagcaaagaatcagaagatggatgtacaatctgtaccacaaaaataatgggcatctagaggaaaggccctctaatccctcatcttgaaattcctgtttctgcttcttaaaatgttattgtttttgacagttccttgaattctggaagaaaacaaagtcctttcaataaatttccttaaacgccaagatgaacttaagttcacctctgtattttttacccaaagaggcccattcaggaaaacatttgtttttaatgcttcatacatttgaaaatgcacatctaatatacttcaaaggagcactacctcaaaaaatacagtatcaaatttttcccttcaccactgaaaatgtttatctttacatataaaattagtaagctgattaacacagaaataaaagagaacactgtcttctgggtgccatgaagatgtgtggtaattcctcagattttgacattgtagatatatagaaattatagtcagtttcaataaaacactgctaatgaaaacacccacaatttcctttggtagaacaaaaacaattataacatgtaacttatctctccaggtaatttttttgtgaaaaccttttaatgaaccatgaatgctggataccctgcagaagccaaggtattgaaatgtaaaaacattgtacgagaatagaaacacatgtctaagttcaaggtccctacagaatcccttatttatcccacttagaaaatgtaatataaactctatttagcaaagcttaattcatctaaaaatatagctgcttctgaaccatctctgaagctctgggttttatttctttttagtcattcccttatttgatcttgggattaattatattaatattccattcctctgacattaaattcacctgctaccccttttacataactaaaattttgttgataattttaaccattattttcatctatgccctaacaacacatttgtttttgtatcaagttatccctaggttcaaacatatattagaaaaattacctctaatttctcattattttcttccattaattttaactttagcactttttcttttcagctaatatgttctcttagtgcattctttgataattctaaatgcaaaaagtaaactacctttgtcctgcttttacagcttccaaaaatcattagttctaaatctgtctcctttgcaaaacttctttttcagctacttgttataaataacgaacttcattttcttatcgaaaatgtttttaataactgtgtaatagccaccaaaataatttaaatccatttttacatattattagggaaaactaaaattcttatcttagtagccaatatctcaacttcaaaaaatctttaccaaagattttattgggttgcttttcctatgcatatttatgacaatgcttctgattgtatagttcaggtatacctacactagaaagaccgagttcttgtcccagatcttctgaatcagaagctctgaaaagggaggtcaagagaatgcactttgaacaatctcactgaattcttgtatcctttaaagtttgaaaaccacctcttcatggtacatgatacgttcatatctgttatttaaacataaaaataattacaaaattcagaaactatgttattactaatagaaccaacattttttctgactacgtagattcaaatccccaagttactttcactagccagttctctacacattttccaagtgattcttccttaccttagaacgtctctctgatgtgttcctttttcatagtcctaatctcttaccttacttagacccttgtcatttcatacttgtaccacggtgatagcctcctaatatcttctgacattccattcccttataatcactgaaggaaactttctaaaacgctacttttattgcccaattatctagacaaaattttatctattgtgtactggggtaacccctaaaatagaattgagaataaaaggtataaatttatttttctttatgattgattcaatttacatatagtgaaatgcacagatcttaagctttaacgttttaggggcatagacccatgctattaccactcctattcaaactttatatttatttttaaataaaataatacaaaagtaaacttagctaatgctttatatactgactgacactgtgtctctgtatgttttagggacaagcaaggaatcttgagggagatgtgacaagtgtacagtgtgaagggataagcagcagtgtattattcagagttctttagagaaacaaaacaaataggctataaggacatattagtactgacagtgagaaagaaagagagagagagagggattgattctgtcaatcaattggctgattgattatgcaaatttgttgttttagtccattttcacactggtgaaaagacatacccaagactgggcaatttacaaaggaaaaaggtttaattggacttacagttccacgtggctggagcctcacactcatggtggaaggcaaggaaaagcacgtcacttcttacatggatggcagcaggcaaagagagagagagcttctgcaggggaactctgctttttaaaaccatcatatctcgtgagattattcactgtcatgagaacagcaacggaaagacttgccaccattattcagttatctcccacatggtccctcccacaacatgtgggaatttaagatgagatctatggccaggcatggtggctcatgcctataatcccagcactttgggaggctgaggcaggcagatcacctgtgtcaggagttcgagaccagcatgcatagcatagtgagatcccatctctaggtgagatttgggtgagacacagccaaaccatatcattctgcacttgacctctcccaaatctcacatcctcacatttcaaaacaattcatgccttctcaatagtcctccaaagtgttaacccatttcagcattaactcaaaagtccacagtccaaagtctcaccagagacaaggcaagttccttccacctatgcatctgtaaaatcaaaagcaggctagttactttctagatagagtggggatacgggcattggataaatacagccattccaaatgggagaaattggccaaaacgaagggtctacaggcccccaagtccaaaatccagcaggaaagtcaaatcttaaagctctgaaatgatctcctttgactccatgtctcacatccaggtcacactgatgtaagtggtgggcttccacagccttggacaactccacccctgttgctttgcagagtgtagccccctcctggctgctttcatgggctggggtcgggtgtctgtagtttttccagaggtactgtgtaagctgttggtggatctaccattctggggtctgtaaaatggtggccctcttctcacagctccactaggtggtgccccagtagggactcagtgtgggggctctgaccccaagtttccctcctgcactgcactagtggaggttcttcatgagatccctgcccctgaagcaaacttctgccttaacatacaaggcatttccacacatcttctgaaatctaggtggagcttcccaaacctcaattcttgacttctgagcactcacaggctcaatactttgtggaagctgctgaagcttggggcttacaccctctgaagcagggcctgagctctatgttggcccctttcagccacagctggagcagctaggacacagggcaacaagtcccaaggctgcacaagcatggggatcctgggcccagcccacagaaccatcttttctccccaggcctccaggctggtggtgggaggggctgtcatgaagacctctgaaatgtcctggagacgtttttcccattatctacaggattaacatacagctcctcgttacttatgcaaatttctgcagccagcttgaatttctcctcaaaaaatgagattttcttttctatcaaattatcaggctgtaaatattctgaacttttatgctctgtttccctaataaaactgaatgcctttaacagcacccaagtcacctcttgaatgcttttgctacttagaaatttcttccaccagataacctcaatcatctctcaagttcaaagttccacaaatatctaaggcaggggcaaaatgctgccagtctttttgctaaaacataacaagagtcacctttgctccagttaccaacaagttcctcatctctatctgagaccacctcagcctggttttcatcattaatatcattatcagcattttggtcaaagccattcggtaagtctctagagagttccaaactttctcgcatcttcctatcttctacagagccctgcaaactgttccaatctctgcctgttacccagttccaaagtcgtttctgcatttttgggtctcttttcagcaacaccccactcctgttaccaatttactgtattagttcattttcacacagctgataaagacataccagagactgggcaattttcaaaagaaaaaggtttaattggacttacagttccacgtggctgaggaagctttacaatcatggtggaaggcaaggaggagcaacccacatcttacatggatggcagcaggcaaagagagaacacttgtgcaggggaactcctctttttaaaaaaaaatcatcagatcttgtgagacttattcactatcacaataacaacacaggaaagacttggccccattattcaattacctcccaccttgtccctcccacaacacataggaattcaaaatgagatttgggtggtgacacagccaagcgatatcatttgttatgaatgctaagagcatctactctctgcaaattagagaaccagaaaaactggtggtgcattttttatcaggtccagaggcctaagaaccaggggagtcattggtataagtctcagaatctgaaagcctgagaactaagcactgtaatgtttgatggcaggagaagatggacgttccagttcaagaagagagaactcatccttcctctgcctttttgttctattcaggccctcaatggactggatgatacctgcccatattggtaagagcagatcttcttcactcagtcttctgattcaaatattagtctctttttgaaacactctcttagacagacccagaaataatgttttaccagctctttctacatgccttaaatcagtcaagctgtcaaataaaattaagcatcacaagcagccttctctcttgtctgtttgctttcaacacattgcagtgacttttagtttacatttggccagttaaagggatctgtattttataatattaattttacaccaaactaatgctcaaaaaaatgaataaatagctgagaaatatctctgcaaataaacctgagattaaaggtaacactaatgatatgtgtagaagtgaacaccaacagagatggaaaaatcccttcccattcctctgctaaaacagcttaatcagtcatgttattaggtcaaaaccgtggagatccaggcagaccggaaataaagtcagactgacaattttgatgtaattaatacaattatttataatgttgacttatatataatacaattaatcattttctatgtgatatatgaacattgaaaatttaatgactgataaaatacatgtataattcttaaatattagagtgtgtactcaaaaatattttttaattcatgggatgaaggatcataaaagttatgtattcattataaaatgtagctatcattaactaaatgatatggttttggctgtgtccccacccaaatctcatcttgaattgtaactcccacagtttctgaatctcatgggaggaagcttgtgggaggtaattgaatcatgaaggcgggtctttcctgtactcttctcgtgaaagtgaataagtctcacaagatctgatggtattaaaagtgggagtttccttcacaagctctcttttcttatattttgccatgtgagacatgccgttcaccttccgccatgattgtgaggccttcctgaacatgtggaactgtaaatccattaaacctctttcttttgtaaattatgtagtctcaggtatgtctttatcagcagcatgaaaacggaataatatactaacatacacacacaatcttgcctaaagttatttatgtcttaaagttcagagctccactttatgaaccctctcatctccttgaattacttgaattagatcaaagatggaaaacattttttgtttcctaacaagtaaaataatctttttttcccctcaccttaaatctgggcaggaattgtccttgctttgaccagtatatgatagtagattatttctactgattcagttctgggatcaggccttcagaagtttgatagctttcacttttgccttcttaaaaggcaggcatacatgcaattaaatggactattttaaataaattctataaagaacattttctttaaaaaataatttccaaaatgtagaagtacattaaaattagaagaagcattctagagaatggtaaggcatgaggaaaaatacaccttgggggatatatttaaggttatataatgtttgaaaaaaccacatgtgctcagctataagtgttcagttataagaacccagttgtgtagcacaaggatcatgaaacaaaagaaaatataaacaaaaaataagaaaacaaaaaaggaaacagaaaaatatggactctctgataactgtgaaatatgaaatacaaaatgaaatatggtaactgtgaaatatgaaatacacaatagaagaaatgttgggcccatgaacattttcatcccttctcaatgtgatatatgcattgaggaagggacaaaaaatgtgtttttctcttcacatttccaatatgagtatactgtatacttggccatgaaagtgctaatacttgataatacctaccacagttaatgaaggttgataaaaaaatttaaaccaaggtttctggctctagtatctccattcttaatcaatgggtgacaccaacattttagttgccagaatattcataatattattataatcatactttgaaaaattagaaaaaatactgttagcaatattatatttatgttttagtatgtaacatatatctcatctatatgatatttaatacatattacttttcacacattagctgctcatataagagtacttaatactacaagctactgttacaagctaaagtcagcagactttcttatattattagaaataaatacacattgtatgatatcattattaatgacagtgctgcaacagagcttgatagctgttaacatttacattaaaaatggtcagacttgataacacaattagaagcagaaatttcagctacatatatgattaaggggtctacagattatgcttttctttcagagaccttcatggcaggtttctccaccataggccttgagacttaggaggaaagaatggttttgtgggccaggaccacggctccactgccctgtgcaacctcaggacactgcttcctgcatccagccattccagctctagccatggctacatggcccccagatatgcctcaggcctctgcttcagagcatgcaagccatagccttggcagcttccatgtgatgttaaacctgtggacacacagagggcaatggttgaggcttggaagcctccacttacatttcaaaggatgtatggaaatgtctggatgtccaggcagaaatctgctgcaggggtggagccctcatggaacacctctaccagggcagtgtggaagggaaatgtgaggtgggagcccccacacagagttcccactggggcactgcctattggagctgtgagaagaaggcaactattctccagaccccagaatggtagatccactgacagcttgcaatgtgcacctggaaaaggcacaagcaccaaacaccagcccatgaaatcagccaatggggctgtactgtgcaaagccacagaggcagaaatacccaaggccttgggagcccaccccctgcatcagtgtggcctggatatgagacatgaagtcaaaggagattattttggagatttaagatttaatgactgccctcctgggttttggacttccatggggactgtagaccctttgctttggctgatttctccttttttggaatgggtgtattcacccaaagcctgtacccccattgtatcttgtaagttttttcaggctcataggcggaagggacttgccttgtctcagatgagattttggactgtggacttctcagttaattctgaaatcagttaagacttggggaactgttgagaaaggatgattgtattttgcaatgtgagaatgacatgagatttcagaggaaccaggggtttcatgatatggtttggatttgtttccccacccaaatctcatgttaaattgtaatctccaatgtaggaggagggacctggtaggaggtcattgaataatggggggaaatttcccccttgctgttctggtgacagtggtgtcagtgagtgagttctcatgagatctggttgtttaaaagtgtgtagtaccaccccttctctctcctgctctggccacgtaagatgcgccaacttccccttcagccatgattgaaagtttcctgaggcttctccagccatgcttcttgtacagcctgtagaactgtgagccacttaaacctatttttatttataaatcacccagtaacaggtagttatttatagcagtgcaagaacagactaacacagaagaggtattaaatattctctaatggtagaatttaccagtaaagcatctgatccagaattcttctttgtgggaagatctttttgattactaagtcagtctattaacttgttaaaagtctaccccaattttttattttttctgaagtcagtttgaatagtttgattccaggaatttgtccattgcatccatttgtctagttggcataaattgtatataatattccctcataacatttttttatttctctaagctaaatagaaggtcctctctttcattccaagttagtaaattgcatcttatctcttttattcctggtcagtctagctagaggtttgttaattttgttgatgatttcaaagaattgattttggcttcatttattatctctactgatttcctaatccctcttttattactttccactgtagtctctattatttctattgtgttgtttagctttctttctttttttttttttttttttttaaagagagtcacctccaatctcctccatcactcaggctggagtaaaatgatgtgatcgtagctcactgcagccctgcagccttgacttcccagacccaggtgattctcccaccttagcctcctgagtagctgaggccacaggtgcacaccactatgcccagctaattcttgtattttttgtagagacagggtttcgccatattgcccaggctggtctcaaactccaggtctcaagcaatccaactgtctcggcctcccaaaatgttggaattacatgtgtgagtcaccacagatggcctcccttctgctctttttctttagtttgcttaacatttccagtgtctttgtgacaaatattacattattgattagagattaaaatacatgttacaaagtattgttatttttatttgtctcaaagtatttttctgattttatttcttccatgagtcattgattaaagaatgtttaacttccatacacttgtgaatttccaaaatttccttcattataatttctaattgcattccatttttgtcagagaatagagtttgtattatttcaatcatcttcaatttaacgatattggttttatggcctaacatgatctatactgaagaacattctaggtgcacttgagaagaatgtgtattctgctgttagggggtagagtgttttgtagatatcttttaggtctagctgctttatggagttgttccatcttgaccttaagttactgcatttgcagagtttcaaggttagtcagagatgagagcttagggccttcccaagtgcttcctgagtatatatacagcttgcttttatctttttagaatcccagaaatatgttaaactttttaaaactccctatgaacatcattatctagcttttcctttaaagacttttggctagtcaataattctgccattgatgttcatgacagtagaaccattgaagaggttgacaacagcccttggatgacctcgtcatagacatcagcatccgtatcctcacatatagtaaacagagactgtctataacaaatggaagcaggagaggagtcgtccatgtggtaatttactgttagcttggagaaacacatatattcagaagtatttgtatggatttagggaaaattaagagttttgacaaagtacgtgaagtcagagtcatggatatccccttctgtgtgtgtgtgtgtgtgtgtgtgtgtgtgtgtgtgtgtgtgtgctgtgtctggtttttgtttttgtgtttccatttgtaccagactgatgtgacttaggtaacatgccttattttccttcctaatgctaataacaatgtcaactaaaatgtattgagcattaactttttttccaggcagcattatgtacatttacaatgtattggatcaaattctcacaacccttttgtacaaagatctatttttgttaatcctatattaaagaagaataatctggtcaggtagtggctcacgcctgtaatcccagaacttagggaggctaaggtgggaggatcgcttgaacccaggaagtcgaagcttcaatgagctatgattgtgccgctgcactccagtgcgggtgacagagcaagacactgtctcaaaagaagaaaataagaaggactaatttcaggtaaaggggggctaaataacttaaataaaattatgtctagtgtgagttaaagtcaggatttttaacatggacagtacaatttccagaggctacactctcaacccctacaattctcttccttctaaaaatgtaaatagtgtaaaaggatattattcatttaccttagctgtgacagcaaataattgtaagagtttatatctattgtttgggacaatccactatcctacggttgtaggctgatgaaactttccatcactgtgtcacttttctgttaaaattttttaattggctcctcatttcactcagagaaaaatacaaagtagataaataacatacaaggctctctagtttctgctctgttcttatctgtcacctttctacttttacctcactcacttctttccagtacttccggcccccttgttgtttctgaaacccacctggcaagcttcagttttgatctctgcctagaactcttcccggagatatcaacgagaataacttcctcagcttctgtaagcctttgctaacagcttaccttttgatgacacaagtgctgatgatactgcttaacactgcaacttctactacaatcctcctctgcttttccaatcccattcatatgatcgatttttcccatagcattcacaactttctaactttgataataaacacttacttattatagtaaatgtttattgcctatctcttctgccagaaaactggctccacaaagtcagtgataggggttgcttcacagggtaggtgatcgtttgttgagaaaaagaatgcacataacttttaaaagtgaaataaacttgaacaccaatgcatccaactggctctgagtatcataattatccaagtctgttattaaatttcatcctttggcttttgcacatgctgcattatctatatagataattgtctctctttttccacctggaaactcctgtctttctgctaaaatgacacttcctaagcaattctcataaaatgcttaatgctctcctctcatgagcctacatgtggttcaaactttatttagagtgccttaaatattgtattttaatttatcttttacgttgttttaatgttttttagccacagactccacgactccctaacctagaacattcatctctcatatttgtgtttttagcatctaataagagtgattgacatacagtcaagccttcagttaatgaaataaatgatgctttattatctacaccaagatctctatagacttaaaatagtttctgtttatgaaagttttttacaaatataaaagtctgagctctgcttatgatatttgtgtctttataaagaccaaaggcttgaaacagaattgcttgaattttctttacagacagcatttctaagaaggatacagtatgatatttgcaaatctaatatctgttggttgttgtgtatttgtatatgcacataggcttcaagtaagaggacagaaaggggttgagggctaatgctgaactccattaaagttatttttcaagcacacttcaaaagaagccctttctcccttaaaagatatatagcctgtctcacatgcatctgtctgtctagaggctatgcaaatcagcaacatccatatttcagcaaaagcaatctaagaagagcagcataatcaatttctcatcatttttgcttttgacacaattagtagtatatgcatagggatggattaggatggtttctgtggaatttttcaagaaaaatatttaccaaaggttaatatttcgtgttcccttgggctaatcgtgctctctcaccttttttttttaaatggctccaaaatagctctttttaaattcagtcatatattatcacaattatgtatagtaaccaaccaaaggtaaaacacgtgtaaaatgtttttcattttatattaaagctgaaagttggtgctagaggaagttttatatgataagttgatatgtagaaaaatactaatatgtaggttaatttcctaatattttgaattgctttgcttcttccataaaagttattcatttatcattctacacatttcagtccaacaaattgaggaagcaaatatcttgaattattatttttaaaatgtgtttatacacaaaagtaacaatcatgtcaaataataaactttgttatttaaaatatttccttggaattgagagaatttgttactgtaagattctagaataactgatagtgtaaaatgttatcagatacaaaccaacaaggatggaatagaggattcctggcctatctgatggcggttgaatattccggtcctgatcaatggcttggattggtggcgtaacaataatggggttcagttcttcctgaaaaaaaaattaagagagtttcattcagccgcattactaatacttcatgaaggattgagacagatgctttagtttggaaatctatataacgtctgagacagtaaactcaagtttcaacatttatgatctaataccttttactagttaattttgaatgttaagggggagcaaagtattctcaaagtcaaaatggtaagacatagtgattatgcacatagacatttatatcagtaactactcctaaaaggaaatcaaggaagaatgataatgcacttttaatcttctctagaggatttcacaaaagaaatagcagcctatcaaatagtttatgaagtaatgttttctctttgctttagacaagatttgtaagaatacttgtattctttccttgctaaatcattttttagtttcatacacatcaattatattaaaatataaataaagtaaataatttcataaaaataaaagtcacattattgcaaatttcatataattaaaattgattttaaatattgcaggtatttacatgtattttacaatggtctataagaaataatgtttaaaattataatatacttctttaatttggtgtttcccaatttaatgtccagtactattttgttgtgctatcaggactggcaaacatttttctgtaaagaaccagataataactatctttaggctttgccaaccatatggtctatgttgcagctaccctcaactctgtcattacagcaccaaagcccaagtgggcatggctctgttgcaataaaacattacaaaaacaggtggtaagttatatgaggttactgactactgtgatcataatagatatgctaaaaatacaacaataggtatgttgaaaaataataaaaagcttatctacacagatatgcttgggaaatatgatattaaatacagttttgaaagccaattaactgtactgcaaatcttttcagacttaattatgctaatctgcatactgactttctaagaaaagggtactatttgctcactttcaagaaacacccattaacctgtttttgaaatgatgcctttagaacacagtttgggaaacactactctaagttatgtagccctcatcccaaatatgtaagtggtaattctaaatgaaatacttctaaagggtaattctaaagggaaattccattacatatttgggctgagggctgtgaaacttaaactactgtttcccaaacatttagtatgtctcaatatctacaaccttacattctaaaaaattactgcaatgttctcatattatttcttctcaaatgacagaacattgaaatatgtaatgtacttttatacaaaaccagtagtttcagttctcagcaaaaatgtatagtgatggcatgctaaaaaaagagcaatgatattaaaacattatgtataatacttgattttatattgaagttataataaggataattattgaccaataatttaaacaccatagacattgtatggggtttctctcgagttcattatcactaataggtcctaagtagtctaaatgttatcagtattttcctgaaaataaagagttgttggtagtagcaacttactaatactctattctctcctttaaacgtggaatcagaaccacgaaaataccaaataaatatcaaaattactccattaaatccagaagattattgttcttaaaacgcaactctcactgaacttttcctcccatgctgcctctctctctctctctctcacacacacacacacacacacacacacacacacacactttcccaataatcaatttgcttggtatgcaatacctgtatttctccctaaactgaaaaaaaaatctgaagttctttgaaatatgtatgtttgagcacaggacttaagagttgacaagctctttctagtaatttcactgaggaatctgattgccatcagccaaagtcagcttatacttaagctgtatcactcctggttcatataattaaatctgcagtaatttttccaaaaccgaggctctatttggatcctgtaaaggcatttcaaatctgaggattttctgcagttccattctgcatctcatagtcagaaaaatattttcctaaacaatttttgctattataaaataagtaatttcttatctagaaattaaaataaaattgaatcttagcttttcgtttggaatgtaaaatgtaagcaaatcacaatatttgaggatatgttggctgatcaccttcatctatttatttctatagatttgctaagttacctacacataagcagttttagctttaattagtaatgtagtataaaatattctttctataatatatagaattgttgaaatgagcaacataatttatttacattgaattgttgtataagcaatgtaaaaactaaaagtaacacatcaaacaaaaccaagaggaagggagaaatgaaaattaaattcctcatcttacacatttgcctgtgattaaatatatatatatatatatagagtaagaactgaagaactaaaaagaaacaagtgtagtatttagaattatattaataattagaagatgaaaaactgtgagtatctcaggatactgagcatggaagtgagggtagatgggatagaaaatattttacataaagccatttggtactgtgtgactatgtcattaccatagcccgtactatttgttttaacattattaataaataaattatagtattgagaataaaagaaaataaactctcttgataaaggctttcacaagtttctgcaaatttaaaagaaatggtgtggtttaaataacttatcagaattgacattttatcttgtcctatagagactagcaacttattttacaatatttatttttccttctgctaccataaatgaaattgtcagataatctaggattaaaggtgaaaagaatgatttcttaactattatgtgtatgattacctctcaagtaaactgtgctccatgaagcttgaaatgtttaaatattattaatacatgacattaaagaatactaaaaattatgatttttaggatgaccttgttaaatatttaacatattttataaagatatgtagcattgaagtcagaggcagacaatttatatacattaattagaagaaacaacataaataacatgcattatgtttgaacttctgtctgccaacacaacctccacagtagatgaaaccaggcctggaaagggtattcatataagcaagaacaacccagattgaaatggttccttagaataagtgagaattttacagagagaacagaagtaaaataataataataatatgtacgtattcagttcaagtatttttttttaacaacagggtaaatccaaagaaaactgagtaaaaataaaatgaaaaaggaaaaaaaaaagtagtatatagtagtaaagtatccaatgctgatgaacaaaggaaacagataaaagaaatagtctttgattaccaagtgccagcatattactgtccttgaatttattgaaaaatagtatccttataatgaacctctttttccctaagttagtttcaggtcagttctctgactttaaacctagagtaccaatctaataaagggctaaagataagagaataacagatggtgtgttggctctcttagagacatttacttaaacttctaaattctgttatttattttcttttgctttttttttttttttttttttttgagacagagtatcgctctgttgcccaggctggagtgcagtggcgcgatcccggctcactgcaagctccgcctcccgggttcacgccattctcctgcctcagcctcccgagtagctgggactacaggcgcccgccaccacgcccggctaatattttgtatttttaggagagacggggtttcaccgtgttggccaggatggtctggatctcttgacctcgtgattcacccgccttggcctcccaaagtgctgggattacaggagtgagccaccgcgcctggccaattctgttattttcattgaacacagttacagctctatgaagagaacagaattattcttgcccatgaattgaaataatgtaatcatttacaggatttagcaaatagcagatatttaacataattttgccaacttattctgttgagttatccaaagagatcactactctctggtcaactttgtaatatccactagcagaaaatagtccatctgtggctactgccaggtcttccacagttccaaaaaggagattgattcagtgacttgtttcttctgaagaacagagtctcttcacatagacaataattgctgttgcttattctctgtcgtcctcatttctcctagtttttgactttactgcctatattacagaggaagtacggtatgtgttgaagaaattagaagtccacccatagctcaaatatgcttgggtatcctttatggaaagtatcaaaatgttcctctattttattacaattgctatatttatctttttgccaaaagctttattggtctgtgggcagaaattatcttatttgtacttacaaccctcagcctagtgcctcacagatttcaacaaatttttgttatcaagtcaagaaacacagaaagagctccccaaaccctggatggttcttttatactttgcctctgaagcaaagctgctttctttgctgtctcatttgtcttcaagaagaggtcatgtctcctgaattctgttccagttgataagcatatattagaagcacacaggatagcagatttgcatttcattgctgtttgaactgtcagagctacattccctgtcttagtcatggggacacataagtaaagtgaattaggtccatataaagagattcataatgagaaggtaatcatagaaacgattaaacaataacaaaaaaagtcttctgtgaaaatactgtgtaattatatggtttaagaaccttaaaattattattttaattttaagaaccttaaaattattctattttgaatacatgcttcctattcattagcttttctggagacacaccttctcttttgagcaatgttaagacaatgttttcatgcagaactgttgtattattctgagaggataacagtagccaattaacatttgatgtgagtgagggttaattatgcctcatgaaacctcactaccagattgaaaatgaacttttggtctgaattctatttttatatatatatatatatatatatatatatatatatatatatatatatatatatatatacacacacacacatacatacatacacataatcattaataaaaatatattagcaagcaatcccaaaagattaagaagcctttttgtagatttaataaaatctcagctttctggtcatttaggtgttcatatggttatcttgaacaaaaggtatattcaagagaaacactcagatttcagagattggatacattcactgtttagcttatatcaggttaacagaagtcatgatccatagaacaataagatttaacctattatatcatccctaatgttaaatgcatacatgatgcctatgattttcactgtttcatgcatgggtaggttgtctttaaaataatatgaaaccagttcttacttttaaaatacttctcacttcaccaatgaaaaataatatctatcatttacacaagttgatgggtcagtaaacttaaaaaaatgacatttcgcagactgattattaaagcttccagccttggttgagatagacataatagaagcattgttaaaatactaaatattctcaacttggcatttgaatgatgtcttcatctgagtaacgtatacatagtagtatactgaatgtgcccaagtatttcaaattaactgaaggcattataattatcttcaagaaagaatatgttctgatacatccctggaaaggtaatctgagctcatataagtacacagtttgctgttataaaagccaaactttgatgtattatataatattccacttatcattgcttagatctttacactgtattttaatcaagtaataacatcatagtatttggagaaaggttatgctaaaatagtaaaaatatgctgtaagtattccaagaccaataattaagtgatttgaaatcttagtaactatataatttaatacctaagttattgaatttattatttagtacttaattactttcactaattttgtgtgttctttacatttaagtaggtgctttttcaatatctattaaagtcattaatatttaatttgtacacttcctttaacaacagaaaatttctactacatttaaggaaagtcagtgtcacgcctgtaatcccagcactttgggaggccaaggcgggcagatcacgaggtcagggatcgagatcatcctggctaacacggtgaaaccccttctgtactaaaaatacaaaaattagtggggcatggtggcgggcgcctgtagtcacagctactagggaggcataggcaggagaatggcgtgaacctgggaggcggagcttgcagtgagcagagtttgtgccactgcactccagtctgggcgacagagcaagactcagcgtcaaaaaaaaaagttagtgaacattattagtctcatttcatattacattgcaaatgtactattttcctcaaagctcttgattattttcagccagattcttgcttgtttccatgtgttactaacatagagaattagaacaaatcaaaaattttctcaaacacattcatatagacataaatacaattatatgttacctttagaggccaaacaaccatttctgttttcactttgcttagttttgcttttttcaagggtcagaaatatcagattgtttgaaaaagtatcagacatatcgaaatgtttttcctggtgagattattttaaaaaatagtaacgaattggggtgagtagtatgggccaagccaattactttgaactttttgtattgttatggaagaaacacaggttgaacattcacaaacctctttgaaactgattcactgcatatatcaaagttcctcaaatggttttgacaattattatccttagaacagaagagtgaagagcacatttgagataggtatataattatgattcatgaaaatcataacaattcatgcctgatcactggaatttcgtatcacatattaaaacaaaaactcacttagctaacagaaaatacccttgttttattatttccatgagcaaattttatgacccctccaatatcatactctttattctaccaagtatgtgtaaatttaccttgtataatgtgactgaatttgtttccaaaatgtgcatttcagtatcctctcaattgcatatttgaatacttttactgatacttcccttattttcaaaatacttccttgaatgtctttgtctttaaagtttgtttacctgggattatatgcctccttttctatggatcatcaaatgatttctagacaggcaataaaaaccttggctggtggtaacccggtaattattttccatgaataaataataaaagcctgtaacaaaatcttgttggtaacaaaaggttggtgacttgttccacgctgtccaagtgacaaagtctgaagcattactgcaatcaagttggctttgactatcaaaaatcgttttccacataactcaaacctgagaatatgcatttcacagatgttgtaaggaggatacatagatcacagaaatatttcttacaaccctttctcacattcttatccatttctataacaactattctggttcctacttctcacactgccacagggctaactcaaaatcttctggttattcacctccccttcattcccatcgtgcacatcaaaaatcctccaaacgattttgacaagcatgacccactctggaagtcagaggaaaggaagaaattgagcagacagagtttgctttaccatgaagataaggagacaatcttgggagaatttatttgttcataattttagtctcattaaatttggatgaatatttcaatgataataatgatatggttcccattgtgtgctctcatcaggtcaggagacgactgtttttgtgatgacttcaattcattgtcaaatcacaattctatctaggacctccttgttagcagggactgtgtgagcactccctaggtttttcaccctcaatctctccatataaggcctccacactcaataggaaggcaataaaacaaggacaacaaatatgaaacatatataacaaagtaggccttttttattgatttgattttggagaaataaaatctgattttgcattatcagatgcagtagtttggtaaaagaacatacatttttaatttagataaatgaagcaaagtaatgtacagttttcccaagtggttttatcattttatatttctaccgagtatatgtgtaataaatgtgaaagttcaaatcaatgggagaaaatggatttttaataaagaatgattaaatattggttatcaataaatagagaaaaaaattatgatagatattgactttaccaaataaagctttggaagattgccagataagtctttaccagatacatctttggtcgattgcttatgccaaataaatttttgtagaacaaaagtgaatgtatgagaaaaacacatgtattagaagtcaacatagtagaaaataaggtaaatgattacttaaaaatattgcaaatgcttgcttagcaatgatttaaaacaatcccaaaaattggaactgttgaaggcatgaggagatgtgggcttttatatctgtgatggaaataaaaagcaggttaagttcaaggaaaaaaaaaatgaaatctatcactaggtttgacaatatgtatagtatagattaaagcatttcaatttgagctttatcttacataaatattgagagatatgctcggagatgtgttgagaaggatattcattgtacaatatacaatttgctttttaaaagaataaatttcttattcaagtacaacctatgagataccttcataaatcaatagttcacagtctgatgaattatcacaatgttataattataaattccaggaaaaaaattgatattttcacaaggtctgacaatatatgtagcttaaacttcaggattgcactttgagcttcatcttacataaatattgagagggacatacgctcagagatgtgttgacaagaatattcactgcacaatatataatgtacttttaaaaataaatttcttattcaaatataagttatgagataccttcctaaatcattagatcacagtctgacaaattattacaaagttataattcattcatgtaatcacactgtgatcaagaaatagaatattgtcagtatctcagaaaaccacttattaaattatctactcataactacccctacttccatcctagagatggcctgatttgtaatatgaaagatttgttttacctgttttaaattttctataaattgaattacatagtataaaaccttttatatatggctttttaatcaattattatgtcttatatgatatgtatgagtgtaagattcttgcatataattaagtgcagtactagtatactcatattaatggttatactatcatccattagatgaatacatcatattttatatgttagttttttttcaactggcgatgaactttgtacttcttctagggtatgctgtgaggataatgctcttacgaacactcttgagtatgtcttcttactgatatgattgcatttgtgttaaatagaagaataaagttgcagagtatgtatacattctgataggctagattactgtcagttttctaacgtggttgtatggtttacattctatcacagagtaggagaattctaactctttcacatctttaccaatttcagtctcttaagattttagcaaagccagtgaatatgtattattatcttatagttgctttaacttgaattttgatgatgattaatggggttgaacaactgtttgatgatcttggacatttgtaaagtgctgttccatatctcttgcctattttagttgaattgtctgttttccttaatgattcacaagagttcttcatatattataattaagtcatttatcagcttaatgttttataaatattacaattcttatggcttatatttagaccctattagtgttatcttgtcaaagaaaagtttctaattttaatatagttttatttatccctttctctttccatatatacctggctatttcctctacctgtacacatatcctgaatgtatgaagtatagacaataattttccttatctatttccatagataaaatattgcactcatccacatcagaatttatgtaaactgagttggcttccctacaactttcttgagagcaaagtgaaggtctattttcttttatatctgtaggaccagacagtacatatggcacacggagactcaaaaactttgaataaagtgtttctttgttgtagattatttagagtatttttaggctcatacacacttgccttgctctctgaatttctgtaggacatctaaatacaaataatgatgttttttgagaatctatttataatttcaatatctttgagcttcctaaattgctgcatttaactacaggccaaaataatctggtcataagagtgaatcatatacacatataggggctcacagcgcttcattgagatggccttttggggtagtacaataaacaatgtcataaacattccaatagaatgaacggtgaactcctatgtcctacaacaaaatatgccaagcttgccaataagtagcaataaagcttttcgataaactagtctcttagagcttgaattatgattttcaaggtgagattaataatatctacattacttgcaccactgcactccagcctgggtgacagagcaagactctttctcaaaaaaaaaaagaaatatgtatatatatatatctacattgcatgattgatgtgaggatgcatgaaagaatatatatatatatatatatatatacacatacagtaaatgacattcttaatatgtggaaattattatagttagttttttaaattgataattttaatgcttttaaattgtgtaatctgggtgttaaaattgactccaagttataagctagggagaaaaaaattttcatttgaaactagaagcttaattgataccatgtcttacacatctgtctgaaaataggacagtgatatgaattttgaaagtttatttagaattccatagttgatcaaataattgaggaagtaaaaagggattatctatctctgctatttaacttgaagccaagcttcaaatgagaaacttatgaattaaattatttaaaaatcgtacttaaaaataagatagtctgccagagagttgaatattcacttaaaatagttatcttattttgatttatttaaaggtaacttcagtgaaattattttctatagactaagacatatcatacttttatatccaataataaattcattccctacatttttattgtaaagagttgaagtgaaatttcttaatttgttaacattcagatgaattatataaatgcattaagcagttggcaggtaccaagaactctactaactgctcaagcagtagaaaataaattagacacaaattctggagatatgaaaaagctcacagtatcagggatggggattcaaagtgcaggtaccacaagttaatttagaaaatgttttgttagggcatttctcaatacatggtaagagaaagctctgataaaaaaattcatgctgtcaagtattaaaggtgaattataaaaaataacaacaaacagacattcaagcatgtgtactttgatccaagtatcaaatgtgatactgctagtgaaaaatgatgttcttgtctctgataggagtgggaaaaaagagtaacaaaatatagtagaaaatcatctagagacattttgaggagagtttctaaatcgccttaaaaatggaggagtttaattttcataaactgagttgccaatgaaaaacttctataggtaaatagcaaaaatatttattgtcttggtgattaaaaaatgatcctagagtatctttaaaagtatagttcagagaagcaaaaatatttataaccctaccacccaatgattatcatttttaatatttaaggtattttgtatcagtatttgttatctatgtatatatattgcttgtctaattgtccgtatataaacacatgtaatattttaccatgttccatatttaattttgttgacattttcatctcatatcataacattggtcttcatcaataaatatgcatcaaaaacctatttttgcaatagctttccaaacccactaatgtcataatttataaaatgatatatttcctcttcagtagtgtgtaaaaaagtctaactgcagatgcttgtcaatagtgagggagatatacatctagagtgttgctagttaagcataaagtataattttaaatttctttggtcactagcataatttacttgatatatttgtgtcttgcctgttcatttactttgcctattttgctttgttttaatttgggcattttaaaattttatttccatggcatatgtgaatagcatagaaatcaacactttgtcaccagccttaaacatattttcagtttgttgtttgccttttagtgttgtttttgacatttaggaggttggtgtttttatttactcaaatatttccctttccttttggatttcaggctagatactttaaaccatctgaaaattatgtgaatatcaaattatctattttttttcaagtactatggcttttttatatgtaatgtttcaatccatcaagaaattgaatagtaaagacttaatactcaccaaattataggtggaattttaatctttatcatttataacagaaataaaactagattgaaaaactatattttcccattgtatcttaaatggatatcttatttatttatttatttgagacagagtctggctcagttacccaggcttgagtatgatggtgcagtctcacaacctccacctcatgggctcggaccatcctcccacttcagcaccagagtagtagctgggactacaggtgcatgccaccacatccggctttttttttttttgtattattggtttcaccattttgcccaggctggtctcgaacttctgagctcaagcaaaaggcccacctcagcctcccaaagtgctgggattacaggcatgagtgactgcacctggcctataaaatgtaatctcattgcaaaactcaatgatgccatgcttctataatatgctattacttttttttttttttttttttttttggagacagagtctcgctctgtcaaccagttgcccaggctagagggcagtggcgcaatctcggctcactgcaagctctgcctcccgggttcacgccattctcctgcttcagcctgtggagtagctgggactacaggcacccgccaccacgcccggctaattttttcgtatttttagtagagacagggtttcatcactttagccaggatggtctcgatctcctgacctcatgatccacttgcctcggcctctcaaagtgctgggattacaggcctgagccaccgcgcccggcttattacattttttaacacaggttttctctagtagaagagagccatgatatttaggattatggatatgtgtgaaagctagacatttaaaaagcacacaatgacttgaaatatggaattgggtatcaaataatctggatttacggaaaactagtcacaaaattcatggagataaacaagatggaatgccaaacaagaaaagaccatgtaattgcatttgttaaatgtctctaatgtgttccacatccacttcccaatctctctctcacacacacacaacccaacaaaactgctttccttgtaaataaaatttgagggttgaaaaccaacatgtatactttttgcattacacatgtactttaattatcattttaaattcctatattaagttaaaaatacatatttagattaattttattggtttaattctttttcttcaacagtcaattgacagacgtctttgagtacttttattctgaagataatatgaatccttgtatatatgagaatgatgtttcattcttaaataaaaatttgattgaattttaggttctctatttacaaactttttctttcaatgcactgcaagttctacctaatctttgctttctttatgctttcttctttaaccatctggtagaaatttgcttttatcctagaaataaatatagtttaccagggattttccaagtatttgtctgtgctttaactgtgattcataattaacacttttgatctgcaaacacaggttctttatataacccttgagtgtttttgtctttgtttttgtttttccttacagtatctttgttattgtacttgcttacttctcctggtttattaataaacacaaactaattacatttttatctggctctctgatcttcgttgctttattctcctagtcagttcgtctgtagtctggaagatttttcaaacatgtaagagcatactataaaatcgtagagagtgctttttttaaccaggctgatgcagacaaagtcttgcctctcaaattagtttctgtgaactccaccttttgctggtctataaaataaagagtaatcttaccttctttaccaagaggtttgtttattaactgtggaaatgcttgtaaaacacctactaccattgtcctatcaagttctaaaaaaatatttgttattattgtttagagtcgcagctttgctttctgcatcttaaatcctatctttctgtcttaaatctcttcagtttaattatttcatttttcttctgtatcaatatctttatttaactttcaatatcatcctatatattccattcttaattaaattttatttcttatccaaacttttaaaaataatttaatagtgtttcttttagtcaatcttattaaatatatgctcccccctgcctttttatcttcagtgtaaaatgctgctctaatgttgtggaatctttcaagggattcaagtgtgtttgaaactgtgtattaagcgatgatcactaccttgctgactgcaaagtttccatatttctgtggtggagaggtagaaatctctcctttatccctgtctacatctcttttccctctactgctgctttcttacactagtcttggcaaaaatcgtacttagaccccttgtttctagtgttgatgcaacttgtcatccctttttgctgtctccacaagtacatcaatagggccatgagtaaaactaatgcagatactagtagctgcctgacatttcaattcagacctactctatgtatttcaatccaaacctactttaggttaagagatggaaaatgacatcacagaagaggtgttagttaaaactatgttttcaaagattgatacttcgaggcaaagccttctcctctaacttttccagatagaataatattgattatcctcactattcccattaaaatatgctttcctctgcattagattattaatcagaactctcacattcttagttcatcatcatatattttatagcagtccagtccagaggaaagcatgctgccatcagagccagaacgaccaaggtcttcaaaactcttctccacaacttattcattatgtaaatatatctttctaaatatcaacgttgtaagtgtataatagtaacattaatttacaacgattcatatatcagattagaccaattaatcctatgtcattttaattatagaacttttctcaggatttttttttttaaagtaacattagacggccttgcagtgactgtcccagggaacattcaataaatattagttttataatttcttattattctatttatgtataaatttctttctgatctgtactatagttatattgaagagaatgtctatttctttcatgttagtgccttacttggtgcctgacacattgtagatactcgattgccacttattgaatcaaagaaccaaggtattgattgaattatgggagtaaaataattacaacatgttataaagctgggagataggaaaatccaaaagaagagatacattttggggaaaacaattacctagtaaattcgattgaggattgggtttactagagaaatatcattttaaattcacaattcagaactggagaaaatttaaaagagtaagaaacagaaaaaatgaataaaaataactttgttttgatattaattttcatatgttgattgaaccttcaatataggcgagaatattaaagttactgcattttcctacagtttttttgggtatattctatatggaatgaacacagtggtttttattgtcagaatattcaaatattactactaatagcactatctgtcactgatcacattcactagcacactgtagaccctacatgtacatcgagaatattgagaaatctgtgacaacagtgagttatatattttattgacttcctctagttctgtatcatccagcatagaggacacataatactttacaaaatatacccttgctgtatgaagtaccaacatttttagtttcatttacagaacaaattctgaactttgtctctgatataaattatgttatacagcagcatttaaaagagatattagtgattagtgatttctttttataaatgcaatgtgaactttagtaatattaaaataattttgtcaccttactatatttatattaaaatatgcatatggtaatgcttgctataaattaaatcatataaataactgttccttttacagctggtttgaaaacattcttttgctgtcttttaacgtagattttagatctcaaatactgtatttttaatttaatagaacacatggccatttaatactaggaagaaaaagagatgttaatgtcattttccaatagtatttaatctaatatgttaaaaattttaaacatatacagcatttgtgcattagctttaggaaaaatacactagcagtaattatattctttgcagaaacatttctgaaattaacaaaatgaggaatataagtaaaccatttttaggcattgaaaaggataaatttatcctaaaagatgttgatttcagactcaaaataccataaactctatctgtttcttggtatttaaaattgaataaagaataataacatcctcttattaccaagaggacctactgtctcaccccgtggttagtgtatgtgacttaagaagcaatgattagaatttgtagagatgatgcaagtctcacattgacaaaaagaaaatttagaaaacagcaatgctaaaaatagaaatgcacaccaggatatactagcaacataaagttttaatgctttacagagctcatataacctgaattttctgagaatacaagaggagcgaaaataaaggttcatttttttgatagatagtcttggtgggattatgtctgcctcactgaacagtataaaacatttggcagagcatgtataataaccaccaatagcatggttcccaattcactcttactcaactcccacagctagcatctgaatcacaaacagaatagaagcttcccagaactcaaccactggcaacatttaaatccctcagcatactgaaggaccttgggagattagggtctttttgtggaagggcaaactgaaacacttggttttaatgtttgaaattatcatgacctaaatttgttttcacacttctgttttgtccttgtagtagaggtgactactttaaccacagcagggtactgttgataactctggatgctgatgcctgtaaggcactgatagatgcttcataaatctttttcaaatgacattcttgatatttgcccaccgggtctctggaagcatctgctaaacttctcaatttgtcttcagaatttcaacgtaattttttttctttctcctttctgcattggcaacaatttatgtcttccacataggatgtacttctttcacactatgtggatatttttaaaagtgtaggtaccatcacactcgcatcagaagcatctgttaaagtaatcacactggtgggggtgaccccagaaagcacatattctcataacaccttacaagagctgtaggtaatttgtattttggacaaacatgtcagactttttttatgtacaaaaaagatgtatacaaactataaccttttaaccctttctgataagccttcctatatcctgacatcgatttccttcttttacttgtttctctctcagtactcttcaaaaagagaggtggtgaccagtgttggaagagatgaagcagatgcacatcacttcctttgggaacttgctgaaataattctttgcattgcattttcatttacattatgctgaccagttctcttcacttagaactttcttagttgttcttttgattcttactgttgaaaaccaagattatgctcttgtgatgaagtgttttcaaatatcaaaatctgaataattgggcagcccactttcagaatcttatcatgaagtttatgctgcaaaatgtcagtttaaattgaaatattcaaactagtagcaaggtaccaatgataagacatccacagacccaaaagttaactgaattcatatgctattttttgctgaacttatctaactggtagccatacacagcaataaataggctggcaattatgcatgggggaaaatggagtttcaagtgtgtagtatcatgtctataagaataatattaatgatagcctgaaagcccactcagatatctcacagagcctatactctgtaacttagctatcatatataatctgtcctggggatttacaaccctggcccaagaattaccaggcatctatgaaaatgcgacctagaacaccagttgccctagagaaaaagacgcctcagcataggtgcaaatttcatagatgttaaaacaaagctaacccttacaagaataacttaaactccttatatgaaataaacatctgataattgaccaggactgaatacagatgtaagaaaggggaagacctccccaaattccgagaatagtctccggaaggataccctcccagctatttggtggccatgccaccagcctgctcccactgtcttgtaagagcactgccacaataaaccacttgggaatcaggtgatgtctaagactcatctttgaagcgtatcctactgaagagaagaagttgcctctggagaagatggtcagctaggctcacctaagaccctggagtgcaatggcagaaaagataaaaaaaagcatttaatgatgatctgatgactaacaaagcaactaataaataagttaacttttaaaggtaaagatgaatcagatggtcagctttacttagaaatatttgagataggttgtcctaattaattaaccaacaaacacttattgagagaaagtgagtagattggaagtagactaacatttattgatactctacttgcatctggttctgtaggtttaattttcacaattctactgttatagaacctatcaaaagcttcaagtaataagtaatatagattgaatcagaatctgactttgaatactctgttttttggatcaatttgactttccaccattatatgtgtaaggctgctgtttcctcacattacctacctgtcctggctgattgtacctcctactattgtgtttcccattccttagtatctctggtttatttttcttattaaaataagccaaaactttccttttccaggtttttcattggttatttctttagccttccatttatatctcacatttcaactcaaattctccttccttagagaagcttcactgaccactctagttaccaaagaatgctgtcttcttaatagtatgtatcagtgcctgaaattttttgttgaaattttaatttcctgtcttcttacactgaaatgtaagctccctgaagcagtaaaataacaatgtctatatccctagtacataaaacattgtcctgcactaaaagtctttcttgttcatgccttcattcactttctcattctctctctctcgatagattagatagatagatagatagatagatagatagatagatagatactgagatagagatatagtgtgtatgtatctataactgatggactgatttttttaggtaatgttccttgtcaaggagttgaaaatataattgtaaagaaagtttaactaatatatgatacaactaacaattaaaacaatgtatagtatgtggaactcacctactgaattactgagaggacagagggttgcgttatgagggaatctgaggaatacagatatcacttcacatttcgtcagaatttcacagtttaacatatattttatttcatttgtgcctcataggagctgtgtgaaataaagagaattgtcttctttttttttttttttttgtcaaagaagtcaaatgacatctcaatccacaaatccagtggtaaggcaaggttccctaaagaagataaacttgctaaaaatactaccctcctttgtttatttttcagaaatttaaattgctactcttcattgagaaaattagagcaaatgatgagattttttaaatctgctactgtgagtacgtgtatgatatttgatgaagttagcttgctgaaggcatcatagatcaaatccctaaaacaagaaacattttgtggccttacatgtgtaggattggagggtgtatgcatacactttcagtatattctagaaatcagtgagctacagtgtgatgtcatacagatatatttggccactgaccaaaaataaaagcatgctatagaagcattcgtcttgaaacaatatacttgccaaactgtctttacattggaataagccaatatttttatattttatatgtgcaggcaatcaataaaaaattgctaaggaacagagtctctattcacagtcctctgcatggggcacggcccagtacacattaagttgacctactgcatgatgtccagtcagtattaaaagggcttaacgattaaaaaaaaatcagatgtttaacatgtaaaagataattaattggtacattcaaagtctctcattcttttttgggatcatcctctgtgcttgatttttacccaatatttcagagccatttctgccagtgatgaaaaactggagatgaggttgcttagacacagcaaatcctgtatagccaaagggaagctgaaggtcaaagagtgaattagattgatgtcttgttcttgttgaaaacagaatttatttgttttgctgacagagaaggaaaatataaacagtcaagaacgggaagacatattattttgctataaaatgaattcaagaggaaataacagatataaggaaaaacacagtgaatattattataggaataattcattagaatagagagacaatgaacttaaacacttgctaattctcctgctgaaatggatcaagtgattgcttcgactggagaaaaatcctaaactaacctaaatataaatgagtgctagaggacaggcagaatcacatcatgacacagacttaaaggcagagccagaagtacaataaagttaagacctgagctctccatataaaacaaaccttgtgtaacaagtgaaccacccaggtatgtctttaaatttatttttgaaacattagtttctgtccttaattattttctaataaaaataaaatcatttgataaaagaaatacaataataatatccaacgtgaataaagtctgaagactcagagggaaaatatttttttcaataactgtaatcatcgtatttctccaaaaatctcatttgcaaataatattgtgaaaaaaacaattttcgtgatataactcacaaggcagaagtctgatataaaacataaaatgtccttttgtttttcgttttgcatttatttcttatttcatcctgataaaaatgaatgcatgcagttttcaatatgagcaaataagtttttttccatatatcctttaaaactgtcttattcacttcgaatcttataaaatatattcatttaaattatatttatagaaaatcttcttgagaaattatgaaacttctaaatttgaggagatagtgacctaaattactttaaaggtaatcttgatcataatagaatgctgcagaagggctcaaagtttcacttttagaaagtaataaattgcatggcatttaacaggcctactctaaataagccacagccttgaaaagaaaattgctttagacactggtcctcttgccaatgtactgatttctattattagccaacatcttctaccggcccctgtctggggtcaccttaggtctagctgaagctgtatcctcagggccctgaatggattcagaatcagcatgcaacatgcttgtggtggcagtataaaacagtctacgtgagagaatggtccatgagagcaaaatcaatgtaaggataaatgaatgtagatgggatcaccaatcccaaatatgttacaagaagagagtgaacaaagtgacacggagactaagagaagataagaaaagaagtagaaagcaaacatagggtgagtattatggaatagttcttgagtaaaattcagtaactataaaattataattactatggctctatctgttaatgtagtgggctatttaataagccaaagcagcaaaaactagggcattactatggattagttctctgtgtgtttcctgaaacctagagaagattgtaggatataaactcaattgtgtcctagaaactcattttctatgttccagtcttgtaaattctacaaggttctagaaatctgtagtctaagaggcaataaacctaattatgaatatactaagacttagtcccttccaggaaaaagataaagaaaatactagtgaagattatttccttatgaaatgtaaacatggccttaatctagactaaaatacattttttcctaagaattttagggattaagatagattttctgtggtagtaacaggagcacagccgctaaatttatgccactagaagcaaggaagatcataggaaagatataacctgtcaactttgattcattttgagaaatcagtactcatgtaatgacggtaatggtatttatcgtatgtaaaataaaaccataataagcttttaaaatagtttaaggtacaaaagagtattttaaaaacaatgaatttgatctcttaaaatttattatagttttgtcacgagttttattagaagattttccatgtgttctttctgggagaaactatttaaaaagtccattaactttttctaaatgtttaattttttttttgagaaggaatctctctctgtcgcccccaatttttatttaacatgagttaccaaattagggtcactgcattcttattaactatgctagtttaaaaaaatttatagaaactttttaatgcttaaatatgccatcatatcactgccaacatttgtctctttttaatcaatatttaaagtaactatttccagtttttcattttaatgatttatatagtctttaaaaacattcataatggtttcagtggaagccatctctgtgttgatttttatgcttttatgtttctttctttttttgagacagagtcttgctctgtcacccaggcaagagtgcagtggcgcgatctcggctcactgcaacctccacctccccggttcaagcgattctccggcctcagcctcccaagtagctggaactactactactactacaggcatgcactagtagtagtactacgactactactactacaggcatgcaccatcacctctggctaatttttgtatttttagtagagacggggtttgggcattttggccaggctggtcttgaacacctgacctcaggtgatatgcccacgttggcctcccaaagtgtggggattacaggtgtgagccaccatgcccggcctgatttttatgcttttaaatggcttttggtctcattctttacagtaatgaccgctgttggtttgataatcaaccttcataatgttcaaacagtttatatttctgcacatattttctatttaaatactgacaagtattgtggtcttagtctcttagagacaaaataatcataaaatatttgttaggataaaaaactgttaggataaagacataaaaatgaagttttagaaggaaatgtagataactgtttgaaaatgtaaaatcagtgagaccttatttattgtaggataataaatagctattaaaaatatacagatttaacactacatgaaaatttaaacatttttataaaaaagctatcattaatatgatcaatggataaatgacagattttggaaaaatagcatttaccagaatgatttgtaatacctataataatactaatgaaaattaataataataatacttcaaatagataagaaaaagcatattgctaattgaaaaagacaaagttgttaataggcaaattacagatgagaaatacaaatgacctgtaagcatttggaaaaaaaaatgtttaggttcattagaatttttgggtgtagtggatgcaagtattaaaaataatgtattagatttgtacctgataacctgtaggaatttcctacaagtggtttttaaagtaaagcaagatacattaaaatgtgtatacaagtattctattcttaacacacatatgcatattacatctattttttataatataaagaattgaatgtcagagtacatatcagtgttggaggaagagaataaggaggaagcacagaaagtaaaaaggaaaaataggcaccaaaaaagatttggagaatggcagatggccaaggagatgcagctgggaagtgcctcttccatggagaggaacccaaatatccagtaaaccgtcacattttaaacagatcttttgagagaaaacactgaaagttgatacagaggtgacacagacaccatggttgaagagggaagaaatggggcagtctgctcagagtcactagacaccaggactggcccatataccttgaacaaacccaaggaaggggtgagtgaaggaaccctgggacactacatacccacaatgtacttctgagatcctagctacaggagtttctacgacccccatagatctttggactggtaggagagctgcctcgagcacatgcagaggcacagtttgaacccacaccgagcccagaaggctttgttgtgcggtgcagctgcagcaaaatgcaaccctaggtgcccatcccacaagtctccatttcatactgagtggctaagttcctgctatctgccaggctgggagtgaaccgtgcctggcctgctcacatgcccaagataggccccatcacccatgctgcgtgattaaggtacatctggtccacatgcccccttgcctgtcaacgccttcccagacctcatgcctgaccactcctgcaagagggtgtccacagcacaacatccactgcccagcttaagtgttttgttaacagcctgggagaagttcaccaccctgtccccaaatcatagccagtgcttaaagcttagaggccagaggacaaatcagtgagcccaggcccgtgagctcagtcccgtgagcccagtcccaactccccaagactccagtacaccacgcagggacattgagctgagatttgtgacctaatctcaagtgaaggaggaggatcctccacagtcagaatgcagagaagaatgtggtatgggttctcatggggcatgggagctggacacccctccctttgcaagaccagacaacgaaaggtatggcctgatggtcgtagctttttttccagggagtatcctggcacagaatgcctggagtagctcaacaatgtgggagcagatggcttggggaaagcctagttggttgggcttgccgccagggcgagtgtctgtgggagatctgctgggttaggggagtgtgagctaggcagacaccatggttgccagctgggctgaaaatcacgggctgcaagctccatactggtgttgcacccattgtggcactgccctgcctggagatcctctacccttgaaatactgcattttctttgtctctacacttgaaatactgtattttctttgtctcatgttgtgttttgagacagtacaactcatacctaagttgtgtatcacagcaactgcggacataccctaaaacctgctctgactttggtaagcacagtagactggtgggtctctggagagttgtgtccctagagatgtaatcctcagtgtggaccactcctgagggaaggggagtgcagcctgccaaagcacaccatgagataaagaaaatgtggccatggcatcagccactaaaagggtcaccaccaaggcccagaaccagacttggagaaggaatcatgtcttgcctccatctccacttcccagtgcactgttgcggatgcagcagtagctcttcccataaggtcctagaaagtgtgcactgaaagaagttgtttctcatgatgctccagtgaggacaagcatgcaccaagaccccacctgccagctcttactcttaaatctgtctaccagattgaagtttgaattatagcatcacataaaaatacattgctaaaacaagcaacatctatgaaagccactgcaggaacctatctctaaccaaggaacatatatagaaacttcacccctgcaactacccagaaatgaagccaatgaatcacatacaccacagtcatactttcaaggagaataaaaaatataaaagccctgtgatggttaatattgagtgtcaacttgattgtattaaaggatgcaaaatattgttcctgggtgtgttttgagagtgttgccaaaggagattaacatttgagtctggactaggagaggcagaaccactctcaatctgggtgggcaccatctaatcagctgccagcacagctaggataaagcaggcaggagaagacagaagagcagacttactgagtctcctggctttcatctttatcccatgctggatgcttccagttcttcagattttggacttttgtacttacaccagtggtttgccaggggctctcaggccttcagtcacagactgaaggctgcacatcagcttccctacttttgaggctttgggactcggactgccttccctgctcctcagcttgcagatggcctattgtgggactttaacttgtgattgtgtgagtcagtgatccttaataaactccccttcaaatgtacatctatcctactacttcagtacctatagagaactctgactaatacaaaccccatctaaatgaagcaaattcaaaaacaaagtatcaactcccgcagatggaaaggaataagcacaagaactctggcaatacaaaaagccagagtgttttgtggtctccaaagcctctcactagctccctagaaaaggatcctaaccagatgtaaatgtctgaaatgagagacatagaactcagaagatggatggcaaggaaagtcaatgagacataagataaaattgaaatccaatacaaagaagccagaaaaacagtccgaatttgaaagacaacatagctatattaagaaagagccaaactgaacttctggaactgaaaaattcactaaataaatttcgaaatacggttgggagtcttaaaaacagactaggccaagtagaaggaaaaaattcatagcttgaagactgattcttcaaattaacccagtcttgcaaaaataaagaaaaaatattttttaaaaagacaaagccttcaagaaatatgggattatgtaaagaaaccaattctacaacttattgatattcctgagagaaaagaaaaaataaccaacttggaaaacatacctgaggaaaaatttcaagaaaatattctcaattttgttagagatgttgacatgcatacatcagaaatccagagaaccccttttatatactataaagacagccatccccaagacacatagtcattagactatccaaggttaacacaaaagaaaaaacaaatctcagacacagctagagaaaagagcaacactacccacaaagggaaccccatcagactaactggtcttctcagaagaaaccttacaatccagcagagattagaggtctatttttagtactctaaaagaaaagacattccagaaaaaaacattcatattcttcaaaactaagcttcataaacgaaagagaaatggagtctttctgagtcaagcaatcggtaagggaatttatcaccaccagactagccctgcagaaatgcttaagggagttctaaatgtggatgtgaaagaacaatacacacaaaagcagagttaagtacatagtccacagactctataccacagactctataaagcaactacacaattgagactgcaaagaaactagctaacaaaactatggcaggaacaaaatctcacatataaaagttaaccttggacataaatggcctaaatccttcacttaaaagacatagagtggtgaattggaattaaaaaaaaaaaaaagaatcatccatctgctgtcttcaagagacccatctcataagtaatgacactcatgggttcaaagtaaagggatagagaaagattaatcatgcaaatggaaaacaaaaaagagcaggagtttctattctatcagaaaaaacagatcttaagcctaaaacagaaataaggacaaaaaatgttattgcttaatgacaaagggctcaattcaacaagaataattaactatcttaaataaatatgcacccaacattaattggagcaccaagattcataaagaaatcactactagacctaagaaaagatgtagacagcccctcagtaataactggggacttctacacccaactgacagtggtagatagatttatcgaggcagaaatctaaacaaataaattctggacttaaatttgacacttgaccaattaaacctaatacacatctacagaacactctacccaacaaaccacaaaatatatatttttctcatcttcacatggaacatactctaagagtgatcacatatgcagtcataaagcaagtgtcaagaaattaaaaaaaatattaaataataccaagcatcctcttggaccacagtagaataaaaataaaaatcaatagcaagaggaactctaaaacgcagacacaaacacacacacacacacatacacacacacacagaaactaaacaaattactcttgaatgactttcatttgggtaaacaagaaaattaaggcagaaatcaaagaactttttaaacaaatgaaaacagagacacaatgaacaaaaacctctgggatgcaacgatagcagtttaaagaggaaaaattatagtgctaaatacatcaaaaagacagaaatatatcaaattaacaacgtaacattgcacctaaagaaattaataaaacaagaaaaaaactatatccaaatatagcataagaaaataaataacaaaaataagaacaggactgaacaaaatcgagattcaaaaatccatacaaaggatcaacaaaatgaaaagttggttctttgaaagtttaaacaaaattgatagactgctagcaagattaacaaaaaagagaagatccaaataagcacaatcagcaataacaaaggcaacattagatccagtcccatagagattcaaaagattctcagagactactatgaacatttctatgtgcacaactagataacctaggagaaatggataccttcctggaaacacacaacctctcaagattgaaccaggaagaacttgaaacactgaacacaccaacaatgagttacagaattgaataagtaatagaagtccgggactagatgaattcatagctgaattctaccagacatacaaagaggagctcatgccaatcctactgaaactattccaaaaaatcgaggatgagagattcttctctaacttactgtacaaaacctatatcatcctgataccaaaatatggcaaatacacacacacaaaagaaaaccctaggccaatatatctgatgaacatagatgaaaaaatcctcaacaaagtacttgcaaaccacatccagcagcacatcaaaaagataatacaatatcaagtgaactttattcctgggatgcaagggttgttcaatatatgcaaatcaattaatgtgatttatcacataaagagaattaaaaatgaaaaaaataagattatctcaacagatacgttaaagtatttgataaaatccaacatgccttcataattaaaaccctcagtagactaggcatttaaagaacatactaaaataataagaaccatctattgacaaacccagtctacattatactaaataggcaaaagttggaggaattctcataagaacaagaacaaaacaagaatatccacttttaccactcttattcaacttaatacttgaagccctagccagaatgatcgaccaacagcaagaaataatagacatccaaataggaaaagaggaagttaaattttatttcttcactgatgataggattctatacctagaaaaccctaatgattctgaccaaagacgcctaaagttgattaaaaatttcagtaaagttttaagataggcaatcaacatacaaaaagcagtagtatttctatacaatgcaatgttcaaactgagaaccaaatcaagaacacaatcccatttatgagagccacaagagaaaaaaatgaaatacttaggaatacctctaaccaaggaggtgaaagatctctttaagtcgaactacaaaacactgctgaatgaaatcatagatgacacaaacaaatggaaaaatattacatgcttatagattggaagattcaacatcattaaaatgtctttactgcccgaagcaatctacaaattcaatgcagttcctatgaaactgccaaaatcattttttacacagaattagaaaattgattctaaaatttatatttaactaaaaaagagcctgaatagccaacacaatcttaagctaaaagaacacagacaggggcaacacattacctgacttcaacctatactacaaggctacaataaccaaaatagcatggtatgggtacaaaaatagacacatagaccaatggaacagaatagagaatccagaaatgaggcctcattcctacaaccaactgatctttaacataattgataaaaatgcaatagggaaaggataccctattcaattaatagtgctgggaaaactggctaaccatattcagaagaatgaaattaggctcctgtctctgaccatataaaaaaattaactcaagattgataaaagacttaaatgtaaaactttaaactataagaagcctagaattagacctaagaaactcttttggacattgacgtaggcaaagaatttatgactaagtactaaaacacaaaagcaacaaaaaacaaaaattgacaagtgagaccaaattaaactaaagagcttctgcacagcacttgcatgttctattgcaaatatgaaatagcaaaggcatggaatcaacattggtttccaacaatggtggattgtataaagaaactgtgatgcatatataccatggaatactatgcatccagaagaaagaatgaaatcctttcctttgcagtaacatggatgtgcctggatgccattatgctaagcagatgctgggacacaagaaaaatctttaagatatgtcactgcttcttatcaataataatgttctagtgagtaacaagagttaagaacaccactaattatagtactgtaaatataattacagttctaataagacatacacacacagagaacaattttgtctggtggttgaggaaatcttcattgatttaagatattttttgatgaacaggatttttcaataactatcagacgaagaatgtctatgacttatttttaaaaactattttcttctctgccttgcatatctgacattttcatctcctatcttccttgaatacaatatagaacctgacatttctttcctttcaaagatccttaaaacatttcctacatttaatctgaatgtctttctcagtaatttttcttatacaagcaattatggctacattttcttaatataatcatgaaaaagtgagcaactgaaaatttaatctggagaatatatatgaaacatattcaattaattcaagttgttgttaggctgcatatgttcagctttcagtgaaggtgattgataaatgagaaactgaaagaaaacaaaccaataggtgtttttcagaaacagtattattaaaatgcatgtgctttctactgaatgaaagcaatatagactttttcctcgcattggtagttagtaaggtgtataaaaacgactttgtaaagaacaattaatataggttaatgaatcactgtgaagaggggataacactttattctagcaatgatctgcaaggtgttaaaagttaaaaaagatgaaaaacaattgaatagttatttcatcatagtgtttattaaattgattttcctgtatctgtcaagctttacagaaatgtcttcaacagaataacagtgttggaagccaaatgaaatgcattatgaaatatgattcttcacttggtatgcaggtatactctcaggtgttaactcaggcaaagagacaaattcaattttaaagttccatttgttaaaatttgatgattgtgattaaagacccataacaattctatctttgacattttagttttttcttcacagaagcattctactgcaattttcttagttttctttcctcttaactgtggtattacccataaatgctggatttctctgttttaagtgtaacaaacctacaatcaactatttctggaacaccacttcatcttaacaacaaggacccataaatattctaaaaattcaaagtgttttatataaaatgttaaatgatacacataataaatttctaagtagtaattatgattatgcccataattatacccataatttaaaaatatgttacctgaagtaaattattacatattttatgttggaagtattcatttatctttgatctcttttaacacactgtactaggtggtaataaaataaactgccttattgggtagtcatttatcttttgtttcatattttttactggactaatattccaacgctatagatagtgaaatataacattcaaacaatttgatagtagtcaatgaatccagtttttaaaaatgggatccattttctaaaattgagtatatagatacttcatgaaatgtcttatcatacatcctaaaccaaaccaacctcttcccttgactgtcttacagtgcgttattattttatccactgcagcaactagcacatttttcagaacctagtagatattcagtcattgtctatggaatacatgaacacattctaaatttggacagtcatcattcttggtgttttaaaacaaacacttcctgaattgcacaaactattttctaaatagccctgggaattcattgaaggaaggtatgggtaagttgggggtcaaactataaagatgtaggttctcctctcaaaacttcttcagcgtatcctcattgttgtttgtttgcttgcttgcttgttttgaaagatctagatatagtctaatgagagttgtataaatgtgatgttccacaatgattctaacttacatggtgcaaaataataaaatattacattctagctgtttgtggaaaatcagggataatataaaggatctagattttctctctcctctcctcctaagatttattcactcagcaaagttacctggtgactacttactgctagacactgttttagatacttgggctataacgttgataagaacagggcttgaattagtgaaaagtttattttaattagctgtatggcaaaataggaaactaacaaaaataaacatataacatgtcagatggcaatggctgcactgagaaaaatgaaggagaataagaagttctaaattattatatatgaccaatattaccaacatattatagaaagaaatgagttcataatgtttatcagagaatttcatgaaaatcactaaatttttccagaaagccaggcactgataagggaataaacaaacagataaccgattttaatttgatcttctcttacaagtgcagctatgatctgccattgtatataatttaaattttaaaattgtttatatttctttcacataattatgttcttacattttgtttgtttgtttgttttgagacagagtgtcgctctgtcacctaggctgaagtacaatggtgcgatctcggctcactgcaacctccacctcccgggttcaagcgattctcctgctccagcctcctgagtagctgggactataagcaggagcccccacgcccggctaatttttgtactttattagagacagggtgtcaccaaattggcgaggctggtttcgaactcctgatctcagattatcagcctgtgcctcagcctccaatagatgctgggattacaggcgtgagccactgtgcctggccaatattcttacatttaaagatcagacatctatcagattcccttctccctgctacaaacattgtatacttttccataggcacaagattttgttttcattcaggttggactcaacaagtattatttagcagttcattgcatttatccatttacccaatagaggaagtataaaagatacagatgaataaagtgtaataattcttatactcactatttgcccttacatcatgtaagtgctcaactgtacaacatgtttgtgttcccaaaacctaactggaagggataactcagaaaaatagaataaaagtattgtatatctcatacatcttcattttagaatattgtaggggtacagatcagtataaataaaatactttggtaagtgcccaccacatcatctgtttgtcatccttagagccagattataccattctcattaagaaagaaaacttactactgtacctcctacccagtaacatatatatgatatatatatatcatatatatatattttatatataatatattatatatatatataaaacatttgctactggttaggagtaacactcagaaaatcatacttaataatgtagtacaattgggtataaattcacctagtatttttaaattttatgtatattcatatttatatgaatcatcatttaaaatcatgtctactgatcctgatggcattaaaggcataagaggtaccgaggatattaatttaattttgtttacagctatgcacagatatttttagttcactcagatttaatccagtagtctattatttgattaattgtacagctatcaaatcattcaggactcccactgtttcaacaagagtggaaaaatattttttcatttatgtttatatgcagctatttgtagtctaaattaatattctggcaattgatggtgaaattaaaattatttctgtcagatatggtaatttgatgacagtggataagcatgggagtaagagaaagttttgaggaagaggggtactttttgtttacttaatgattattcaaaagatgttaagtaaacattctatagaatgctacagatagtggaatacaacattgaaacaatttaataatgcagtcaatgaatccagtttttaaaaatgggatccgttttctaaaactgagcatacagacacttcatgagatgctttatcacgcatcctaaaccaaaccaactccttcccttgactgtcttacagtgcatagggtatctctacattctaggaaaggaattatctgtttatatgccacttataaaatcatacttaataatatagtacacttaggcataatttcacttagcatttttaaatgtaaaatgttaacgaaaagtgttcttgaaaaatatttctgagaatattttctaaaaaatgaacaaatcgtaacacctaagggatgatatctttctagtgaattgattatcagagtataatgtggtatgttctgattatgttacataatattctgattagcagaacattttaaataagtgaatttagcaaaatatttagaggttaaggaaactgttttacactgactatgttttctgacccaaatgtgagaaagaacccaataaaaagaggcagccagataatgctgttgtttgtgaacttaaacagaagcttgcatgtaatttattgttcaaagaaaaataaaaatagaagttatactttatttagaacttaatgacagtgaaaattacataaaaaggaagactactgaatacagcaaaagctgaaattatataggaaatataaatataaacacacaaaataagtgtaaattataatgaagtaaaaatatatcaaagagaaaaaaggaagtagtacagtaaaaaaaaaaaggtgatgctttaaaaactgtaattaaatagacaaatttccagccagattgatgaccaagtaaagagaaaaggaaggagacagatcaaaagacacaagatgatgaatgaaaagggggtcagcacttataaatgtagtagcaatgtaagccataatgagcacaagaaaacattatcaacttaattttgaatatataaaatagagacacttaaaaaaactgaacaaaaacaacttactagttttaaaagaaaaaaaagtcatcaaacatatatccttccaaaagtatagacttcaaaagtatagccccagatgggtgaacaacttcaaaagtacagtcccggatgggtgaacataaaccacactttaagcaagaactctcagttataactgcttgcaattttagaggataacagccacactcctgaaccagagcttggcaccggctattccctctggaacacccttttatttccttctctaagcaaagacatggaatcaatctaaatgcccaccagtggtctgcgggataaagaaaatatggtatataaacatcatggcatactatgcagctataaaaaagaacaagatcttgttctttgcagggatgtggatgtagttggaggccattatccttagcaaactaccacaggaaaagaagaccaaacactgcatgctctaactcataagtaggagctaaattatgagaacacatggacacatagagtgggggacagcacacactggggctttttggagggtggagagttggaggagggagaagacaaaaaaaataactaatggttactaggcttaataccggggtgatgaaataatctgtacaacaaaccaccatgatacgagtttacgtatgtaatgaacctgcacttgtacccctaaacttaaaagttaaaaatgaatgaagcctgtcagaaccacccactttgtagtcttacattttccctagtattcccaaacccctttgcctagtcaacattttacaaagcgcttttcatcttctactgtgttataatttatatatttttagtgtatattttacacactttattagaatatgagttccttcaaggtaaggactgttgtttgttttgtgctccctgatgtattttcagagcctagaacagggcctggaataaaataagcagccaacactatgcgatgaaaattttttggtgggtataaatgcctttgattcgaaacaaaactcagtttaattgtgtgtgtgtgtgtgtgtgtgtgtgtgtgtgtgtgtgtgtctaaagtcaccctaagcacactgttaataaccctagaatgactgacgtgttcgtattatgcaattttttatttttttcatcatattgacagataaaggattctaattcctataccttttcaataatgcagaagccttcataacatttaaattccattcatggtaaagattcttagcaaataaagaataaattgaaccttgatcaattactttaaagtagttataaaagacctatagtgaatatcatacttcagtattagaagctttctctttaaaataaggaacaagacaaataattggcaacatgacttcttttcaaattgcacagcattagggatccaagccataaaagaaaataaaagacatgtggatcataaagaaaatataaaacgttacttacagacaataaagttgtctgcataaagattataagagaaagctaaaaactattacagtcaaaaagagacatcagcaagcttggtggaaacaaaacaaacaagtacaagttgtcagtgacctttcaacaaccaattaggaaaaaaatatatatatacgttaaatcttaacactgaaaagcaacaaaaatatggaaacagtgcttcttatatgccagattctgattgaaatattttacaagtttaactcatttaattttcccagtgattcttgaggtagaggccatatttttcttaactttaatagatgcagaaactgaagcacagagagcacttgacttgcctaaggtaaaagttaaaaggcggcagatgtagaattcattcacaacaatctagatccagagtatttcttgtgcccctgatgatatgccaattctctggactctatcactaactctattaaatgatcaagaacttgaaagaaaaaaatatttaaattagtccatgaacaggaaatgtccaagtcataaacctagtaatatttcccaaagataatgcttaatagtggtgtcattacaaccaaaatactaaaaaaatgtgcaagccaatctcaaatatgtgggagagaaaacccaatactaatttgaagaggataaaagagcaaggcatctcccttgctgacagaaaggcttcttataactacaacattcatactgaaatgctattatactagatctagcactgaaacaatccaggccactacaaatgaatgaaaaatgagtccagaaaaacacagatccatatatgaaaatttgttttataacagaaattgcattaacaaatcagaggttaaattttaaaaaccataaaatatttcagacaattaattatttatgtggaaaaaagtaaagttgactcattatcctgcccagtacacaaaaatcaattccaggtggacttaaaaacataatgcaaaagcaaaactttaacataattaccaaaaatgtaagtcatcatctttatggtatttaaataaaaaaaagacttctttaaaaagacacaaagaaagcaaaacccataaagagaaaaactgatactcttgaagatgttcaagtttaaaactcatgcaaaatagcaccaaaaacaaggtgaaaaggaagcttcacagaggtactagataattctgctatgtttaactagcaaataattagtatccagaataaataagaaagcaatacatcactaagaaagtgacacacaaccctatagaaaaatgggaaaaaatatgaattggtaattcacaaaagagaaaatccaactgaatactaaatattataagagaatgttgaacaagtcaaactattaaagcaatacaaattaaattgccaataacattattttattcccatcctattgaaaacaattaaaaattctgaataccatgtggtggtgaaaatgtgatttcatgagtatatagcaatttggacagcaaactgacagcatgtgagatagttgatgatattcatatgacccagaaattccactattctagaaaataatcttgtacatatatataataaaatctatataagaatgtatactgcaacattttaaaattcaattaaagattagaaaagctctaaatgtatcaaaacaaagaacttgaaaaacagattataaataaatttatacagtggaagtcagtaaactgataaatcacaaaaacataagtttgagtaacaacatcaagttgcagtagacatgttcagtatatcatttccacaaattaacaaaataaatagtgctatatttttatggctataacacataaaggaaatatacatatgactttctagataggtattatttcttgtatctacaagtagaaaatggggttgcgcagagagggtgatagctacaattgcttctgtaattattctctttaaaatgatctgactcacaaacttaagagctggtggaaattcagcacgttttttttcctctttttctctccctgaaaagcatggaggtgttgtcactctcttcctgagtccctcagtgagcagacgtagagaaaaataccctaactgatctggaagtggaagatttaagttaaataaccttcaggaaaaaaggccttaaactgttttaaggcactaatattaaggtggtttcattgttacaggataacctagcatacgctgactgctattagaattcctgccatgaatcctaaaatatatgatatagtcttagtgatcattgggtgagtggcaaagcaactataactaaagctgaaagcatggtaatacatcttccgcagtgacaggatatttgataagactttcaccagcaaaaatatggaaggtacatgacattcctaataaaattgtagttccaagagaaggatggccagatttagcaaataaaattgcaaggcattcagttaaatttgatttccagatataaaacagatattattgtttagtaaaatttccatgtgatattatactaaatgattatacatatttgtactaaagaaaaacagtgttgtttacccgaaattcaaatttaactggttttctgtgttttacctggcaatcccatcaagagggagacgttgtgaaatagaaaagtagcaatatttcttggttactataaaagttatttaacaagactttataagggaacatgaagtcagagaagggggcaaaacactagtcattttaaaaactaggtggggaaatttggaagtagaggtgaccagatttcacagaagattgtagggtgagaggagtatagaggaagccaatataatacatcaaggtttatggtttgaaaaatggaaagatggaatatcaattacctgaaatgaagaaaatagcacacatttgtaatttgagttgcttattagcacccaactagagatatcaaatagatagttgaatatctacatctttgaattcaggagagagattcaaactgaagacataaatatggacattgacagcatatagatgacagtatactaagtttataaagataaaatagtaataaaagctaatattaacctcttttgtgtcagtccttgatgtaaatttttttatgtgttaactcactgagtccccacaataggtcgatgtaattggttctactataactacactctttaaaaatggatattttagtaaaaagaaggactcaatttatactcaccctcaatttgtagccattggtgtcatctctaagacaatttttagtaattgcctagtcagtgaaccttgccatagtccttagttatgtaaatttattgtattttttggaattccttttcattagccataacgctttaataacatatttttaaaattttgactttaacatctatattgtagtgaatatttaaagaacttcctccaagtttaggatacagaaatgggtaaattatgtctactccctcatatttcactattaagatgatggtaaattagcagtccaagagatcatggtcctgaaagtacagagaaaaaaatagaacccagtgacccaacataactaaggagcatatttgagacattgtcattcttggtatttctgaagaagcactgggatggaagggagttgagatcattttgtcagctacagcactaaattttggtcatgaatatcaaagtgattccatctttatgaggagcctgtggagaatggcaacatgctatatgtatacattttagaatggattaattgccatctgcgtaccttttatcaggttattctatttgttcagcatgccccaagatctcttttgtactttacaaatctgcacttcaattcttcttagttcgagactcacttcaacctaccgcatccttagttttctgcacttacttgttgtttctaaaaaagtatacatgatattatacaataaacatctagaattatacatttatgtactatattcacagaaattggacttgcctttaagccctcctttttacatatattcctgttattgtctcactgctaagtaatattactggatggcaaaataaaccaaaaaacacaaattgattttaatgaaaaatatcaatattaaatattagcttaaataacacaaataagtaaatattgaaatagatgggcatgttaggctgggcagctttttgtgggcacaatcatacaatttcaacttcaaattccatcatataacaggatgttctattggtacaatatctccttgttcacatgaggaaattaagtatattgatattcaccgaacaccaatttttaaatgtatttgaaattaattattttaagtgtctctcaactctcccaatagtgcacaaatatgtagttatgctatatactaataattaaataactttggaaactcacaacttcaaaaaaatgttcgctgttgtggaaagtttccgcagtagagaagggaatgtgaatggtatcagtcttagataacaagaaaactactttactttgtttcaactctactcatttgccatccaaatatgatagaagatgctgctcattcctaacaaatatttccagatatcatgcattccttaaaggagatgatactgattgccctctctattttcactcactttcccattacaattagcagcagattcttttaattatccctgcccttcttaaagcagtctcagatatataaaaattaattgcctggaactcacatctttataattttaaccttttcatgcttcacttatttacggtgacatttatctaaaacacttatcaggtgactgcgcatggtagacatctggtttatcagaaaaggcaggagaaaaaataaatgtaggacattaagcttgctatggtgctttgagactttcctagaaatcgttagctcatcaaaacttgttttggcatggcagaaagacatgtcccattaaaaggatattaatgcaagatcaccattgtcattaaaccatcataccatatattacacatttatgctgaaaatgggttcaaactttttattcccttatcctttaattattagaagaaactttgcagattatagccagataatttaaaataataaaatcaatgtcacttacaaggtcacaggatttagtaaaaccctgctacccatttccttttaagtaacttcgcattttagaaatgaagactgcctattcatgtggcttctgtgattttgttaaacattaattaacaaaatttctagtttttttttttttttcttctagagcagttcagtggaatgaaagaccttttttatcctatgcctctaaccacaaccgggtgtctctatcttaaaagatatttatcaagtctctgcttcatatttccttctctacaccattacagtcctcagcaagccctgctatctcatgatcgcaaatcttggccctttattgttggtcttctttctttcattgctacatgttagaataaatggtgtaagagaatgcttttatctattcaatttctttctctttggctcctgacccactgtctttgtttcagaataattatcagtgcctatatattaccttcacatatgaggcctttgttcgtttcattctttccatctcaattttctgtacattcgtattctctaaagtcttcatctctgtcaattgttcccttatctccctcaagtggacactgtcggcttttcgtagatgttcctactcaaaagagatcttgcaagccagtattttacattaagtaattgttctatttctcgacttttgctggcctataaatataacacatataaaggtagccattgcaggcacagtaaattatttgtctatgaaatcacaatgtttgccccagtatcttaatacaactctcaaatttatataattttttaatttaaaaatttaaaaataactttgcttaaacaaaggcagtttgttttctaacttatctatgtgtgtatgtatatatacacagaaatgtatatgtatacacacatatatattcataaattattgaaagtttcatgcaaattttttactttgccaatatgccccaaaacttgatatgaaattaattatacgaaggagtacagccttgtctttaattagctagaaaaattctcagcccacttaaataaactgttcccaacttggggagataaatttaaatatcttatcttggcaacgaacttataacccttaaaaacatttgctatggcatctatatattatatttcccttgatgtgaaaaataagaaacatttcagaaaaacccacaattaaagaatatcacctggcatcatgtctaaaaatgtataacagtaaaatagaaaagatttgtggatatgacaacaattctgcttgctttcaaaattattttttgctttgttttttgcaaagcctaattaaattaatatatgaatattgagtctattaatcttctctcttaaaaattcaaagcactattttaaagtaaattatcttaggaatattatctaagaatgaacttcatgtggtaaataccagcataagtcattactaaatgtgtttagggtatacaatggaagcagagtctgctgctaggaaaaattgaccttttgttttacaatttataatttatttagtgcagtatttgaaaatcatatttagatataacaggtgacaagagagctctatactaggaaagataattttagtactaccatctataaaagagactaataaatatgaaatgaagatgctataattaaactgtaactcttgcccatgccagcccaacataactattataaaattgtacataactatcaggctgttaatttgaggtaatattgcaggcactacaaaaaaaattcagtaactcatcaaaactattttcttatgaaggtaataaaagctacaatacctgcccatgtcaattatttaaaggtgttcgaagcaaatttcttaaataatttaatttctggagccagacataacagttgactttgtgctctttgacatttactactacagactgttgctaagtccaggcttcaagaactctcctgcatttattctttttaaatcaatggtacaaattatctaactagctatatgtgacgacagcagtggttctcagtttggttttaacaccacctggaaacctgcaaagtctcaggtttcaccccaggtctaccgaatcagaaacactagggataagccccaacaatcactgttttagtaggatcttcaagtgatttcaatgcaggttaagtctgaaaacactggaaaagaggagagaaaaagagagagagagaggagagatggagacaaattcccagaccatacactgcactagaaatagagtgttaggactttacaacaggttcaaaattttagagatgaattatagctgacatttgaacacaaaggaaaggagcccattagtccagggaacatctctgattataaacaacttcatttcctgcttaggtattattcaaatgtatatttaacagtataatgcttctctacaatcaagtaaagctcaaacaaatttaagatgtctttttttttaatgttgtatgttgatgagatttaaactaatagaggcttagctcaattggtgattaaggtgatgagtctgccctggaggtggaaataaatatttcattagacttgtgatgaattctagataattttgacactactagaatgattttgaaagtctggatgatttttgaccaaatatagacccaaatacaaatattgtgaataaaagtattgctaggatttagaaactttaacaagttacataatgtttaaattcatgatttctgtgggtaatttgtggtcagtgctttggggggcagaatgttaaagagatttctatatgagattatgagtaaaactttgtgacaaacaatttgaaaaaatagttgaaaagaagaattcagtaggtaaagttaaaaaagtagaccttactatgaaaaaaagagtagggatatatagaaaatttagatattacgagttgaatgtgtgcagacttcccaagatctatgaatgctataaggaccactacagttgatagcgtagagaaactaaggcaatatttatgcagtgttttagaaggccacagctccattccattactatctgatgatattttagcaaagctggactctgcagtatccttttttgtttgaagaggaatagtagaaggagcatttgtcactcttatttcaccttcaacttctcattatttcccatacacgctcctgttacaattcttgggaaataattaaaataaacttacagccttttatatgggtaatttaaccatatttactagtgtttaaatgattcaaccactgctaggctgtgtagaaaatacaagtactggtagttgtgtgaaagttagctgagtttagataagaggtggcctgaaaagtcaagtctcactagagcactgagattttaaaactattctctgggaactagctagctagctagctagatagatatagatgtttctcaataacaacaataaagaaaattatttcttcatgtatttattacaataagcaaaatattgactaataaaaacacaagaaaggaaaaatactaacaaaaaacatcctgaatactctatatactaaagtgtaataccaaaataaaaattagacacttagcattttctgtgagataaaatagaccaagcaatgagcctcgcttgatgcttcatacaccaggagagctggaaggatgcacaggttcagtaaaaacatgccaaaattaacatgagaagacatgattttatttacttatttatttattttttagagacagggtctcactctttcacctgggctgggatgcattggcacaatcagagttcactggagcctcaagttcttgggctcaagcctcctgagtaactaagactacaggtgcatgccactatgcccaaataattttaaaaaaatttttaacagaaacggagtctcactaagttgctcaggctggtcttgaactcctggcctcaacccatcctttcatctcggcctccctaagtgctggaattacagtcatgagccatggtgcccggcctaataaatgattttcaataaattatatttaacaaaatggattagaattaaccaaaaaataaaactagtaattcaaagctttaaggagtggatgtaggtatgtatctacgcatggatgtctgttaattttgtttctttttaaatcagagaaaacaaatttgaaaagatgctttgaaagtagctgccttcttattgtaattgttttaccaaatagcaaagtctagttcttcaaaattgtcagaacctgttatttatactccatttattcttatgattgggcaatgtgtggcacatttaaggattattttccagtatatcataaatatattaacaatgtgacactttaaggatctaaggaggactgaaaattttatctgaggaattcgttagtctatcacagaggtagctctttgatacctaagtcatcaccttttatagaacgtaacataaaggttgaagttttcacagaataagtaatactgtgaattttcagatagagtgtaaactcctctgggttggctggcttttctgtccttacagagctgcccattgtggtcaaattgaccacatgagaagttgatgatgcagttatgccatgcatagcaaccgcagcaggccttcctcattccaatgtaaatattcattatatgaagcattatctaagacccttttgccttgaaagagagagtaaaaaattaatcaggagtagagtctctaaaatattcatttccctggttcatggagtcatacaagcttctttatcatctcagcattttagtctagtccaaaagcccaaagactaaataaagtaattgatacatggcatccatgaaaataatacaagtaaaatatggctttatgttgactatgcaaatttcatatgaaagaaattgtttccaagaaacttaactcaataaaatttaaaccataaatatttttcaccaattttattcaataaatacttactgagaacctactgtttcctggccttgttatacttgtttggaattcatttgagaagtcaaccatataatacttcatgacattggtctaggcacaggtttttttggataaaaacttaaaagcacaaacagtgaaagaaaatttaaaggcatcttaacagaaaaaaaaaacaatcagcagagtaaagagacaacctaagaacaggaaaaaatatttccaaaccatgtatcagataagatattaatatccaaaatatataaggaactcaaacaactcaatagcaagaaaacaaataacctgattaaacaatgggcaaaaaaatctgaatagatatttctcaaaagaagacatcaaaatagccaacagatatatgaaaaatatatttaacattactaatcttctgggaaatgcacataaaaaccacaatatcatctcatcccaattcgaatattatcaaatagacaaaaaataacaaataatggcggggatgtaggaaaagggaaactctattacactgtttgtgggaatgtaaattagtacagtgtttatgaaaaacaatatggaggttcctctaaaaattaacaatagaactaccatatgatccagtcattctactactgggtacacatccaaaggaaatgaaatcagtatgtcttagagatatccacttccatgtttattgcagcactattcacaatagccaagatatgaaccaacctaattgttcatcaactgataaatgaataaagaaaatgtggtatatatacacaatggaataccattcagccataaaaaaataaatcctgttattcaaggcaacataaaagaacctgaaatgaaataagccaggcacagaaagacaaataccacttgatctcactcacatggaatttaaaagagctgatttcatagtagagagtaaaacagcagttgctagagactgagaagtagagtgagaaggaaagatggagagagactggtcaaaaaattcaaagttacatttgcacaggatgaataagttctggtgctttattgcacattagagtgattatggtaaaaagtattgtattgtatgtttcaaaatacttagaagaaagaattttgaatgtttttaccacaaacaaaatgataactgtgtgagatgatggatatgctgtataccctgaaaagattattacataatgtatagatgtaggaaacatcacactataccccataaatatgcataattattatgtgtcaaaaacaaaatttttaaaagttaatcactctctaatgaaagtatcttttggctcctagacacctgattttttttttccattttgccaaaagtcaaattctacatactaaaacaaagaatttattgtatcctttcaaaacaatatattttaatagcatctatagattcatcaagcaatgatgtaatgaacacaataaaagcttgagtaatctaactactttacaatagaaattgtaatgtttttgtttttgttttgtacgttcaatcctctgaaaaacatgactcttcctgatttttttttcttttttgaaaggagtcttgctctattgctcagtctggagtgcggtagcacgatctcagctcactgcaacctccgcctcctgagttcaagcaattcttcctgcctcagcctccagagtagcttggattacaagcaccaccaccttgccaggctaatttttgtatttttttagtagagacggggttttgccatgttggccaggctggtgttgaactcctgacctctggtgatccacccacctcccaaagtgctgggattataggcgtgagccactgtgactggccaatattttaaatgttaatgtctatcattatattttctcattctcttttgctgtacttattaaatggtctattatcctagaaaataggtaagaagatgaaaaacaaaccagtagcataagatctgaaactgattgataagttatacattaaatatatgatttgatttgcttaagacctctagtatttctattccttttttaatttttagagtttcaaaatttcattataattttggttaaatttactgacttctcaaaacttctaaagtttaatgaactatatacccatcagtgtattaagcagaaaaatagtttagaaaattgtcaccaaagtatgcactttgtatctgaaaacaataatgaggcttctctctgaccattaatcttgggcttttatgacacacaacaattttactattttgtttatttgcttggtttatagtacatgaagacagaaatattatagtttctgtttcatgtagcacatttctttaaaaatgtgttttaaaatgcctttttttctgcaaaactgaattccagtacctaatttctctgttactttggtgggccaggagtcctgccgagaagaatattgatgtctctctcatcagaggtttttgataatgtcaggtttccaatatatcctaggggtatatttttacctttttaaaacaaaatttatttttgcctatttttttcgttctaaggctctttatgacaggactatttaaagcactgaggacaagacaagatgtttatatatacttcctgctgtttaatattcatgcaattctgacaagattaatatactaatttctctgtcattagtttcattaacagatattaattatatctgaatctaaatgccaaatgaatagacagttgggattcaattctatttaagataatcgaagttctctttacaatcatgattggggtggcatacataccatctattctggttagagatggactctggacgctagataaaacacttgggattaaaacacttatcctagaacttatcattataggcacttcacataatgggggaaactgaatatttacaataaccttttggaatagttgatgatgatgatgatgggaaagagagagagaaaggccaggtgtggtggctcatgcctgtaatctcagcactttgggaggctgaggcaggtggatcatgaggtcaggagttcaacaccaacctggccaacatagtgaaaccccatctctaccaaaaacacaaaaattagccaggcatggtggagtgtctgtagtctcagctacttgggaggctgaggcaggagaatcatttgaacccaggagggagaggttgtggtaagccgagattgtgccactgcactccagcttgggcatcagagtgagactccatctctaaataaatacataaataagagagagagagaggagagagaaacatccttttttctggtaaaatttagagactagattgtccaatgaagatggctgaataggaacagctccggtctgcagctcccagtgtgactgacgcagaagatgggtgatttctgcatttccaactgaggtactggttcatctcactggttgaatagtgggtgcagcccacggagggcgagccacagcagggtggggtgtcacctcacccaggaagcacaaggggtcaagggatttccctttcctagccaagggaagatgtgacatactgtacctggaaaaatgggacactcccgcccaaatactgtgcttttcccaaggtcttcgcaactggcagacaaagagattctctcctgtgcctggctcgtcaggtcccacacccacagagccttgcacactgctagtgcagcagtctgagattgaactgcggggcagcagcctggctgggggaggtgcgtctgccattgctgaggcttgagtaggtaaacaaagcagccagggagctcgaactgggcagagcccaccacagctcagcaaggcctactgcctctatagactccacatatttgggcagggcatagctgaacaaaaagcagcaggcaacttctgcagacttaaaaatccctgtctgacgctctgaagagagcagttgttctcccagcatggcatttgggatctgagaactaatagactgcctcctcaagtgggtccctgacccccgtttagcctaactgggagacacctcccagtacgggctgacagacacctcatataggcaggtgcccctctgggatgaagcttccagaggaaggatcaggcagcaatatttgctgttctgcagcctccactggtgatacctaggcaaacagggtctggagtggaactccagcaaactccaacagacctgcagctgagggacctgaatgttagaaataaaactaacaaaggaatagcatcaacatcaacaaagcagaaaggaatagcatcaacatcaacaaaaaggacatttataccaaaaccccatctgtgggtcaccaacatcaaagaccaaaggtagataaaaccacgaagatggggagaaaacagagcagaaaagctgaaaattctaaaaaccagagtgcctcttctcctccaaaggaatgcagctcctcaccagcaacagagcaaagctggatggagaatgactttgatgagttgacagaagtaggcttcagaaggtcagtaataacaaacgtctccaagctaaaggagcaagtttgaacccattgcaaggaagctaaaatccttgaaaaatggttagacgaatgcctaaccagaataaacagtgaagggagaccttaaatgaactgatggagctgaaaaccatggcacaagaactttgtgatgcatacacaagcttcaatggccaattcgatcaagtgaaagaaagggtatcagtgattggagatcaaattaatgaaataaagtgagaagagaaggttagagaaaaaggagtaaaaagaaacaaacaaagcctccaagaaatataggactatgtgaaaagaccaaatctacatttgattggtgtacctgaaagtgatggggagaatggaaccaagttggaaaacactattcaggatattatccaggagaacctccccaaactagcaatgcaggccaacattcaaattcaggaaatacagagaacaccacagacactccttgagaagagcatccccaaggcacaaaattgtcagattcaccaaggttgtaatgaaggaaaaagtgttaagggcagccagagagaaaggtcgagttacccacaaagggaagccaatcagactaacagtgggtctctcagcagaaaccctgcaagccagaacagattgggggccaatattcaacgttcttaaagaaaagaattttcaacccagaatttcatatctagtcaaactaagcttcctaagtgaaggggaaataaaatcctttatggacaagcaaatgctgagatattttgtcaccaccaggcctgccttacaagagcttctgaaggaagcagtaaagatggaaagaaacaaccaataccagccacctcaaaaacatgccaaattgtaaagaccatggatgctatgaagaaactgcatcagttaactggcaaaataaccagcgaacatcataatgacaggatcaaattcacacataaaaatattaacctaaaatgtaaatgggctaaatgtcctaattaaaagatacagactggcaaatcggataaagggtcaagatcaatcagtgtgctgtattcaagagacacatctcacatacaaagacgaatataggctcaaaataaagggatggaggaagatctaccaaacaaatggaaagctaaaaaaagcaggggttgcaatcttagtctctgataaaacagattttaaaccaacaaagatcagaagagacaaagaaggccattacataatggttaaagggatcaattcaacaagaagagctaactatcctaaatatatatgcacctaatacaggaacacccagattcataaagcaagtccttagagacctacaaagagacttagactcccacacaataataatgggagactttaacgcctcactgtcaatattagacagatcaacaagacagaaggttaacaaggatatccaggacttgaactcattcatttgaactcgcacttataaaattgaccacataattggaagtaaagcactcctcagtaaatgtgaaagaacagaaatcacaacaaattgtctctcagaccacagtgcaatcaaactagaactcaggattaagaaactcactcaaaaatgcacaactacaaggaaactgaaaaacctgctcctgaatgactactgggtaaataacaaaatgaaagcagaaataaagatgttctttgaaaccagtgagagaaaagacacaacattccagaatctctgggacacatttaaagcaatgtgtagagggaaatttatagcactaaatgcccacaagagaaagcaggaaagatctaaaatcaataccctaatatcacagctgaaagaactagagaagcaagagcaaacaaattcaaaagctagcagaaggcaagaaataagtaatatcagagcagaactgaaggagatagggacacaaaaaaccctccaaaaatcagtgaatccaggagctggttttttgaaaggaccaacaaaattgatagacctttagaagactaataaagaggaaaagagagaagaatcaaacagacacaataaaaaatgacaaagtggatatcaccacagatcccacagaaacacaaactaccaccagagaatagtataaatacctctatgcaaataaaccggaaaatctagaagaaatgtataaattcctggacacatatgccctcccaagactaaaccaggaagaagttgaatctctgaatagaccaataacaggatctgaaattgaggcaataattaatagcctatcaaccaaaaaaggtccagggccagacggattcacagcctaattataccagaggtacgaagaggacttggaaccattccttctgaaactattccaattaatagaaaaagagggaatcctccctaactcattttacgaggccagcatcatcctgataccaaagcctggcagagacacaacaaaaacagagaattttaaaccaatatccctgatgaacattgatgcaaaaatcctcaataaaatactggcaaaccaaatccagcagcacaagaaaaagcttatccaccacaatcaagctggcttcattcctgggatgcaaggctggttcaacatacacaaataaataaatgtaatccatcacataaacagaaccaatgacaaaaaccacatgattatctcaatagatgcagaaaagaccttcaacaaaattcaatggcccttcatgctaaaaactctcaataaatcaggtattgatgggatgtatctcaaaataataagaggtatttatgacaaacccacagccaatatcatactggatgggcaaaaaatggaagcattccttttgaaaactggaacaagacagggatgtcctctctcaccactccttttcaacatagtgttggaagttctggtcaggcaaatcaggcaagagaaagaaataaaggacattcaattaggaaaagaagaagttaaattgtccctgtttgcagatgacatgattgcatatttagaaagccccattgtctcagcccaaaaattccttaatctgataggcaaattcagcaaagtctcagatacaaaatcaatgtgcaaaaatcacaagcattcctatatgtcaataacagacagagagccaaatcatgagtgaactcccattcacaattgctacaaggagaataaaatacctaggaatccaacatacaagggatgtgagggaccttttcaaggagaactacaaaccactgctcaatgatataaaagacacaaaaatatggaagaaaattccatgctcatagataggaagaatcaatattgtgaaaacggccatactgcccaaggtaatttatagattcaatgccatccccatcaagctaccaatgactttcttcacagaattggaaaaaaactactttaaagttcaagtggaaataaaaaagagcccgcattgccaagacaatcctaagcaaaaaagaacaaagctggaggcatcatgtaacctgacttcaaactataccacaaagctacagtaaccaaaactgcatggtactggtacaaaaacagatatatagaccaatggaacaggaaactgggctcagaaataacaccacacatctgcaaccatctgatctttgacaaacctgacaaaaacaagcaatggggaaacgattccctatttaataaatggtgctaggaaaactggctagccacatgtagaaggctgaaactggatcccttccttacaccttatacaaaaattaattcaagatggattaaagacttaaatgttagacctaaaatcataaaaacctgagaggaaaacctaggcaataccattcaggacataggcataggcaaacacttcatgactaagacaccaaaagcaatggcactaaaagccaaaatagacaaatgggattgaattaaactaaagagcttctgcacagcaaaagaaactaccatcagagtgaacaggcaacctacagaatgggagacaatttttgcaatctacccatctgacaaagggctaatatccagaatctacaaagaactcaaacaaatttacaagacaaaaacaaaaaaacccattaaaaagtggtcaaaggctatgaacagattcttctcaaaagaagacatttatgcagccaacagacacatgaaaaaatgctcatcatcactggtcaccagagaaatgcaaatcaaaaccacaatgagataccatctcacaccagttagaatgacaatcattaaaaagtcgggaaacaacagatgctggagaggatatgaagaaataggcacacttttacactgttggtgggagtttaaattatttcaaccagtgtggaagacattgtggcgatttcttaaggatctaggactagaaataccatttgacccagcaatcccattactggatatatacccaaaggattataaatcatgctactataaagacacatgcacacgtatgtttattgcagcactattcacagtagcaaagacttggaaccaacccaaatgtccaacaatgatagactggataaagaaaatatggcacatatacaccatggaatactgtgcagccataaaaaaggatgagttaatgttctttgcagggacatggatgaagctggaaaccattattctcagcaaattatcacaaggacagaaatccaaacaccacatgttctcatagttgggaatcgaacaatgagaacacttggacacatggcagggaacatcacacactggggcctgtcagagggtggggggctggggaagggatagcattgggagaattacctaatgtaaatgacgagttaatgggtgcagcaaacaaacatgccacgtgtatacctatgtattcaatctgcacgttgtacacatgtaccctagaacttaaagtataaaaacagaaattagagacattttctgcctcaaatagatataacgcatgttactaatttattaagcagaactcatcaagatgccaaaagataaaaatctactaaatcaatgatatagttaccaaaagtcaccctgtataattcatggatttaggacatgattaagtacatacttagcataattgaaaggtgtccacctgaaagcaacagtaatcacacacacacagacacacacatgagtcaatctgtcaaaattacacaccaagcttttaattaattcatcaattatacatcagtgtttctggattattagaattattttgacacattaaaaagtaaacactcctaatttaactcatattatttttgataaaggcattgtggtatgccatcatttcataatatacactgaaacatattcaaataaaatgaaactatatctgagacatgcttcaagtaatttgggaagaaaggatgggagaagatatagttggtgcaagtatgcctatgaattggtaattgttgaaactgggtgataaattcatagtgtggtcatgatggtcttctgtttttttgtatatatttgaaaattgctatataaacatttttgaaatacaaattcttaggccacattccagtcatattgaattagaataccctggagttgaagcttcaagtgagaggtgaagccagctgagcttctgggccggatggggatttggagaacttttgtgtctagctaaaggattgtaaatgcaccaatcagcactctgtaaaatcacaccaatcagcatgctgcaaaatggaccaataagtgctctgtaaaatggaccaatcaattctctgtaaaatggaccaatcagcactctgtaaaatgggccaatcagcaggatgtgggcggggccaaataagggaataaaagctggccaccagagccagcagcgtcaacctgctcggatccccttccatgctgtggaagttttgttctttggctctttgcaataaatcttgctggtgctcactcttagggtccacaccacctttaagagctgtaacactcactgagaaggttcatggcttcactcctgaagtcagtgagactacaaacccactggaaagaagaaactctggacgtatctgaacatccaaatgaagaaactccggacataccatctttaagacctgtaacattcactgtgaagctccgcgcttcattcttgaagtcagcaagaccaagaacccagtggaaggaacaaattccagacacatttggcaaccacgaagggataatcaccaagtagtgagtaccatcggacccctttcacttgcaattctgttctatttttccttagaattcaggatctaattatcgggcacctgtcggtcagttaaaagtggttggtggccgggcgcggtggctcacgcctgtaatcccagcactttgggaggccgaggcgggcggatcacgaggtcaggagatcgagaccatcccggctaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagggagccgagatcccgccactgcactccagcctgggcgacagagcgagactccgtctcaaaaaaaaaaaaaaaaaaaaaaaaagtggttggcacggccactggaataaaaacacgggtgtcaggcattctaggaaagggctctcttacaacccctgactcttcggggttggaagcattgatttgcctggaaccagcttccacttttcttgtacttctgggctgagccgagggtagacagagtggaaagccattcagctccagggtcccaacaacaagttggttgaccctgaggctgagcggaactctcaaagacatgtcgcctaagggagactcgcccatctctcctatctatcctgacccttgcctcctgggtcctcatgcctgtcagacaaacttcctcttgcctctcttctctgaggctagtctcgcttctaaaaaccactccctgtctctggtgcttttctagtttctcgtataagaatgatttctagcataaactttaggactctattcccttctttaggcacccaggctcaccaatcagaaagacataatttttgcccaaagccccatcggaggagccagactatcttatctggaattttaggacccctcctcaggctagcaggcctaacaaaggctattcctgaagctaggatatggggagcctcagaaattgtatccttgctattcatataagtgaggacaaaaggcatcactcttccaaccctggagatctcttccctctctcagggtatggccctccacttcatttttggggcataacatctttatagggcatggataaagtcccaatattaacaggagaatgcttaggactctaacaggttttctagaatgcattggtaagggccaataatccgaccttcctcattcctccttgtggtctaggaggaaaactagtgtttctgctgctgtgttggtgagcgcaactattcccatcagcagggtccagggactgttgtgggtgcttgggcaagaggggtttctgctgccacgtcagtgagtgtaactattctgatcagcagggtccaggggccactgtgggttcttgggcagggggagaaacaaacaaaacaaaaccgcaggtggttttgtctttcagatgggaaacactcaggcatcaatgggctcacccttgaaatgcatcctaagccattgggaccaatttgacccgcaaaccctgaaagaaaggcagctcatttttttctgcactatggctcggccacaatattatctctctgttggggaaaaatggccacccgagggaagtataagttacaatactatcctgcagcttgactttttctgtaagagggaaggcaaatggagtgaaataccttatgtccaagctttcttttcattgaaggagaatccacaactatgcaaagcttgcaatttacatcccacaggaggacctctcagcttacctccatatcctagcctccctatagctccccttcctgttagtgataaacctcctctaatctcccttgcccagagggaaataagaaaagaaatatccaaaggaccacaaaatcccccaggctattggttctgtcccctttaagtagggggaggggaatttggcccaacgtgggtacatgtccccttctccctctccgatttaaagcagatcaaggcagacctggggaacttttcagatgatcctgataggtatataggtgtcctacagggtctagggcaagcctttgatcttattggaaagatgtcatgctattgttagatcaaaccctggcctttaatgaaaagaatgtggctttagctgcagcctgagagtttggagatacctgatagcttaatcaagtaaatgatagaatgacagctgaagaaagggacaaattccctactggtcagcaagccgtgcccagtatggatccccactgggacttcaactcagatcctggggactggagttgtaaacatctgttgacctgtgttctagaaggactaaggagaattaggaaaaagcccatgaattattcaatgatgtccaccataactcatggaaaggaagaaaatcctgccttcctcgagcagctatgggaggccttaaggaaatacactccactgtcaactgactcactagagggtctattgatcctaaaagataagtttattacccgatcagccacagatatcaaaagaaagctccaaaagtgagccctaggccctgaataaaatctggaggcattattaaacctggcaaccttggtgttctataatagggaccaagaggaaccggcccaaaaggaaaagcgagatcagagaaagactgcagccttagtcatggccctcagacaaacctaccttgctggttcagagaggacagaaaatggagcaggccaatcacccagtggggcttgttaccagtgtggcttgcaaggacaccttaaaaaaggttgtccaatgagaaacaagctgccccctcatccatgtccactgtgcagaggcaatcactggaaggcacactgccccagagggcaaaggttctctgggccagaagcccccaaccagatgatccaacaacaggactgagggtgcctggggcaagtgccagctcatgtcatcaccctcactgaaccccaggtacgtttaactattgatgaccaggaaattgacttcctcctggacactggcatagccttctcagtgttaatctcctgtcccagatgactgtcctcaaggtccgttaccatccaaggaatcctgggagagcctgtaaccaggtatttctcccacctcctctgttgtaattggaagactttgctacagatagtaagtatgcttatctaatcctacatgcccatgctgcaatatggaaagaaagggagttcctaacctctgggggaacccccattaaataccacaaggaaatcatgcagttattgcatgcagtgcaaaaacccaaggaagtggcagtcttatactgccgaagccatcaaaaaggggaaggagaggggagaacagcagcataagctgctgacagaggcagggaaagaccagcagaaaggaaagagagaaagagacagaaagtcagagaaagaggaagaaacagagagacaaagaggaggagacagagagaggaagagacagagacaaagaagaagtcaaagagtgagagagaggaagagacagagagacagagagtcaaagaagtaaagagaggaagagacaaagagggagtcagaaagagaaagacagacaaagaagagagagacagacaagaagtcaaagagagagaaagagggagatagaagtagtaaagaaaaaacagtgtaccctattcctttaaaagccagggtaaatttaaaatgtataattgataattaagggtcttctctgtaaccctataacactccaataccaccttgttgtcagtgtaaacaagggtgtagcccaaaagcactgaggctactgacaacccatagccttcctatcaaaaatccttaacccagcaggtttccaaacagggatctaaatcttaatgaattaccatacaaaggtctgaccagatctaggaggaactcccttcaggacaggaggatagatggttcctcccaggcagttaagggaaaaagacacaatgggtgttcagcaagtgataaggaaactcttgtagaagcagagttaggaaaatttcccagtgattggtctgctcaaacgtgcgagttgtttgcactcagccaaatcttaaagtacttacagaatcaggaaggagctatctataccaattctaagttaatatggactgaacgaggttttcattaatagtaaagaaaaattataatcccaaacttacaaggctttcaactaaagtttgctaaaagttaacagtgtaatatgtattatcctgctaccacacactcttaaaggaattctcagacagtttgcaagaaataacgaaatctatccttactctacaatccgaagtagactctttggcagcagagactctcctaaactgctgaggcctagacctcctcactactgagaaaggaggactctgcaccttcttaggggaagagtgttgtttttaccctaaccagtcagggatagtaagagatgctgccaggcatttacaggaaaaggcttctgaaatcaaacaatgcctttcaaactcttataccaacctctggagttgggtgacatggcttctccactttctaggtccggtagcagccattttgcaattactcacctttgggccctgtatttttaacctccttgtcaaatttgtttcctctaggatcaaggccatcaagctatagatagtcttacaaatggaaccccaaatgaactcaactaacaacttctaccgaggatccctggactgacccactggccctttcactggccgaaagagttcccctctggaggacactacagctgcagggccccttcttcgcccctatccggcaggaagtagctagagtggtcatcgcccaattcctaacagaagttggggtgtcctgtttagaggagggattgagaggtgaagccagctgagcttctgggtcggatgggggcttggagaacttttgtgtctagctaaaggattgtaaattcaccaatcagcgctctgtgtctagctaaaggattgtaaacacaccaatcagcacttggtaaaatcgcaccaatcagcactctgtgtctagctaaaggattgtaaatgcactaatcagcgctctgtaaaatggaccaatcagcaggatgtggatggggccaaataagggaataaaagctggccacctgagctggcagcggcaacctgtttgggtccccttgcacactgtggaagctctgttttttcactcctcacaataaatcttgctgctgctcactctttgggtctgtaccacctttaagagctgtaacactcactgagaaggtatgtggcttcactcctgaagtcagcgagaccacgaacccaccggaaggaagaaactgcagacacatctgaacatccaaaggaagaaactccagacagaccatctttaagagctgtaacactcactgtgaaggtctgtggcttcattcttgaagtcagtgaaaccaagaacccactggaaggaacaaattctggacacacaagttcctaggcttcatccaaaacattaaatcagactctttgaggtagagtaagacacatatttacaagctagttatgcaagttatgatccaggtaaaacactaatcgattgtatccaaaatataagtcttctatcattctgttgtacaaaatgaatgaaatctctaaaatatttctttaggaaccaacacaaagatattccattgtactaagtttgttttctggaaaacaaactctcaggtaaatttgcatgtatgatgtttataagggaattaacttttaattaattatgagaggggagttgaaaagaagtacaatccaggcagagacaacaagcccacagaatatcttaaaaggaatggcttcctgagttctcatgcactgaggctagatgactgggccttgatataactctctccagccccactgaccagccatttgatactatgcttccaggtgatgaatttgtgtgaaatggttgtctttaaatgaagggcaattcctcaggagagactcaagtaattttcactagccagcaacattcctagcatgtggggatgaaggtaattgagaggggagaattcattgcctcaatggttacacatgtaacacttcatagcacccaccacatctataagagctaatatattttttctgggaatttctttactgtcttttctcatttatctttatatatcccttacaagtcaacaaagaaatactgcagtggtggttatagtgactacactgtggttgctggctgtttttttagtgtttaaattaaataatattacccttaggaataaaatgtaaaaccatttttttaaaattcccatcaaaatcaacataacatactgtttgtgttagtaacagaaatatatttaactgcatagataataatgaatagcagtctggattttcaaataaattatttcaagatgatatttactaggttagatacatgtaccctaactcccacccattcacttcctagaaatgtgttttaggtgatgttatttaggtggtaaaatcaggtcaataactcctactgaatccttagatattatgtgttgtacagggaaaaggtagtataggtaaaacttgtgtgagacacactttgttgttttagactagactgtaagttccagctgtgtctgaatgtttgtgtttccccaaaatacatatgctgaaatcctaaccctcaagatggcggtattagaaggttgggaggtgattaggtcatgaggggtgttaacaatagttcccttaataaatgaaaggcctaagagagacccgtcgcacattccactatttgaggacaccactaactgtgagccaaaagcaggacctcctcagacatcgaatctactggtgcctttatcttagaatgccaacctccagaactgtcagaaataaatttttagttttataaatgcctagtttgtggtattttttatggcagtcgatcagactaaaacaaatgtttactctgttgtgatcagatagtttatataacttacctaacacataataggtactctagtaggtcgctcctcctttgacctcagacctttccatttgagaaattttacaactttatttcaaaatgcattccatctactttacaaagtaaaaatacaaaggcctcttatcatgatgtgactattaggctttacaagcctatatcaaagtgtttcatgtaccccataaatatatacacccacacatattaaaaatttaaaaagtgaatgttatacacctccccacttcctttacaaaacttagctcaattccatctggataataagaaaaataggaaactttattgaataatgagtcacttctatgtgtaatttccactgctagtatgagccttcagaagggactggctttaagaattggtacagttcttgactgagaggaacttccaccacctagcagatggggcaatagattacaagggcaattatcactcagagaattgctgataaggtcaaattactgctgtcactttattcttaatctctgtatgcatttttttttctaaaagaaaactgcatatacaattctacagaccaaaaatattgcaaaaaatatgagtttatatgtcctaagagggttccccaattatcacaattgtttcaaatggaaacaatttcatatcccatatgtacatatatataaaaatatatttatgtatgtgtatatatatgcatatatatgcacacacatacacatttctctgcagatgttagtatgtggaaatgtattgctatataatagggacaataattagaactcaaaatctagagtaatgcaactgaaagtcatatcatgcatgtattacaagtaagatactctgcaatgtatacaagagaatgtaatttttaaggaccaaatgtgtgttattaatcaggtatacactctgtaaacactacgtggtataaaattgcttctcaacacaggaaatatttataacctaagtatacagtccaagaagtactttatttctgacacttcataccaaagcaaccagactgacaaataagcattctgagtaaaagcagtgttttaaataacttttgaacccaatgcatgcatgcaaggctgataaatgcaaacccttttacataatactcaaatcatattaaagagatgcttcttgacagagatacacttaaaccattctacatttctcctttttgttctcctgtgtgaaaatgtcaccttaaaagcaattttttaagaaacaagtgctgtttcatttcatgtcttcagatacattgtctgcccatgttttagcgattaggaatttagaggtttttggatgtttattacaactctttgacttatcagtataaatatttatcataccaatcatatttattctttgattatcttgacatggcaaggttttttcaattttatttaaaagagccagctgttttgtatcttatttactcacccatatcattgtttcccgttaaattaacactggcataagccagctgcaagttgcaaggaaatcgcactgaaaacagagctactataaattgtattcgcctctatataccaacaaaaacaaataaaacttttttattaatctctatgactttgttgttgtttaaagcaaatctacattaggaagagttgtcaggaaatttgggaagttatattgtttcctgaaacctgatattgattgatgagagtataccaatgattgcaagttctgagaaaagagttttacacaaaatgaacagcaaaagcttgggcatgagaacaaacttagaatgtccaagggataggaaaaaacgtcctggcagcagagcagcagataggcaggaattgaatcatgtgtactttggtaagccatacacgggcattgagaattttattcttaccacagttggaagtcactggaatattttaagcaagagagtaacttgaactgatttatgcttttaaaagattaccctgattggctgtgtgaaaaataagcgatagggagcaaaagtagaaacagggacaggagatgacagtggcttatgtataagatttcttctaaggatcttgaaagcatcatgaactaacatcacttgggaagtagataaattcattgctgtgtccatagtctgtttatttccctttttttttgtatgtatttgcagaatatgttagtaaacaaagtgaaattcaaggaaatcactattagggctgcctacaaatcaagtcggtttagagctattatagttgagtagtaatattctttcagaaaaaatcttaatcataaagcccaacacttatactatggcttcttaaaagtgaagctgcaaaactgcttgtgaacaatcttacagctatttttataactttttaaagtgttatgtacataatttcttttctgatgacctcattgaattctaaaccatcttttagccacacataagccccaacagttaaaactattaaaatgcattagcatgtccttcattatttgttttaatcaagaagaactgaaataaggaatatgtaacataaatttagttttgctaacgaatacatcagagagaaatatatctccttagagaggaatatattttatctaggtattttttttgaacagtgaagcactttttaaaaaagtaatactgtacacagaattccaaaatataaaacagacaaataaattaaggtacctttatacaaagtcattctatgcagctattataaaaagtaaaatatatatgcattgatagggaagttttaatttattccatataagtaaatattaattgagcattttatatttgagccatcatcctaacagtttgtgataagatagcaaatgatatagggaaagtctctgttttcagatgtttttatattttgaaggaagtagacaaatattaatcaattaagtgaatatgcaagaaatttccacatagtaaactaatctgcagaaaacaaagtcatgaattatctaattcttgagggaacctattacagactgtgttattagggaagccttttttaaggaggcatatatgagggaaaatctaaataactaaaggagccagccataggaaaatagcagaagagaatattctggaaaaaaaaaatggcacacaaagacatttcacctcagccaaagaatatgggatgataaaggacagaaaaaagaccaggaagcaggaggaagagaggtagtagaagcagatgggatgaggcaaatgagacaagatagtgtaggaccttacaggtcatggtagaggaagacacttagatatgattacttaataagaagctatcatagcactgaagcatggaagagatgtgatctaatgtctatttttcaatgccattctgaccagatttcgggcaaacctggtagacacccatagtaagactccaggaaaaaaaaaatttgatggtttgattatatatttgctttaaacatttggcttttcagctgccttgcatccatttccctttaacaatttatctgtttttaaattaatgaccttttctattagacacactttcatcaggggccctgtattgattggtatcttccagagaaacagaaccaataaaatgtgtgcgtatgtatgtatatgtgtatgtttctcagagagagagagcgagagaaagataatttaaggaactggctcatgtgattgtggagttgggcaagttcaaaatctgtaggacaggccagcaggctggagacatagggaggaattgtcatagtttgtgtccaaaaatagtttgccagaatcctcagttttttgagggaggtcagtctttttacttaaagccttcaactgactggatgcagccaaccgatatcatagatccaaagtccagtgatttaatgttaatatcatctgaaagcataccttcacatcaatatctagatatatttgacagatatctgggtaccatgtcttagccaagttaatgcataaaattaactatcccaggctccattccctctggtcaaagggcaagcatgtgattcaagctaggtcaatcagttgctctctccctcaaatttgcactgggttaaaaagacaaagaattacatcctgtctatacagtcatgccaaatcacatgatccatctccaacccctaaaacacataggtatggcttttgttctcaaccttcagctcctaattcctttaaaaagttaccagtatattctgtgaggccacagtgaatcttctaatagtttacttttatgtaggccagagtcatttggcttgtttgaaattaaatatatatatatatacatatatatatatatgtgtgtgtgtgtatatatatatatatatatatatatatatatatatatatacatatatatatatgtgtgtgtgtgtatatatatatatatatatatatatatatatatatatatatatataaaattgcttcagtcaggctccaggtacttggaaagacattcatcaaattaataatggttatcctggggactgggctttgaggattgaggatttctgatttttaatatgtgtctaatctttttaaatgtttcagtataatttataattagcagccaattattttataattaaagtaaatcctgaaaaactttctacattagtgtgtggaaaaacagcacaattgccaaatttatagggcgaagaagtcctatgtttacctagaggggaaactctgaaccaccacagcccaacaggaggctctgtgggacaatttggaaaacattaccataatctattgtttttatatttatttagaaaagaaacaaagggagcaagatacctccccgtctgacatttaaaatttgattcactgatatattttggctcacagtatcaccttgtggcatttggcatctgctgctccccctccccaaagtcataatatactgcataattaattcagcacaagtagtgacaatgccaactctgtttatttaaaaagatacctcgactgttcttttgaataaatagattgcattcctttaaaaatccaaaataatactgaattaattagaagtagtgcaatcagaataaattaggtcctatctacatacaactcagttttaaagctagaaattcaaattaataactaatttgaattagctacttcttcccatgtgtctctgagtaaacaccaagcagacgaaaaatttccattgccaataataatagtaacaatagcaaatattgttaaactcttactatttgctggtaactagttaagcatgcttcataaatcttcttttatagtagtcatgaaaaccacatatctgagctattaccttcattttgtggatgacaagttcaaactgagttttagagacagtaagcaacatacccaacatcacacaagatttaaattcagactctgagtgcttacaaactatcttacgctgtgatggtaaacatctttgcaaattttccctcataattgagtaagccatcagagtttcagaataaatgtgtaggaaaacttataaacatcagggacaagcttaaggacttgacatcttttacttttgtgtgtgtttcatagaaaaaaatagctcaaaggttaatttaaagtaatactttgaacaaactccttaacaagaagagttagacttcatacttgttattcagcagaatagtgactttgttcatacaactaaactaacgaactcaattcctcctttcgactgtttcttttttttgcctccttaatagttattttatacctgtttcttattatttatttattccactaaaaatttcaatgtcttcacattatctataattggtgctatggtatattacagttgaatatagttgaacctgttcaaatacattttgaccaatgataaggagaaccaaggattcctttgctttcatattacttcacacatgactttttaaaaaatttactttaatttctgggttacatgtgcagaacgtgcaggtttgtaacataggtatacacatgccatggtggtttgctgcacccatcaacccataatctacattaggtatttctcctaatgctatccctcccctattccccgacccccagacaggcccccatgtcacacaccacttttagaatcacaatacaatttcacattcaggacaatacttgctgaattttagtttgtgtttgtgtgcgattgttgatgggaagaacaaaatggcagtcacatcatatgttgactctagatgtgttatttatcatttgtttcttcaaaatattttgacaaacgatcttcgcattaaaaggctgtgggcagtttgggagctaccacctgtttccctcttcattgatcactttgctggccccaaaacatatccacagaaaaaattttgaaagtgattggccaagggactcagtgaggatatactttaatatttagaacactattaaaaacaaaaggagacattattaacaatatgctgggacaagaattataacctgggactttctatggcaaatgggatatatgattacttgatctagactgtataaaataaataatatatttggataatctacaattacaataagtatttatacacacaaacatatatatacgtacatacacacacacacacacacacacacacacacacacacttcacatatgtacctttacaaccaatatactttaattgagactgagaggacaagagccatgattattcatatttatattcaatgacttattacataataaacatattttgaaaatttgatgagttaattcaattcaaaatatgcaaaaaatatcaggctgggcacggtggctcatgcctataatcccagaactttgggaggccaaggcaggtagatcatctgaggtcaggagttcgagatcagcctgaccaacatggtgaaaccctgtctcaactgaaaaaatacaaaaattagccgggtgtggtggcacatgctggtagtctcagctacttgggaggctgagagaggagaatcacttgaacacaggaggcataggttgcagtgagccaagattgtgtcactgcactgccttggtgacaaagtaagactccatctcaaaaaaagaaaaaaaaaatactgtatatctgctatgtgaagccaatgggtttcaagttaggatataatgacaaagaagtttaaagaattcatagcgtagtgaaagaaaaacattcatagtaaatgaacacactgtaatgaagagtttaatatttatagtaggaataaatgggatcacaaagagaaactattagttttgaggatctatcattttaggttaactgatatgaaccttcaataacaaatatgtgcttaacatatgaaacagagagaaagtagggtaattctcagagttgttcagggtcatatgtgatgttctgtgtgcctagacaagttgtactatgtgtgttagaagagatgagactggaaagtggtcagatataagttactttgaatgataagataaaagccgtggaattcatttggtgtatgatggaaaacactgaacctttttaaacaccaaaaaatcagatcagcattgtattgaaaaacaaaaacaaaaacaactttggctttattgtgatggtggttagaggagtgagagactggaggccggatgccgagtttagagtatgtctttaaatagatgttctgacagtgtaaatagacaggtgtcaaacagatttgagtaagagtatataggtaatgcagaaaatggctttggagattgattgagtttggaacggaggtcattgaagtctaggttcaaatcaataatgaccacaggagtaacaatacatagtaagtatggatacattagaattggatagaaagaataatgaggcatctgccagaaacacagttaaaaatatccagaaaaagacgagaaattcaaacttggaactcaagacagatttcaagttagaagacttatctacaacaaatacataatccctatttgaggaaaaatagaactctatataggtttgctcaactcaatcttagtaaaacaataagggagaaaaaaagaattacaaaagagagaagccttggaactctttaaaatttaatcataattttaaaataaatttcaaaataaataaaagtgatcaaagatttaagaggcaaaatccaaggccaccaagggaatgagaaaaaacggtacttccataaaaaagcaagagaggagagatttcccagactgtaatatatttaatgtgaggctatgccaagaagaaatgataagtgttgtagatcactgaaaatcatcattacttttctgataactgagaaagcttccccggagggagagggtttcatagataaaccagagaagctgtttttgacatgaaagctagattttttaagacaaagattgaagttgagatgtttgtcactagaaattattgggatccaatccaatggttttaaacagggggagagaaaaagatgaccatgttcagtgagcaactgatgttgaaatactgaaaaccacatggtgcaataattaaaggaaggtatacacagtaaacgcatagaaaatacgttaatatatcattcatttttctgtccagggataaataacactgcaaaagaaaaaacagccaaccaatcaagcaaacacataaatgtatgctactgttcaattgaaaaaaatgcataaggatttatcatggttttatctgtgcttcattagaaaataaagccaaggattttatactccaaattctacagacttttttcataataccagaaaaccttaactttacagacataataactttaaaagagttggaaattaagaataaacatacataataatatatctgggcaataatttatttcatcctacttgcctagcatcctcaacgtagtttggcatacattaaggtcctatagaaatttatcaaattaatactaaattagcagagtactatgaattgctttctacctttgtaacaccagatgtatatatttatgtgttcaatataatattaatcttagtgtttgtgaaaacattaatttgccaaagagagttgtttatattagaaaaccgtgtaatctacatttataaaatcagtgtatttctaaacaagtgactttaaattttgatataaagcgatttttatttttattatatcatagttcatgagataaatttattaatagactatatttttaaaagtttttctgaactgacaaattctgcatgtattataatggggttaggaatggtttctcaagtcaagaataccaccaaagtaaggaaaatttcacatcaacataggtgaacaggtggcaagtcttccaaaatttgaagaattctttcaagaaaggatcagcaagtatgtaattagagtcaacatgttctgtttagctgacattaatggttagctttcactctggagagcaagatcttattgaaatttcatgaaattttagcagaatatataaaggaaaatagaaaaagagacaatcaaaaagaataaaagtacagacataaacacagtaatttgaatgtgaagctcaaaaactaactccagtttttatacctagtgttctagaatggattcaaaataacaatatacataacaatgtacataaaaacctgatgccagtactaaggatgattttattttctaaagattgccacaataacattttcttttccatatgctcttcttataatgtgacttggacacccctcatatagggaggtggagtatgtttctaccccttgaaactggcagagatttgactacaacagaactgacccttcaaattccatagctaatttatgaaaatttctgcctaattctcttgggaagcttgttgtgacaacccactgtcttgctgtgaggaagccccaacagcctataagaggcttcagtggggtgaaaatgaagcctcagtcttcaatcctggatgagcaccagccaacagccaaaatcaacttggtagccatctaagttaatcattatgaaagtggcacccagccctcagttaaagtgccacagctgatgctgcatggagcaaagataagatgttttctcaagtcttgctaaaattgcagcttagtgagcaaattaaatgattgtagtttgagcccactaagttttggtggcctgttatacggtgactgataatctgaccaagtgcctaggcttacaagtaaatatatctatatttttgtacatgaaataaaaaaataaatatttgccataattacttaaatgtataaatcttaaattctcattttttcaaagtatgttaaggaatggctcaatctgttaaaaatgataaaaggatcaagattgatcattccagaatttcttccataatatttaattcaaaaagcaaggttttaaaagaaaataaaagagtaattgttcaaaaaaatatttattgatcttcagttaaagacctcctttttttactggcaagaatccactatccttaggatctttcatgctctttgcccaaacactactttacaaaggattcagagcataaaaaatttcctgacttatttcttcaccattagttcattattctccttatgttaggatatgcaatatttaatattggactgggtttgtcatctgaagactgaataagttttatccttggactagttctactttgagtactgatactcaaaatatgaatattatagtacaacaagggagatagtgaggcattctgaccaaaaatttgcccatactctctgaaaatacttttggatataaatatttttcaacaactatgtccacctacagagtgaatctccaacttaacccaggctgccagagccagaaaaaacctgctatcaatttttgcatgtagagctaggactcaaatgtatcttaattttatttactcttcctaaattgtatctatatacttaaactgtctaccagaaacgtttttgtgtatattcaacacatgcaaccagttaatatttgtgcagagcttagcatagttcattacgaacagaacattctatacaacctctagacattatgatcacttacgttattaccccaaattgaaagtataatctggtctctagcattaaactgcataggaatgagagagatgctcagtctgtaatctggagaggaaaggaaggtcaatgattctttgtaaaattaagtttgtacactctgcttttcaagcagcagtctctatcttcctttactttcctcaatgaactaactactagtaaacagtcatcagactgactcattgaattggattattgcggtttcaatgtataccttctcttggggtcccactggtacactagctgaatctattaactcggaaacataaattaatactaaaaatatatttttctttttccttttttatatttaaaaggattttaattggaagtacacacacacacacacacacacacacacacacacgcaatacagagtgccaaatttgtatggggatgattgaaaaagattattatcaagtattaaatatttgtttcagcatatttgttttttcactgttgtctttccgaatagaaattttcgaatgaaacaaaaatgcacattttaataccagcccaatatacttgatccttacatgtttaaatttcatgtgcaaaaaatgattagtcatagagcaaacccaccctcttgtagaaattttaaaagattttaatgccagcgtaatatacttgaaccttacatgcttaaatttcatgcacaaacaatgattagtcatggagcaaacccaccctcttgtagatattttaaaagataaataaaaatgaaacttttttaaaaaaagagttatattttaggttcaggggtccatatgcaggtttgttacataggtgaagtcgtgtcatgggaggttgttgtatagattattgcgtcacccagttagtaagcccagtacccaatagtcatcttttctgctcctctgtctcctcctaccttccaacctcaaatagacttcagggtctgttgttctcttccttctgttcatgagttctcatcatttacctcccacttatatgtgagaatatgcggtatttggttttctgttcctgtgttagtttgctaaggaaattagcctcccactccatctatgttcccgcaaaagacaagacctcattattttttatagctgtatagtattccatgtggtatatgtacatcattttctttatccaatctgtcattcatgggcatttagattgactccatgtctttgctattgtgaatagtgctgccatgaacattcatgtgcatgtgtctttatggcagaatgatttatattcctctgggtatattcccagtaataggactgctggatcaaatgggagttcttcttttagctctttgagaaattgccacatggctttccacatggttgaactaatttatactcccaccaacagtgtataagtgttcccttttctctgcaaccttgccagcatctgttattttttgactttttaataatagtcattttgactgactgtgcaatggtttctcattgtggttttgatttgcatttctctaacgattagtgacatttaactgtttttcatttttttattggccacatgtatgtattcttttgaaaagtgttcatgtccaaaagaaaacactttttgatgtttttatttaattcttgtaattttaaattcctcatagatgctggatattagacctctgtcagatgcatagtttgcaaatattttctcccgttctgtaggtggtctgttcactctgttgatagtttattaagctgtgcagaagctcttaagtttaattagatcccatttgtcaatgtttgcttttgttgcaattgctgttggttctttgttacaaaatctttgcctgtgcctttgtcctgaatagtattgcctaggtggtcctccagggtttttctagtttggagttttacatttaagtctttaatccatcttgagttgatttttggttatggtataaggaggggggggtccagcttcaatcttcatatggctagccagttctcccagcaccatttactgaataggaagtctttttgccactacttttgtcagctttgtcgaagggcagatggcagtaggtgtgcagccttataaaaattatgtttgtcatcattacttttaccagtcctttcaagtaaaatttttatgttcaccatctttaatagtttgtgtgttttttttgtttgtttgtttgtttttgtttttgttttttgggttttgtttttttttttggctgggattcaacaaaataacataatggcatataactttaggtattctacatctattttgtccagtcaagttctgattagcttttttgcctgcaaaaatacttcatttggctgaaaacatatttttatccaatgcacataactatttatttttctctccagctgttttttttattcatgcaagttaactggaccagtgatcattgctgtgagtagactcaaaagtgattctcagctattttagatctgctgtgagaaaaaccaatagatgtattaatattataacattggataagcactctggctttacatttaggaggcattcctgttctattcctcaaaatctcaaatagaggaccctcagaacttcagttctcatgtattttgaggaaaaaaagtcaagtagcttccaacaaattctaacactttgagccattttgggaacccagagagctgattgctttccagggaaatagcaaaaatactggttaaatggttaaatcctagaccacggaatttttaaaaacagaatatgtgtatacacacacacacacacacacacacacacacacacacacacacacacaaatacaccttttaggggagaaattgatatttttgcctcagcaggatatccatttgccttaaaattcttattcttaggtatgtacatcaatcatctggggaggtccaagctgtgaaatccaaactgacagaaatttatagctccattagcatttatcaaaaatacaggattaagtgtagaaaatatgtattcatgcttcacctttctatatctttactttaagaggtaagtatttgtattcagtatttgttagctcctaccttcaaacggccaaacataatctccaataacatttcagaattctactgggccaaaaatgtatcctattgacctgtgtgtcctctgacttacgactgcatgtttaaatatgaatttaagaaaatgctgcactgattatttggagtttttcagaatggctagtgaattccttggtgatttattggtaaaaaaataaaataaaataaccatgttggactgttgtttcataacatactttctatttggaaattatataattactctttgtgttaaaaatgtattcatactccctgaaaatagtttcggacataaatatttttcaatgtgcatatactgagttttgctattataaattatatgtctacaaaatacttgaacatgatcccattgggttttaaaacatgcaaataaatggagaaagataagagtatatttaccggagttctcaactcaggtatggcagcttgataagtgagtggacggcaatcacgagtgtttggcacaaggacacaaggaagaaacattggacccaagtcatctccatccagaacatccactgtgagagtggtggtggtggttcgcctctcattcagattttgggcacggtcctgttagggagaaaaacaaacaacaggtagtttatagaaattaggcacaatagccaggagcagtggcccatacctgtaatcccagaactttgggaggccaaggtgggtggatcacttgaggtcaggggtttgataccagcctggcaaacatggtgaaaccccgtctccactaaaaatacaaaaatctgggtgtggtggcaggagcctgtagtcccagctacttgagaggctgaggcaggaggatcgcttgaacttgggaagcagaagttgcagtgagccaagatcacgccactgcactccagcctgggcgacagagtgagactcagtctcaaaaaacaacaacaaaaaagaaattaggcacaatgtagacttagttttcattgaaaaaaaaaagattggtaaattaacttgcttaaaccaacagttttaagtggttgagtcaggatgtaaactgagatccaattgtcttcaaagcaactttcttgaaagtatgttacagtagttaagcttttgtatgttaggcctttacctaacagttcacattactagacagcctaaccataaaggtcactctcatctcattagagcatttactttagaaaccttgtaattgtaaattccttctctgcgcctctgaggtgttaatcttttataagctgcttgtcagttctacaaaccaggcccatctttttcatgccctggggggccatctctttgaaatgtaatagtcaaggaagaagcccgtatttcccagtttctgtgggaggttaggagcctgacttcctttggaggcttgctccaatttctaaaactactttctgtcatgaaaattcaaggaaatttattttcctttgggaatgccaattagtaaacacatctggtctgtgattcccccacacccaagtccactggagtgtttaacagctctccagccattttttctattagagatcagttcagatctagtctgtattctggtctctcttctctattgcaatagctgtgaatacagtcttccttatcatttaactttgtctagtgcaattttgctgtaggaatacattgttactaactaaaatccaaagtttctttagatttccttagtttttacttaatgtcagttttctgtttcaggatcccaatcaggataccagtttgcatttagtcataatggttccttaggctcattttggctgtgacaagttctcagacttttgtttttgatgacattgacaattttgagcactggatattttgcagaatgtcccttaatgggtgtttatctggtgttttcctcaagattcaactgcggttatgtgatgtatgtaggaaaaccacaagtcaactgctattttgacatatttatcaaaagtatatgattaatatgacttatcactgttgttaacttcatcacctggctgaggctgtatctagtcagttttctcaactataaatttcctctttcttgtttccctttcatttctttggaaggaaatcatgatggacagcacacacttaaagaatgggtagtaattttattagaaatgtaaattgtttatatttatctgaagaatgtttgtcataggacagaagaaaataatattggacctaagtcatttccatgaagaacatccattgtcaagggtggtggtggtagcatcattcattatgacagaatctggaaatgtttttactttcacagcatttagttattattttgaagaactattatgcttttctgcctttttgaattctattttgtacaacattgacaagtatacttgcatgcatgttcatgtagcactattcacaacagacaaaacttggcaaaagcccacatatttatcaatgaataaatggataaacagattgtggtatgtacacacaatagcatatgattcaagcataaaaagaaatgaagtactgatatatacaacaacatgaatgagccttgaaaacatcatgttttcaaataaagaagccagacaaaaaataaggtcacatattatacgatccatttatatgcaatatctggcagcagtaaacatattggtggctacaaggagctggggaggggatatggaaagcaactgcatgagtggtgccagctctttttggagtgattaaaatgtttgggaactggatagaggcggtggttgcacaatactgtgagtgtaccaaatgccattgaattgttcactttaaaatggctaatcttattttgctaatttatgttaaataatttttaaaagtaattatactaacagacctgtatttttttttttttgttcataaaatgtcttcctttgtgacagttcccagacattaatatttgccttccaattaaaaaaaaagtccctcttgttaaacatggttaatagtacattttggttaagctcattcccagtctggttgctcataaaaacttgtaaagcaatgcttgagggtaaagttttaggaaacacgaatttctgttggtggaattttgtcagtacaaccttgtctagaatgtaataactctgtggttccaggattctttgatatttttatacagtataagacagactgcgataaaattatagcttaaaaaaacacaaaatgtttaaattttcaaagtttcggaactcactcagatccctagaggcactataaagattattcaaacctaaagacatttgagattcaacaaacagaaagaagtcttttctgaacttcttttatgtcactaaaagcagatacttatgagagtgaggctgccatgaattccctctgccaagaaagtttatgaaaatgaagaaaaaacaaggaaatctattcttacctacataaacatgatcacaagctattttaatctcccctttgactcctagaaacctagtttttcttcccttagaagcctcctccctctcattgtgttaaatatatacaccttcttctttagctgtttaaggagctgtgtatatgcactcccatatgtatatcaacctctaggccagttgaaaagtagagtaggagcaacatgtggcatgtgagataattttggtggttcacaaattaactttataaattattcttaagatgtatgaattttgaacatgtagaaaaatattaatttaaaataagcgtatgtgtatattttaaattttaaaaaaaaatagctcatcaaacttgccacttttttaatactgatcttttatttaattgggttatagctatgtctataatatatgaattaatagacaaatgatgtaatgatttgttcagtcagcatatcctgagtagcttccaaggggcagattccaatacactgcttctgacggtcttaaaaaaatgatgaggacatgtttcctcatcccattattaagagagtcatttagtactgaaaattactaatgttaagataatgtgacctcataaagattagtaggttatattttcacatatatttccctttgtgttgcatcatccagtgttttaaatcattaagtaatctcatcttccatatttctaaagttatattaaagtttaagaactaaaacaaatctttaaatttctaaatatatatatataaactggaagcttctttaataggggtggtaaacttttgttacatttattaatgattttacatttgacatttttctcaataacaaataagttaataaaatgacatatttaatatgtatttgtaaatttacttgtggcactggagttaatatttgaaaatttttttatttataaaatatttatttatttatttatttattttagaaatgagaatctcactacattgcctatactgacttcaaaatcctgggctcaagtaatcctcgcacctcagccttctgagtagctaggactataggtatgtgcctggctttaacccaccatttaaaataatgattgcttatgaagttttaaaagattgaattaatctaaatttaatttataaaaatagtaaatagataataaatattaaatatttataatattttatgtgatacatgaatgtagcatgcagatataaacacacatatatatgcatatatacacatacatgcatataaatgccagaggcaatatttctacccttccatgtcactcagccttctttatatgtaatcatcaaatcactataataaacaaatttgaattttttaatgttatgttttctttcagtctgtcagcatcaaatctctcactattatctgcttctttgggtcattgtcactactccatagaatagatactggtgtgttaaagatagtgtatttacaggaagtgtataccaaaatacataataggagttttttctcatattggggaaagatattgcttacaaagtgttgagctctaaaatttgtatttttaagtgggaaataaaaataatcctggcaaaatgattgtgagcagagatgtagcaacaaaatctactaacagtttccacacgtgggaattctcccacattttatcaccaacacatatcacataggaaaatatataaaaatatgtctcatgcacactcataacttgtgagcccataatggtaatgctaattcatgatgttctcccaatttggaatcagatttgatcttaaaatatccatttaaaaaataatccttcagcaattgagataaaaatcaaaacaaaaacaacaaaaacagaaaaaacaaaacaacctacacttttgatctttatagtaatatactactgctcaaggctcttctgagtaaatgaaataacattctaaattgtgagtggtaaaaaataaaaaataactatttctataaacattccatataatttaattatgttttcatttacgttatgtgataatctaatatatattaaaatccacaaagaagatctcctttcttccctttcccattttcatctgcatttctcttcttttttaaaaaataagaatatatatttaacttcaattatttaaaaataacaggatattacattaagttaggaaactgtgattctagttggcaagcaagaatatcttttaaaaagttaaacaagttcaaccagtactctgaacagaattgtgtctcctcaacctcaagctagaaaatctagagtaaagtgatatgtttctggaaacacataatgttccaagatcgaatcaggaaactattgaaaccctgaacagatgaatattaagctgtgatattaaattagtaataagaaacttaccaaccaaaaaaagcactggaccagatagacacacagctgaattctaccagacatacaaaaattgactcaagatgaattaaagatttaaatgtaatacctcaagctataaaaatcctagaggaaaacctattaaaactcttcttgacattggctttagcaaggatttcgtaatgatgatatcctgaaaagcaattgcaacaaaaacaaaaactgacaagtagcacctaaactaaagagcttcggcacactaaaataaactgtcaatacagtaaacagaaaatggaaagaatgggagaaaagctatgcaaactatgcatctgacaaaggtctaatattcagaatctataaggaacttaaacaatttaagaagcaaaagacaaacaatcccattaaaataggggcaagggacatgaacagacacttctcaaaataagacatacatgcagccaacaaatatatgaaaacatgctcatcagcatttatcatcagggaaatgcaaatcaaaaccataatgagatatcatctcataccagttagaatggctattattaaaaagtcaaaaaattacatatactggtgaggctgcagagaaaaggaaatggttatatgctgttggtgggtatgtaaattatttcagacactgtggaaagcagtttgaagatttctcaaagaatttaaaaccaagctaccattcaacctaccaaccccattactgggtatatacacaaagaaaaatagtgcattctaccaaaaagacacatgcatgtctacattaattgccatgctattcacaatagcaaaaaacatggaatcaacctaggtgcccatcaatagtggattgcataaagaaaatgtggtgcatatacaccacggaatactacaaagccatagaaaagaatgaaatcatgtcctttgaagcaacatggatgaagctggaggccataatcctaagtgaattaatgcagcaacagaaaactaaatactacataatatcagtttttcaatgggagctaaacaccaagtgcccagggaaataaacctgggaacagtagactgtgaactgctggggcaaggagagagaatggatcaaaaaactacccattgagtactatgctgaccacctgagtgcaatacacccatgcaacaaacctacatatgtactccctgtgcttaaaataaaagttgaggaaaaaaataatgcttctatgaacattaaccagaggaagttgggtattctattgtcttgtaaacattttttgtttgagatatttgcctaatatttcttattttttatgcaaaccagtagacagaattatattatcatttatagccccaaatgctcatgtatctttagtagccaaacactcagtaaatattaggtcccataaaccatcacctgctatcctcccatttcactctcactcctcagaaaatgcccaagaaacttgcagagttaaaacaatggggttacaattaacactaattccacacatcagtaggaagcagaagtgagggaaggtcagggtagaggttatttctgaaaagttgtttacaaggttgaaatataaaatatagaaaattaattttacctatacaaacacatatgtttgcaatgcttacacattttatttgaatatttctgtccataaagataaaaaattgagctaataaagaaatagtaatattataattttaggaattatatcttgttaggaaagatagctagcatcccttctctagattttgctatttgagaaatatacaacacccttgctattcataaaataatttagaaattataaattattcttgccatgattctaaattaaatttaggccgggcacagtggttcatgcctgtaatcccagaacattggaaggccaaggtgggctgatcacttgaagttgttaatggtttcagaccagcctgtccagcacagtgaaactccgtttctactaaaaatacaaaaaattagctgggagtggtggcacatgcctgtaataccaactactcgggaggctgagttaggagaatcatgaacacgagaggcgaaggctgcagtgaaccgagatcacccccctgcactacagcctgggtgacagagcaaaaccccatctcaaaataaataaataaattataaaataagtaaatataaacttttttctttctggtaattaagaaatcttgattacaaaagtgttcttatatatttcactcaggataacaataatataaaagagagtttgctttgaagaaaaatgatatgtaaagagattactttgattctatgtgaattagggtaacatatcaaagttgaggttataataatatgtagtaaatttcaacaaaaagaaaacccatttgatctttctagatctacccccaaaatttttgtctggaattaatcattccttcattatgtatttatatttgaagtcaatagcatgggtgacaatattgcaaatattctcaaaaaaatatgtgacagggttttctaatatgggtcagtcaaaactcaattaccttaattacggatcataacatgtaaacacggataaaaagaaacctccaaactacatgtaatttgaaggattctcttcgaaaatcaaatatttttaacataagcaaaaccaggtcaaagctgggtaatgttcaataatttgtcatgatacctgtaattattcttttagaggccatatactttaaagtcaaaattgattgctcatatcttaattctccttatgacttcaagataatatattggtgcttaatgtacatgacttacattgtgcataccaccaacacaatataaaaaaccactgccaggtgcagtggctcatgcgtgtaatcccaacactttgggaggctgaggtgagtgaattgcttgaggccatgagtttgagaccagcctgaccaacatgctgaaacctcgtttctactacacatccaaaaattagctgggtatggttgcacgcatctgtaatcccagctactcaggaggctgaggcacgagaatagcttgaacatgggaggctgaggttgcagtaagctgagatcatgccactgcactctagcctgggcaacatagcaatactctcctcccctcccaaaaagaaaatccaggtgtggtggtacgtttgtggtcccagctagttgggaggctgaggcatgagaatcacttaaaccccgtaggcggaggttgcagtgagctgagatcgcaccactgtacttcagcctgggtgacagagcaagactgtctcaaaataaataaataaataagcaaacaaacaaacaagataaatgtaaaaaaaatggaggtacattttagatatatggatatcattatcatatacaaacaaagatatgttagacttatgttactattggtatatacaaaacagttaatgattaacaaccagctatcagataagtagccctgatttgtagcactggcactttccatactgtaaatgctcccagcatggctgcaaatgtgagatcactgaactcagagtttgaaagagaaacccacaattggccctcaagcaagtctcagctgactttccacctccaacaacccacagttttaagttacagatttaaaatgttgtgaaaatgagcatccttctttatcatttgtggaagtgtgatatgtcacaacactttgaaaaataatatagcattatctactaagattaaaaagtatgtgaatatatatgtacaaatacacatacacatatacacatatatatgcatacatataattttctcaaagcaattccatttttaattactgatttttaaacagtaaagtaccagtattttagtgatttatataatactgtaataatgtctcaatatatttcaagcattagtctaagtacttttttgtttgctaactagctaattgtaaccagaacaatgtggtatgttttattaatatacccattttactggttaggaaattaacatacaaagcatgccccaaatcacacagccagtaaatggctgaactgagatttgaactcaggtgacataattcactacactcactgcctctcttgaacatcatgagggtagatatcaatttggtgccaaaaacaaatgatcaaataaacaaaaacggagtattgttgaatcaatggtgatccattattattatcttacattatgtagctattaaaattatttgttcttaaaacttttaaaaatgcttaaaatgttataactttctatatttaacatttcattgtgtactgtatgacttaagtttataacaaaaactgttattgcatttaaattcaaatgttcattcgacttcttcctaatgctattccttccttttgatgattcacatatgtacttctgttttataactttatccctgaaatgctaaaaacttgtcactacctcagtgatgagtagtccatcatgttggatagaagttgttccagatgtctttataaatattttaaaactagacaccaattcagaatcttttaccttgcatttctattaaaaaattatatctttttaattgcatgataaaaaaactagcttacaaataccttccacagcaatctgacttcataaaaaagacattctaccttttcttcacatcttcagttaaatagaaaaaagaattttctgtgtttttgaaaaactctgagtggccctccctaatacattttacttttccccatatctacagttttcactctgctctatgttacatgacattaaaatatatacacacatacagacacacacataatacatataacatcttataatatataattataatatataaaataataaatcatttttaaaatctgaagaaatataaataaaagcttccaaacttagcttcaaaaattagatctatatgtctatctacatatttctatctacatatccctaattatatatctatctaggtatctatctatacacatacacattctgtgtcaggtgatatatctctaagaaaggcaagaaaatgacaagtttgtggcacattttttcatgttaacttcttcagaacagctaattgaggttattttccttttagcatcccctgctatctatctgttctgctgtatgagcaagattacaacgcttaggagtcattaaaggcacaggatggcttcagagtatagctgctttaaaaaagaaaaggctattaatttagagcagttttaggtttatagaaaaattgagaggaaggtatatacaccatgtctccacacgtgcacatcctccccacttacaacatccctaatcaaagttgtacattggttacaattgatgaatctacattgaacaatgataatcaccaaagttcatcctttacattaaagatcaccgttggtgttgtacattctatgggaatggacaaatgtataatgatatctatccaacttcatggtatcatccagagtattttcactgacctaaaaatatttcatgatccttctattaatccctttctacctgcctttaccaccatatccctgacatccactgatctttatactatttccccagctttgcctttaccagaatgttatatattggaatcatccagtatgtagccttttcttaatggtttattttgcttataagtatgcattcaagatttctccatactttttatatctttatgcctcatttcttaacggttatttcaaaaacgtaagcttgtcacttaatatgggactttttatgtgacctccccttctagcttttttctcaaggggtactcccattcatcttgctaagaaaagaaaaatgttttcaggtcatcagtgtgcccagtctcaggatatgaactatacatagtataattcagaagtgaataccgcatatccctttgacacatatggacttcctcaaccttcgttcctattatgctgacacaggtgatacaagtctagaaggagatgttggatgggagaaaactctgaagagagtatcttcccagataaaagaaggaagaatcaataaacgtaaaagaaatcctagttttgctaccctttctgcctgttgcattcagacttgaaatgcagttgtgatgcttatggccatggtacacaaatacctcccagctgataaggcattgggaaaataaccacattccagagaagagggaagtataaggatggaaggaacctaagtccctggtgatataattgaactgtcaaaccaaacattgagctgcataattccagaaattttattaaacttccactaataataactataataaatgtctatgttttataagcatataagcatgtctatgttatataagcatgtaaggatatctatgttttataagtatataaaccatgtctgtgttttacaagcatatgtttggatgtcctgttattgttatctacatacattagcataaacttcagttatgggaatattagctgatatctagtgaacaattactcaataaatgatagccatgaggaagaacacgaccaattaggcaatgattctttgcctttagtgtaccttagaattccctgaagagctaattaaaaatgcagatattccacttccatcatctgagatttttattcagaacatctgaggtagggtccagaaatatgtatatttaatacacacccaaggtgattctgctgctgttaatttgcaggatcctactttgaaaaatatttcagtatagtctaaaaaggttggataatggataatacatatgaataatttagaggtcaaagaatacagtgaataaaaacaacctattctatccctttctccatctataagagtattatatataaacaccaagggcaggagtgccctgatgaagaagtgagtggcacagagctctccaagagtatctgatacattttggatgagttttttacttcataaattcacagaagaaatttaaaagaaattgaatactcacattagcttggattatgacaaagtagcgagtcttatcttcatagttgagcctcttccttaacactatatttccagtcaacattaggggaatttcaaaggtgtcattggatgtctgcaaatattaaagatacagacttcagattatttgaatgtaagatgaattaataactcaatattttggattaatcctcttggaagttagagatgacatgcttatcatctgaaaatagaatgactataagcttcagagtcaatattgttatcatacttccaaacatttaattttgatcaatgggtttccccagagtcctttggtaataataaccagaaaatttgtttcttgtcatagtttttaatatattactagtattattcatcaacagtcttggaatagttctaaatcaaagtccaggtatctgaaaaacttccctgttaccacattatcttttcactgtgttctttaacaccaaagcattcaaacactgaaatctgttatttctacatagtatcaattgtcaacattgatatccattctgtattttaagtatttttaagtattatctggcattaaatacaaaaaaaaaaatacagttacgagtcacttagtgatgaggtacattccgagaaatgtgttgttaggtgatttttgtcattgtgtgactattatagagtgtagattcacaaacctaaaatggtacagcctactacatactaggacaagtgatatagcctatggctcctaggctacaaacctgtacagcatgtcactgtactgaatgctataggcaattgtaacacaatggtcagtattttctctataaatgtaatctaaacatagaaaaggtatagtagaaatacaacattataattttatgagaccaccatttgctatgtgatatatcattgaccaaaatgtcattatgcagagcatgactgcgtgaacttgaatcagttcattattgtggaaaaaaaaatccaggttatatatcatttttttcttttaggttccacaacttctgctcattagttaagttctctgccctgtctaggactgagttttttcctggtaacatggaagtcataagggcaacactagtgctctggtataagcagccctcagtgtaactgtattcacaccttaagggagtataatttataagataaatctcttattcttaagaagaccttatgtcacttttgtattttagtgccattttaaagaatgataaaattgtttctagtaggctcaataactcagtgttattttgttcactgaaattgtcttgtggttgttcagttgccttgtgtatttgtgcttgtgatttttttgtgaaatatttagtttgaatctgcattagattgctgcaaaaggaaggaaagagagggaaagaaaaatgagaggaaaaggcaaggggaaggagaagagaaagggaaggggaagtgtggaagaagaaaaaaactgtgtatgtgagagagaaacagagagagagaggaagagagagagagtgttcacaccctcaacttagtgtaagtgtattcctaagagtcacataagaagttaaactcaatgaaaaaaaaaaagctgattcaaatctctcagctcaggctcaatcaatgaaatgtgtgtagtttagccttccatgtctagagctgtgatctgtctcctttctttctttctttgtctctctatctctctttctctcggggatgcataaagacacacacactgtacattttgcagaattaatatatatttttaaatgattcattctgtgctcctcatgtaatgggccttgcaaatcgttcttggatgcagtcatttaaaagtaacaatttaaaatataaatacagaaaatgaaaatgaacaacacaattaaaaacagacatttgacattttccctaattttttgcctattcaactttgcttatacctatgagtggggctggcattatgacacaggagtgtgaaaatgattgaatctaaacatgtaagttgaatatgggcaaaaccttagttaataattgctgtttacactgttaaacttatcctaatgtgttgttatgaggttattacattttagtgactcaataatatagaaatatatattggtttctagcataaatatggaagatactgtggtcttaccacaaaactaccacatctctggactcagaaccccaaattagctcacatatctggtgacattgtgcctcagaggaggctatgtctctaaatgagatgagtcttgaatagtctagcttaaaaacagtaattccattctcttttaccaggaagtattttgcaaatgtacatgtgattccattttgagtaatgaaaaaatttctcttaattgcaaagatagagagaagctaaaaatcccttttcaggttatagaagtttctgtcaggatataaaatttagaacttcagcagccatttggggactattgataaaattaattacggagaaatagctaacatgctagtgatagcagagtataaaataaaaagagcccggatctgtgttgtctttgagttgctgagcaaatcttgatattaccccatctctgaaaaacttattatgatagataataaattacctttttggttaaatcatctttaatttagttttttacatatatataatatatatataatctatattatatattattatatataatataatataatctatattacatattattatatataatataatataatctatattatatattattatatataatataatataatctatattatatatataatatatatatagtaaattttctgcagctgaaagcactttgatacatgattattcctgtctctatgtgtttacactgtaggcctctctcttctccaaacaggccatggctcttcacacctgatatttgctcttatttttctcttgcttaaatatcccatcacttatttctctgtgtactaatctttgcaaactttactcagtgaaacctcttaaatgtaatttagacttaagtctttgatgtgatctcacattattttttccaaaaaacacttatttgggatcttctgttttgcttgacagattcctcaagggtctcagtctgtgatgcagaaataacctatccttaaatgtctagctaagcaacttaatgaatctttgcaatactttttttgttgttgacagttttcattggacgtttgtagaattattaaaaataatagttattagtgactttattgatcttcagagcactttcaattgcactgaattcttatcatcttaaatctatcctttagagattttatagattcttagattttaattttactttttatatgtatgtatttatttatttatttattgagatggatgcagtcttgctctgtcatccaggcttgagtgcagtggtgcaatctcagctcactgcaacctctgcctcctgggttcaagcgattctcctgcctcagcctctgagtagataggactacaggcatgtgccaccacatctggctaatttttattttttacttttagtagagatggggttttaacatgttggccagtctggtctcgaactcctgacctcaagggtatgcccaccttgcctcccaaagttctgggattaaagatgtgagccaccatccctggcctagattttcattttgttagcacttgtattctataaaatataagaataggatatactttatcatcaatggtgcttctgaaatgttgcatattgaaagccactgtattaaatttaatttattaattaagcaattattgagtattcattctgtctctaaaatgtagaataataatcaagaaaattagaagcaaaatatagatatctttggtatctttatgatagtcttctttttcctctagtaaaaagaatactggattagatcaaccctaagtaaaagtcttgctttaatgatatttctgaagtgtttacctaaaaagtttaaaaaaaaaaaagctaaattaagcaagggaaaaaagtagattttttaataaataaatacatgataaagccatgaaaaaaacaaaacaatacttagaacattcttaaagtttagaatgcacaagaatcataggcatgtatcattaagactgtagattcctagcatctattacccaaaattcccgaaattcttgggaatcggcatttttaacaaacctaccaggtgatcctgatgcagatgattcaggttttacttttgagaaaccactgtactacgtaagtctaagagtgactgcactctctgtccttgctatttatttttctcttctttcattcttagagatttgttccaccaatgaggcagaaaagtttgggaacagagcaatgcccatttacttaagcaaccttacatttctaaagccaggacattgccccctttctgatagtcgtggatattctctttaaaatacaaactaacattggcttttttgggtgataagaatttaagtgctgactacctgcactgtattaatgagaaaaatccaattatggttaaatgatttaatacccacacgccccaaacacctggcctccattaagaaaggtccactcactactttctgacagttcagtgacaacaactgtcaaataagggacaattctccatttagtaaaataagggcataaggcagtttaagcaatttatcactatcacagatatgggaagcagggtaggagacagctgtaacatccacgccacacacattcacattcaataatggagagagaaggaatgttgaggctctagcaactctgtgtttcccaagatgattccatccccccagaatcccctttactaatatgggtttgcaccagtttagataaaacggcagctctctgaaaggaggtgttgaatcctacagttaaagatgctctagaaatggaatatggggttattagcactatttcttctcagctgatagatttggtcattcatcatttttaggaaagagggaaagactccagcctttcacacctatgttgtaagcattgtttgtaatattctcttttcagctgtgatgactagaaattcagttcaaaagaagataatttctaaagaacacacacacacacacacacacacacacacacgtgtatatatattttctggtgacctaaagacagagacttagtacaaaagtgcctcaatgggcctgtaattgagaagtggcggaaatgtagataattacgattttctctttatctctgtaaattctcttgttctttgacacttttttttgaagtatcttcccttatctttgtgtctttttctgtacctctctcttctctctttgggtttcccccatttgttcacattgaatataactgtgagtctgtgttttagttccaataagcagcatcaactttgcccttatcaatctttagacagccttaagcttgtctctgattaagctcaggctactgtgccatcagctgctgaaaattctatgttattgtcattgtttgtgtgtctcctctaatctaatttcctaaagtaaaaagtggaggactaagtaaggctatgcaatttttgtccacccaagagggactgggatttgagcaggcaacattaactttgctcctaagagaaagtcccaacactctaatcattttttctgtttcatactgttaaaacatgtccctggctgacagacaaaatggactccctatgactaactgaagtaagttaaaacaaaaccaacaaaaccaggtggccatgcctgagtgacaaagtggtcgcatactctgtgttctcagaaagatgtcaaagcatcacaggatcttcctttctacaattgatatggtttgggtgtgtcctcatgcaaatttcatcttgaattgtagcttccataattcccacgtgttgtgggagggagctggtgtgagataattgaatcatggcatttccccatactgtttttgtggtagtgaataagtctcatgagatctgatgcttttataaagggaaatcactttcacttgattaaattctctcttagtctgcttccatgtaagacatgccttttgcctcccaccaagattgtgaggcctcccaggcacatggaactgagtccattaaacctctttttctttatacattacccagtctcacgtatgtctttatcagaagtgtgaaaacagactaacacagtaaattggcactggtagagtggggtcctgctgtaaagatatcaaaaaatgtggaggcaactttggaactgggtggcaggcagaggttggaacagtttggagggctcagaaggacaggaaaaggtgggaatgtttggaacttcctagagactttttcattggctttgaccaaaatgctgataatgatacggacaatgaaatccagggtaaagtgatctcagatggagatgaggatactggagtaaaggtaacccttgctatgttttatcaaagagactggtggcattttgtccctgacgtagagatttgtggaaccttgaatttgagggagatgatttaggttatttggtgacataagtttctaagtagcaaaacattcaagatgtgacttcagtgccattaaaagcattcagttttaaaagtgagacagagcataaaaattcagaaaatttgcagcctgataatgcagtagaaaagaaacacccattttctgaggagaaattcaagccagttgcagaaatttgcataagtaatgaggaaccaaatgttaatcaccaaggcatggggaaaatgtctccagggtgtgtcagagacatttgtggcagcccctcccatcataggccaggagccctaggagaaaaaagcggtttcatgggccaggtcctggacccccctttccgtgtgcagcctaggaactcggtgccccgtgtcccagctgctccagccatggctataaggagtgaagacatagctcaggctgcggcttcagaaggtgcaagccccaagccttggtagctttcacatggtgtggagcctatgggtccgcagaagtcaagaactgaggtttgggaacctccacctagatttcagaggatgtatggaaatgcctggatgtccagacaaaagtttgctgaaggggcagggccctcatggagaacctctgctagggcagcatggaaaggaagtgtggggttgaagtccccacaaagagttgccactggcgcactgcctagtgaagctgtgagtagagggccactgtcctccagaacccagaaagtagatttactgatagtttgcactgcatgcctggaaagcagcagacactcaaggccaaactgtgaaagcagccaggagggaggctgtaccctgcaaagcaacaggggtggagctgcccaagaccatgggaacccacttcttgcatcagcatgacctggatgtgagacatggtgtcaaagaagatcattttggagctttaagatttgactgccccactggatttcagacttgtatagggcctttagaccctttgtttttgccaatttctctcatttggaatgtatatatatatatattcatacccaatgcctgtacccccattttatctaggaagtaactaacttacttttgattttacaggctcatgggtgtaaggaacttgctttgtctcagatgagactttggactgtgagcttttgagttaatgatgaaatgagttaaaactttgagggactgttggtaaggcatgattggttttaaaatgtgaggacatgagatttgggaggtgccaggtgtagagtaatatgatttggctgaatccccacccaaatctcaccttgaactgtagctcccataatccccaagtgttgagggagggacccggtgagagataattaaatcatgggggtggcctccccagccacgtggaactgtgggtccattaaacccctttttctttataaattacccagtctcaggtatgtctttatcaacagcgtgaaaacggactaacacaacaataaagcaaaaacagatcctgttcttggtgccaagataaactacagctggaactacttccttttgccccctatgccatccctacactggccctttagcactagccctttgaaagaaacatctgacagaaacttctggtttggggcttggaaatcaaccaatcagagctcacctgaatcaaccaatcagtgtatagaacagtcatgactcatctgttttgaccaatcagaattaagcaaggatctatccttcatttggatgaagacagcttattgggaacctgggtgggaactatagctataaaaccctaaccctctctttgttctctgaaatgtgtcttagcttgaaaccacaggctgtatatccatggtttgaaaactgttcactgaaataaagtctctttcgtccaaattcctttccagagaacatttgcttacaatataaatttaccactctccctcacacaaatacaaacagattcattcacatttaatgatgcattatgattacaatgcagttcaacttatcttattccatccaacttccaaggaaactgtatttgtgtttggttgggttttgaaacttaaaagtcacagccttggtgtgaaaagactgaggttcgaagttttacacaaagaaggcctttacaccagtcttaattatacatgagtttccagtaaaatgagaatattatgaatttatggaggcatggaaatctcatgatataatgtaccctgaaaagtattattaaactacagtaaattttttagtaacctacctaggaataagtaatcactgttttagcttaaccttaaatattttattgacatctgaaatttggactttgacatatatacacacacacagaactacttcaggatggtgatttttttaaaaatcgtttgtccttaaaatgtggttttaacttcctgactcaggaaattcaaatgcttacacattacaaatgaaaattatggcttacattttctgaattatctcaaagctacggggagtcaaacatattacaaaagaaggacaatttactcaggaggacttgataaaagatgttaccacccactgaaacaccactgtaatacctcaaagaaagaagctgcttatgcatattgcttaagtgtcttcattttttttttctgagtagtaacagtagtgaataacaatgttatgctgcttcctcagtaaactggagactgctacaagggacatgtcatcagtctcctccttatcactttaggtcaaacttaaaatgctgaataaacatgcctccagtctggcattaaaataaaaaaaaagatcaaaaagacatgataattattgtctaaatagtcttatcaatcttgctaacaatgagatttaatatatcagaatacctatatttagatttttccatataagacaaattctcaaaaatgaaagttactgcagatcatgtgatgacaaattcttatcaatttcagagttcttcttttattttttcaaaacaaactaattcaagcttgtctaacccatagcccacaggctacatggggcccaggttggctctgaatgtggcccaacacaaacatgtaaatgtccttaaaacattataagatttatttgtgattttttattatcagctcatcagctgtcattcacgttagtgtaatttgtgtgtggcccaagacaattctttttcttccagtgtggctcagggaagccaaaagattagacagacacctctgaattagttcagtgcattatgaacactcttactttgtattaccatgaaggcattaaacaaaaaaaaaaatcagcagtattttacaataactgtgatgagtacactagaaattgcatagaaattaaatgcccctaattaaaggcctgacaacatatattgtccagtacatatttttacatattgtctactaccaagttccaacagataattcaagtggtacttaataaacaaaaggtgaccaaatgagaaaatgaacttatacaaaagaaagaagaatgcttcttcttctgaacaatagtgcagactgacaaagattctttgcctggccaaacttgatcaggcttctgaatcttctcctaggctcatctgtatacttcctcataaaatcactttttaacaaagaaccatactatatcactttaccaagaactcctctacctttgatgaatgatctatcttgaaaactcatcaggtttctcatcctgcaccaccccttaggtgatgtctgatcaccctgacttgtcttcagcaacaatcgtattagcgtgttttagccagaattcccctaatctctgatgtttcctcctagtaattttccatccagtgaccctgaccctgctccttggttataaagtcccacttgcccatgctttatttttagttgagtccaatatctctctccaactgcaagacctcattgcaatgatttctatacctattgcagtggtcctgaataaggtctttcttaccatgttttaatgtatcattaaataatatttttatttaacaattgtctagaggacttttagaagaagatatttactaaattatttttttctaaatacatcagccatgaaaggatagggaatgctgcaggaacaaacccttaaactttcatttttttctttacttttcatatctacatatctaatatgcatcagcaagtggtctctttttattgttgtcattggctaatgaatgtttctcctcaacatgtttttctctgatcacaacagcaggggcagagaatatgattacttgtatattggttctttgagtttacatttcattagtcaaagcaaatacttttctccaggcaagaaaagtacacctctagtatgaatcaaaagagaggaagaaccaaacatttttggtaaacagctcaagtgcttttgttaacagcagtgaatccatatgggtctgcagcaactcggtcctaacctcagaggaaagaatgtgatttaggggaagaagtaagtttaaggcagagggagagattgaggtgagttttagagtaagagtgagagcttattaaaaagttttagagcaggaatgaaagcaagcaaaatactcttggaagacggctaagtgggtgacttgaaagatccaagtgccttgttcatcccttcacttgggggttttctacattggcatggtttgggggtttgccattctcctcccttgatttttcttttggggcaggctgtccacatgcacagtgcctgctggtgcacttgggagggtcttcatgtgcagtatgtttactgaagttgttgcatgcttacttgaggcatttttgccttaccagtttaacattcccagaaaaaggtcatatactagtgaaattctgccattttgcctcttaacgtgcatgcttcagccctcttgcccaacttctaagctcttattgggaagctgctgatcaccagcttcaagtgttttctatctattgggagactatatttccctggcactggctgtgatcaattattcttttacagaaaaagtttaaaagccacctaaccatcacctgacgatcagctgacattcctgggggtggtcctctcctgccctgctcatatctgcctaaccatctagttgatatggtttggctctgtgtccccacccaaaacaaattacaatgtcaaattgtaatccccatgtattgagggagggatctggtaggtggtgactggtttatgggggcagtttcccccatgctgttctcccgatagtgagttctcacgagatctgatggtttaaaagtggcacttccatttttgctctttctgcctcctgctgcatgtaagatacaccatgcttctccttcaccttctgccatgattgtaagtttcctgaggtgtccctagccattcagaactgtgagtcagttaaacctcctttctttgtaaattacacactctcaggtagtatctttatagcagtgtgataacaaactaatacaggaaattggtactgggatagtggagtactgttaagatgataacctgaaaatatagaagcaactttggaactgggtaatggtcagaggttggaacagtttggagggctcagaagaaaacaggaagatgtgggaaagtttggaccttcctagagactttgtgaatgctttcaaccaaaatgctgatagtgatacggacaatgaagtccaggctgaggtggtctcagatggaggtgaggaacttattgggaactggagcaaaagtcactcttgctatgctttagcaaagagactggtggcattttgcccctgccctagatctgtggaacttggaacttgagaaagatgatttagggtatctggcaggagaaatttctaagcagcaaagtattcaagatgtgacctgtctttttctgaaagcatacagtcataggcatatatgaagacattatgtgaaactggaacttatgtttaaaagggaagcagagaataaaactttaaagaatctgcagcctgaccatgtggtagaaaagaaaatcccattttctgggggaaaattcaagctgggtgcagaaatttgcataagtaacgaggaaccaactattaatagccaagacaatgggaaaaatgcctccagggcattttagggatcttcatggcagccgctcaaatcacaggcctggaggcctaggagggaaaaatggttttctgagctgggaccagggccccactgctctgtgcagccttaggacatggcatcctatgtccctgccactctagctccagccatggctaaaatgtacagttcaggccattgcttcagaggtgcaagccccatgccttggtggcttacatgtggtgttgggcctgcaggtacatagaagacaagagttgagctttgggaacctccaccttggtttcagaggatgtgtgaaaatgccagcatgtccaggcagatatctgctgcaggggtggagccctcatggaaaacatctactagcataatgcagagggaaaaagtggaattggagtccccacttgggactgcctagtggagctgtgaaaagagtcccactgtctcctccagatcctagaatgatagatccacagacagcttgcatcatgtgcttggaaaaaccacaagcactcaatgccagcctgagaaggcagctgcaggggcagtaccctgcagagccacagggacatagctgcccaaggccttggaagcttaccctttgcattaatgtgccctggatgtgagacatggagtcaaatgagattatttcgaagctttaagatttaataactgccctgctgtgttgtggacttgcatggggcctgtggtgcctttatttgggccaatttctcacatacagaatgggtgtatatacctaatgtctgtaccctcattgtatcttggaagtaacaacttgtttttgattttataggcttatgggttaaagggaattgacttgtctcagatgaaactttgaacttggacttttgagttaatgctgaaatgatttaagactttagggaactattgagaaggcatgattggttctgaaatgtcaaaaggacaagagatttggaagaggccatggttggaattatatggtttgtctctgtgtcccgactaaaatctcatgttgaattgtaatctccatgaatctagggagtgacctggtgggaggtgactggatcatggggcagttttccccctgctgtttttgtgagagtgagggcattctcatgaggtctgatggtttaatagtgataattcccccttcactctctctctcctgctgccatgtaagatgttccttcctccccctttcccttttgctgtgattgtaagtttcctgaggccttcccagccatttggaactgtgagtcatttaaaattattttattataaattacccagtcttagttattctttatagaagtgtgaaaatgcacactactgtaacactttcactttaaattggatcaatcagttcagcaactatttattcccaaacttgttgcttctttgttttagaacaccatttgaattgcaataaaaagagttgcttaagttctttgtagatttgcggggggaggtgggaggggagagggacagcattaggagatatacctaatgtaaatgacgagttaacaggtgcagcacaccaacatggcacatgtatacatatgtaacaaacccgcacgttgtgcacatgtaccctagaacttaaagtaaaataataaaaaataaaaaataaaaataaaaataagttgaaacataaaaaaaaagatttgcaacaaaacagaaaggctcaatttaattattccaattttattcatatattaaataaaatagttatggtgaagaatttacaatattttgctttattgaaatgttattattttgactagtaaaagtgccacactatggtgctattaatgtaagcagaattactagagatttagtagtagcagaacataaaatttatcatgtattttctcacaggtcttacaagagaagaaactggtactgaggtttacactaattttatatgaagtctaaaagtggattctctccctaagattgtaccttggttaatccttttttccttcaatacatcctaagttaagtgtcatgatgtcttactattttttccacagaattaagagcattttagcttgctaaaacatatattatttatttttcttttttcatttgtaattttgaaaatgcatgtggttgattggtttatccactctgtagggagtaagagttacatattatattgtacagcaaacctacacttccctggaatggggaggcattgagacagaattattgcacagttaaaaaagaatttaagccttattaactgtctacattttaagcagaaagatagtttaaagtaatatatttttgctctcaaactatatctaaacattgaatatttttatgcatgcaataaatatctccctaaaaaacatggactagtcatttgatacttgctgggaggttttatttttacaccttggggagtaaagattagaaagtaaccttcataaaatttgagctagaaacatggcgcacacgtacaattaattctttaaaaaaatacctaaagagcaaacaaaataaatggtttcaaaatcgaatgttcagtcagctgtttctacatttaagaaaaagcatttctgctgcccttttctttgctgtttctttgctacttcccacttcatttcttatgtaacccttcatactgtccttctctgtcacattctcatcatatccccaactcttggttttattgtctctgcctaaaaaaaagtcctcttttagagaaacaaagcaaaaaaaaaaaaaaaaaaaaaacaagactctaaaatctgaccttcaccctgctaataaaatgtatatatatatattatatatatatacttattttccaaatttattaaaattttaacacagccagtacaagttttttttgtgagaacacaatagaggaagagtatactgaaactggattttacagttcagaagtagttttctaatatgacccaaatcacttcacttacgagttttctttgctatgcaacagagataatactacttttaactgatttgtgaggataaaatgagaaaatgcatccacaatttacttaacataatgcaataaatttgtgatgtagatcttactgtgagttctcagactctactatcccaatagagttttttgtttgtttgtttttgcttgtctgtctaaagtttatctacaacatacaatggtaaaaataagggcaaaatgttaacttcaccattgtttatatttctaatatttattaaacataaaagagatgcattcaatttgaaagcttatttaagtagtgcatttataattgctttggggggcccgtgggattttgaggagctgcctcaaagaaagtggggagatgtgaggcaaggcttccagctctagcttcagttaaaaaaaatcttactttgtctgtttttttgaataatatgtcattagaggaaatgattcatggccttaaaaaacaacatagaaatcttcttgtctatttgggaggccgaggcaggcggatcacgaggtcaggagattgagaccatcctggctaacacagtgaaaccccatctctactaaatatacaaaaaaattgagcttccagtgagccaagatcacgccactgcactccagcctgggcaacagagcgagactccgtctcaaaaaaaaaaaaaaaaaaaaaaaaaaaaaaaaagaaatcatcttgtctaatggaaaaaaaggaagaaaaacaacaaaataaaacagactatagctagtggctttgtcttgtcttcttctctatctttggtttaactggtggacggctagaagtttaaaggcttatcaactccagcaatacttggtgtgtgttcttgaggtatagcaacaatattggtattaatttatgagttgcataaaattcatgtttgacacttgttatctcatctccagtgatttatttagaatgctttggagaccacaaacataacagaaatttagtaaatgaggcatattatacctatgaatatattttaaaccttatctaaaaataccatcaaaaattagcttctagcaataaagcataaatattacaaataattcaattttgagacatttttaaataatagtatcattactaatctggttctggaagttactgaataatacaataactatcagctgaaaaaatcattaattttattccttttaagaaaattacattgcaaataggtatttacataccggatcatctggattatactgaataacatactctatctgtccatttggtccatcatctatatctgtagctccattgtctcctgaaaatcctgtgaatattgtggtaccaactggagtgagctgaaaggaaaaaagattttaaatatcaattttcattttatcaactgcacaccagaaatgttacagcataaaaatcagctctttattacctaaaggaagataccagttggcagcccacaaccacaaactgaagtgtttcaaaagaacagttttgagccttacacaggagttcttaaaatgtctgaaatgtccaactttgtgattcttgctatgggcgaagaagcagaagacgctgattccgtgttaaacacatttggaccaatttatagccattagtatgttagctcctgtggagaaactgcatctgttgtttctcctcaaaacccttgatgcaatgttacccacaggctagaatttaaactgtaagaaaaagttagtttaaaataaacgatttacgagtgagcaatgaaatccaggctgatgattatatgcaagtggcaagtttgagaaagagaaattggagacaatgaatagtctgtatattagaggaaaatactgggagtttcttgagtccttctgatattggttgagtagaacatgatcaggtcacagcagctggagagatagcaacatcttttcattttggattaaaacatcagaacttaatatgtgtggcatacaaaaccatgatttgatgtgtgacctaaattgctagtcttaattcttacttatgcccacaagagaatcaccgttatttttttttacctgtaggtttttgcgcaatgtgctcttataaccagagtaatttttttaaattttcccctcccagtttttaggttttagctgaaatactactcattagttaaatttcaacttaattagatatcagcttctcccataccacccctcaaatagcattacacacgccacatcagaagatgattccccttttcttgtgcttgcattttgcactttgttcctataatcattgcattgttagaggaactaaatgcacttcatcaataaacataagctctgtgcctctacagactggacgcttttaatgtttgctcagggatttgttctcttaatttttgactaggattccttgatggtaaaaatagcttaagaggcaacaaaaaagttgccttattcagttttactttcagaaactgaaaattcacattttacaaggatccctcaggtaatgtaaatgagtgaagcaagcatgatgagacggtggaaaatagatagaacatgccctctctgatgctactcagagagggtagctgctactagtagctgctactcaatcccagcaaattcttgccatcttggaatatggagcccatgctaccaagtcttctaatattttaattgtatataaaatatcttgatgctaagattgacaacagatttttattatttatttatttatttttgagatggagtctcactctgtcacccaggctggagtgcagtggcacggtctcggcttactgcaagctctgcctcccgggttcacgccattctcctgcctcagcctcccaagtagctgggaccacaggcgcccaccaccacgcccggctaattttttgtatttttagtagagatggggtttcaccgcgttagcaaggatggtctcgatctcctgacctcatgatctgcccacctcagcctcccaaagtgctgggattacaggcttgagccaccgcgcccggctgacaacagatttttaaacattaaaatataaataggtaaaataaaatatgcccattgcctcaacaactacactagtttgcaatctctgatttaggaaaagaatataattatgacttaaaaataaaccataagtacaaggaagttcaggatttataaggcccagtttcctagcaggcagcattgaaggcaaactttggagagctgagaatgaagtgagacgagatcgtttaagtagtacctatgaggacatcgagggaccactggggatagatttagtagaaatgttagtcagctaaattgcttccaagctgacgttcaatatttttcttttttaatggaattcctgttgcaaaagacatccttatcttttataaatattcacccattcttatgtagctgtactttgatatttttattaccaacttatttttaaatcaacatatagaattttgtatatttgttgtgtacaacatgttgttttaaaatatgtataccttgtgtgatggctaaaccaagctaattaacatatctattatatacttttttgtggtgagagcacttaaaaaatctattttcaaaaatagatagttattaactatagttaccatgttgtacaatagatttattgaatttattagttcaagaaatttaaattttgtatcctttgaccaacatctctcaatccatatcccagcccctagtaaccactcttatactgtctgctgcaattacttcaactactttagattccacatacaagtgggatcatgtagtatctgaatatctgtgcttggcttgtttcacttaacataatgtcttccaggtttatccataattttcaaactgtgaaattttatgattggatgacattgatttgtttccatatatctaataaacttaaaaattttgttgccaaaaaatactatgtcatggaggtagatataaaagcaaaacaaaaaatcaaaataaaacaaacaaattttaaaaaattaaacagtatcgtctgtggaaattttgaggaaataaagggggtgcccatgcctttcaatctgcttactggggtaatgtatactattggaccagatttattttgaagagcaggatcccaaagccctacaacttagggagataaaattggtcttgcggggaagatataggacatccagggagaacttcacgtttgccactcttaatcaagattaaatttctggaataaatatttatatgacagaaatttgttggaatagatggtttgaaagattttagtccttacaatgtaatatttgtaaagttgaaggcatatttctaaattcaatatgcaaactattgaaaagatcaatgtttttctctagctctacaatgtttttttgaaatgatgaaaaggccacataaaagtagcatgatgtcttaatatattaccatcaagtaatatttttcttcatcactgacatggctttttccatgcagaaatcacatttgtaagtataatgtttaatatgtagtcctttaaaataaactctacattgttataatgtttaatatgtagtcctttaaaataaactctacattgtatttctttgattgactttcaaaaaatatacttgctgatgaagcctaccaaagattgataatagaccacaggaaaaaaattgaatatgcatttgcttatggtttcaattttaagcttaatccaaagagtaattcaatttcaaatgttctcatttcagaatatgagctcattttgtgtgccacaggtaaatttccctaatcatatttgtgtggccatatatacttttattatttctgaaaaattgcaagtagaaatatgattctataataaatttcattaatttatatctttgaatagaaaataaaagagaaacaattgtattagccgtaggaatagagaaaaccttttttctataatgatattatataaaggttatgaatcatccctaaatataattttaaggtcttttttagacaaaattttagattccttgaaaattaaatgaaaagcattagtgtaatagcaatagatttcagcatgttctttcattcatggctgtctttcttgacaatttcagtaaaaatttctccctaatttcacaaatatggtatttactggctgacaggggaggatgggcaggctcaggaattgtcccaaggtgaggtttgctctcctccatagttccacatttaaggcaaatgtcttagcacagatcactcctgtgtatttctactactagattgtgcaagcatgtacaaatagccattcatatgtaaaatgcaacacaaaatggatcagtcatacatttttctcatgatctgctcaaatttcatgatttgttcaaatggtagacctgttcacatatgagatagggttgaggctaatatgagagaaatagccgagaaaaaagaagataagttatatgggcaaacatgggaggtctgaaaagtctaaaaaggctctaatgaagaggcctatgccagatgcaaaaaagcagaagaaagtagaagcagaaaaaatgttttttaaaaaatagtagatcctggccagatgccatggctcacacctgtaatcccagcactttgggaggctgaggcaggaggattgctgcttcaagtctgagagtttaagagtttgagagtagagatagatagatagataataggcctggacacggtggctaacgcctgtaatcccaacaatttgggaggctgaactagatggattacttgaggtcaggagttggagtccagcctggccagcatggtgaaatcctgtctctactaaaaatacaaaaattaaccaggcatggtggtgcacacctgtagtcccagctactcaggaggctgaggcaggagaatcccttgaacccaggagactgaggttgcagtgagctgagatcgtggcactgcactccagcctggggcgagaacaagactctgtctcaatttaaaaaaaaaaaaagatagatagatagtaggtggttatatgtatattatattcagatcttttttgtgctattataaaactgtgaacaaagagacctaccttatgtttcatagataactctttaatgctatatctcaaaatcacaactaccttattatcattacaaaaaccaaacaaaagacatggcagaaagcccacacctaaatgggcaggtagcattgaaatgtatgcaaaaacagagtgttagtagtgaactgaaataaatttaaaaggtccctcttgacagcctatttgcatccaaaagctctttaaagacagaccataatttttttctttttaaaaaaatatttcatagcatcaattgtagaaactggttcatcagtagaaactcaattaattattcttatttatatatattatttatgcagatgagactgaaacttttcacaatttcttcatattttaatatactaaatcctctacaaggcctctatactggaatactgtatccacatcctcatcctctacctgcctgttcctggttcctcggacaacctcacttttagaggtgatttccacccattcattatgctgttcaattgcaacaggatggccagagcttctggcagctcactgtcaaaaaaccctgcccacctttttttgcttccatgaagaaaaatatgtagatttcactgtgaagtctagttcttcccatgctcttgccagttttcctacaagaaaattttctacagactgtccatgaataaactataaccataataggacccaatacagcaagcacatgcaagtagaataaccttatattcacgaaaccgatggtatgctgttcacttggaataaaatattgagaaggatatgtggtagaaagtcctccacaaatcataatattgtgttgtacatatatatttggtgattagaaaattccactggcatcaatatcattgtgttggtagataacaatgattttctgtttcatattttctggagtctcatgtgtcatatcaacacagaaacaaaaagtttagtaaaaaataaaatactaaaaaatgatttctgaatacctaaaatagtttacacatgtattccacaccaatgccttctgatagattctaatggctttaatgattaaacagaaaccatatgagagtcctaagaagagaaaacatatatttttatgtaatagacacaacttaaataatacctcttcaactggaagacaattggtacaaaaggatattattcaatttggaaacttgcccccaaaaagagccaccctagaggaaaaatttaaaatacgattgatgagattttactttttcccatgcttcctcaagaatccaagttttttgttttctcctacccaggaaaaatggagaatatctgaaggatactgaattttagataagctgaaacagaattaatcactacagttacttatcatataatgatgatttgatgaaagaaatgctaccggggtggcaggtgctctatttctactaatagacattaacaaaaaagaagcattacctttagtgatgcaagattacatatcagcctatgttaaaacactacacatttattttccaattgttaatatcattgatctgatttatagtattaggcagccacttcatgtcaattaatctcctagaaaacccaatcaagataaggcaacattctgtacaaattatcattactagtgaaactgaaggaatcttccacgtttaatcaacaatgagaactatgattcatcctttaactttctccccagataaaataatgttatagattcattcttgcaattaatccctgccttggaaatatgctttagaaatggtaaatttagaaattttaaaccaaagattctccacacatgaaatccagagttgattttgtaaacaggcagtcatcagtggaatattattgaaaaattcaacattttctgacaattatgaaattacaatgtctctgaatctacgattatttattgagaaaatatcgtttgccaaatcattgtttctgtgaccattatattggtcttactttaactagtaaatataacatttgttttattcaaccatttttccaaatcaaacatccgtttgaagtccatcttaaaactttccagaactgataaaaaaaatacatattcttgaattcaaatacagtgcaagttatcttgtaatgatttattaacattaaagaaaacataagaaaagaggtatagccctttttgtctagttaacattaacttatgaaggtacaatttatattaaacaaaatgcagagatcttaaatattcagtatgttgagttttgacaatttcatgaacccatgtaatgaacacctacacaaaaaatataatatttttatcacactgtaaaatttcctaatatccctgtacagactatcttgtcagatgcagctgcttttgacttcaatcaaaattgcttagttttgcctgttcttggacttcaatagagtgtgtaccctttcctatctggcttcttttgctcaacttaatgttttttttgtttgtccttggtccatctattttattctgtttcattaatgtttttcagattccctttaacataatatggttttcatacctgtgttaaaaatcttgatttcattaaaaatcttgattccattttttatcacaaagactagatgattaatattaagggttactttctctgaataaataatagacaaattcatgtagataagtgtatttaaaataaaaaaagaattattactgttacagagaatgataaataactctatctttactaaaaactgaggagcaattaagcttaagttgaatatacatatgagcttatttatttatttatctatttatttatttttgagatgacgagtttcgctcttgttggccaggctggagtgcaatggcacaatctcggctcaccgcaacctccacctcctgggttcaagcaattctcctgcctcagcctcccaagtagctgggattacaggcatgcgccaccacgcctggctaattttgtgtttttagtagagacgtggtttctccatgttggacaggctagtctcaaactcccgacctcaggtgatccgcctgcctcggccttccaaagtgctgggattacaagcaaaagccactgtgcccggcccatatgagcttagaagttgttgaatatttgaatacttgaatgttgtaaaacagctaaaaaattgattcccacgtacatgcttaaagtaaaaagaaatgtattaatatgtgcttctttcacttcctttaatctccttatctctttctcttttttaactgtttcctgattctcagagagaatgtgcccatcctatggaagagaaaaatggggacaagtaagaggaactagagattagtcttacttctttctttaactttagattaagtgccagtactgcatattcaaagaaattccataaatggggatgctcctgaaggcccagtgatttttattccttgaaaagttgaagatatcgagttttgaactccatgatccatgtttctaaaccataatttatttcatattaaaaaatcacttaattatacctagaaattgtaaacaaaacacacaaaatatgtaaaaaaggatattcaactctataaggaatgtcagtgttatgcttctcatgaatactgtctgtgcttttagatttaccagaataattctgataaaaacagatgttcaaaatatatgtattaaatggaaggagatgatataaccacaatgaaatgtaaaagaatagcataaaactatgagaaatggatttggaaagcaaaaactcaaattagatagattcagaggtaatgttaatttcaccacaaagctgaagtctcaataatgttccactaattactgcctgtttataagtgtatctctacactttcatgtgtggagaaactcttggttttcaaatctgtcactatttccaaagcgtatttccaaaacaggaggattgcaaaaaaaaaaaaaaaaaaaaaaaaaatggctaaaacctgcactaagtattttaaaagtatcacctcctttaatcctcaatacaagtttatatcattatttattttgttatcatacttattttatggttacaaaattataggcttagaaagcttctgcctgatgttattattctaatacttggtgaataatctgaaatgatataatttagattatgtatctcattaaagataatttattttgggcccctaagaaaaatgttttgggttattttacagaaggagaaataaattcaacttaattataaaatatctcaaataatatatggcacagtgtcttgtttaaaagtattcattcttaaacactgtgcaatatgttatttgagaaatgttagaattcactattaatgaacttctgaaaaaatgagaaataaacaggaaaacaaaatgtggcacataacagaacccaagattcacagacaatctgaaaccatataatttagattatgtattaaagataaattattttgggccctaagaaaaatattttgggttattttacaaaaggagacataaaatcaaattagccagtacctgcattttaggaaactcttcttcaaataattattactgtcagaaaaaaattggttctcagcaagcaaattatttaataaatttccaaattcaccatgatttcagtgtgcaaacctttacattagtaatcaaatctctattgctagaacatgcctaaaccattgaaaagcattcaataagcgctcaaggagcaaagagaagaagaaatatagccaaccacagtaatttacactttcctcaattatatttcaaaaaataatatttcaacaatcactaataaaaatggtgggtaaaagttcaatgagaaacaggatagttacagtcttaacctagttccccacaatatagctttaatacttattaagtattaagtacaaaattactggtaaatacagaagggaaagctggaagacactgttttgtcaaagtgataaaagccatcactaccaataatgaaacagatacattgtgtgtcttttgtgttacatgctatgataaaaacagtatcatttttgaaacattcatgcacaaagtctacgaatcatgagaaaatatcaggtgaattaaaatttagagacattttatacactcctctggtcctgaaaaatattaaggtcatgaaagtcaaggaagtattgtggaaatgctaaaattgagactaaaaaaattgaaaactaaacttggttttaggaaatacacaataaagtagtaagggctgaagaagtttcatattttcaacttaattttcattagtataaaatagttatgtatttatatatgacatatagtatacattatatataattacatggtatatatacacttaatgtatgacatacttatatatacatataatatatgctgtatatttatcatacacacaaaaatctacctctatgtgactatttatcaattagtaagaggaaagaaatattgtctgaccagtgagtctcaatactgtcaaggtcatcaaaaacaaaaaaaaagcaaaaactatcacagtttagaggagactgaagaaacatggtaaataaaagtaattgttattctgtatggggacctggaatcaaacaggacattaggtaaaaagcttatccaccatgatcaagtgggattcatccccgggatgcaaggctggttcaatatacacaaatcaataaatgtaatcccccatataaacagaaccaaagacaaacaccacatgattatctcaatagatgcagaaaaggcctttgacaaaattcaacaacccttcatgctaaaaaatctcaataaattaggtattgatgggacttatctcaaaataataagagctatcaatgacaaacccacagccaatatcatactgaatgggcaaaaactggaagcattccctttgaaaatgggcacaagacagggatgccctctctcaccactcctattcaacatagtgttggaagttctggccagggcagttaggcaggagaaggaaataaagggtattcaattaggaaaagaggaagtcaaattgtccctgtttgcagatgatgacatgactgtatatctgaaaaccccactgtctcagcccaaaatctccttaagctgataagcaaattcagcaaagtctcaggatacaaaatcaatgtacaaaaatcacaagcattcttatacaccaataacagacaaatagagagccaaatcatgagtgatctcccattcacaactgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctatgaatgactttcttcacagaattggaaaaaactactttaaagttcatatgacaccaaaaaagagcctgcatcgccaagtcaatcctaagccaaaaccacaaagctggaggcatcacgctacctgacttcaaagtatactacaaggctacagtaaccaaaacagcatggtactggtaccaaaacagagatatagatcaatggaacagaacagagccctcagaaataacaccacatatctacaactatctgatctttgacaaacctgacaaaaacaagaaatggggaaaggattccctatttaataaatggtgctgggaaaactggctagccatatggagaaagctgaaactggatcccttccttacaccttatacaaaaattaattcaagatggattaaagacttaaacattagaccttaaacgataaaaaaccctagaagaaaacctaggcattaccattcaggacataggcgtgggcaaggacttcatgtctaaaacaccaaaagcaatggcaacaaaagctaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggctatcagagaaatgcaactcaaaaccacaatgagataccatctcacacaagttagaatggcaatcattaaaagtcagggaacaacaaatgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactagaaatcatgctgctgtaaagacacatgcacatgtatgtttactgcagcactattcacaatagcaaagacttggaaccaacccaaatgtccaacagtgatagactggattaagaaaatgtggcacatatacaccatggaatactatgcagccataaaaaatgatgagttcatgtcctttgtagggacatggatgaaactggaaatcatcattctcagtaaactattgcaagaacaaaaaaccaaacaccgcatattctcattcataggtgggaattgaacaatgagaacacatggacacaggaaggggaacatcacactctggggactgttgtggggtggggggagggggagggatagcattaggagatatacctaatgctaaatgacgagttaatgggtgcagcacaccagcatggcacatgtgtacatatgtaactaacctgcacattgtgcacatgtaccctaaaacttaaagtataataaaaacaaaaaacaaaacacagggaattaaaaatgaataaatttggttctctatatatgtacatagtgctctaactttttaaagcttaaataaacctttaaaaaactaaaaaaaaacaaaaactaaaaccatctgaataagctatgaatttgaattaataatgtaccaatgttggtttattagttgttacaaaaaatgtactatattaatttaagaagttaacaatcagggaactgtatatgggacatatgagaactgtacacttctattaaaatatcacttaggtctaaattgttctcatattatttaaataaataatgtaaaatatagttgtaaatagaccatttccattaccattttcattataacaaagctcaagacttgaatatatcatttaatataagaaaaataatgtttaaatgtaatatagctttacttctattacatttaatttttataaatataatgcacattgaaccaattatttgtcaacaaatttaataagatatacttatagaatgaaacagagtaaacagagaggaagagatagattttcatgtttttctgtgctttcatttggctgaagtttggttttttgtgtgtctgctaattgataaaatcattaaaaatgtttttagtcattcctttaaaatttcaaagaaaagctaaaatatttaaaaactcattgtttaaaattaagagctaattgatgcagtaggtattgatgaaagatatgattatgtcatgttaggagaaacaagcataataatatttaaaataaattaatatgcaattactaattaaatcagcatgtaataccaggtaagaagaaatactgaaactggtctaatcatcccacagaactgatgtttatgttttcgtctgaataaacctagaaactgatgctcccagttctgaaacttgcaaaagttacatttgccctgtctgagttcctttcccaggaaaccaaccattagacctcccaggtagtatcaaggaactggagtttgccagatcgccacatcaggaaaatgagatgccagaccgcttacctgtcttgattgtctaaccaaccacctgcttcctattgaccttcatttcccctccctaattcccattttcccacatatgattacttttcttccctgctatataaaccggcaattttagtcagccaaagaaatgaatttgaggctaatctcccatctttttggctgaagcacctgattaaatccttcttttctggcaatgtttgttgcctcagtgattggctttctgtgtggtgagcggcaggacctagaccaaagccctggcattttggtaaaaattacctctatggtgagctaactattatgcatgtagttgggcagggtgttcatcttcatgggtcccatttcattaccttttagagttttttcataaatttgtgggattctatagaaaagttattaaaggttatatattcagtcaattataactttttataaccatataatcacatctgctttttcagccattgaattttgatcctacatcatcatcatcatcctatcattctattcttcatcctatagctattattttgtaagtaaggtcttttacagtgtcccctcatgatcaattaaagggcattttctggttgctactcttacaaagtttgaatagaataaaaatcagaacttgtgttgatttgaattgacaaatttatcatagggaaagtgcccatctgtgaatagaatgaagtttaaaagtatgtttattagtcttgctgttatatgggatttagcattcttcattttgtttggttataccactatgttaaccatttatttttcttatttcaaaaatataactagaaatataattagaattgacatgacatacagttattccataaaagaaggtggtaaaaacaaaaatacagttgtcccttgccatagccagattattagttctaggattcatgtatataccaaaatctgcacatactcaggtccctaattgaccctgtaaaacccacagaggtttcacatccatgaatattgtatttccatctatgcttagttgaaaaactgcatgtacaagtggaccctcacagttaaaattcgtgttgtccaagggtcaactgtaaagtttaataaaatatttcctcaaaaagaaatgcttcatggtgaaaataggtgtattttacttttagaataatattttaggaatcatgattggatgaaagcagaaactgctggatataattagaaagctcattgtcatcatcgttcctaccattcaatgagtgttatctattcattgcatgcacccagcaccataggtctcatgttacattctctgtatcctttaacctttaataactaccctaaaagtattatagttttttttaattgagaaaactaagtccattagaaattaattaattttccattattatacaggtaggaagtggtcatcctaaaactgaaacctatgctgtgtgactcaatagattattcccttttctcataacactgaaccttgaacatgattattttactaaactgaatcaagtgcaacttttctgaaattagtattaatatttattcatattaatggtcttacactctacactttcagattttaagactcgggaaataaatatgaattttcaaaatcgcatggaattttctctatgtactcaagccctatcagtctcttgcctaatgtatgtatacaatatggtgagcaagtgctcagttttggagtgagaatgttttggttactgacttagattggctacttatcagcagtgagatcttgagcaaattcattaatgcttccctatttctacactttctcatctgtaaaatgaaaacaatgaacacacaaagtttgagtctgtgggcagctatctataagtactaagtaagttatttcatggaaaacacttagaatttgcttggcacacaatgcaattaataaatggtaactcaatggtaattattataattcacttattattgtaaaatacctttatttcattcaaagtcaggaggtatgatatcagaaatgtggtaaacatatctatgcagtattcttattatgaacaaatttggataagaacaaatttaaaattggtctagtatgaaattagttcctaatgagtatgcctaatgacaaaaggagtaagaaaaataaacattaaaattattataaatctaaagtttgaagacatttaacctggtaagcaggacataattttctatatacttgttatgtcaatatttaccaaaaaacttgattctttcagaaactcaaggttatttaaactgctaatactcaccttcctaaattgtgaatggcattttaaatgtaaatttatgaagcatcctttaaaatttcatgttattaatactgaaagaaacagaacttgattaaacacaaattcattaagctgactgtgaagcacttgggaccctttgcgttgatccttatagagccgtgcgtctagaaaaacctttcaacgaaaagaaaaggtacatttggtcaaaggggaatcatattaatgttgcttaatcaatgagtttagtatttccgggacatgaaaagtagggtaaaaaaatctcaagtggcatgacagtcatataatgaataaatacataatttctctctaatgttttataaatagaccgtaattcatatagttcatatttatcaagttttaaaaagtgttttttgttgttcttgtcattattcttgttttaatctatgtaatttattataataatctggaaaggttatactcgtttctttaaaaaatttactctatatgagcttcttcataaatttaactcaaagcaaactcttgctttctatctcaggaacatcagcgtagaaatatatatgttataggatatttttctgtatgataactgtgccattcctaatttaatgataaacctacttatagtacttctgtaatgtgccaggcactgttctactcaatgaaaaacaaagtgccagctttaatgcagattcaattttaaaggggtagatatcataacaaaaagcaaatacatatgcagtattgttgcagataagtggtataaagataaccagcttcagatagtctgttacaagagtcataaaatatgcaggtcatttatcatacatggaaaagttgtggggcttttttctttctattttaaaatttattatgtgtcttcattgaaccttgtgaggcaaaaattctaatactaccattttcgttttcaggtgagaaatctgaagtacagaacaaattaaatgaaatgtttttaagaaagacaaatgaaactaacaaatggtaatccagcaccagcatcactgtatatttgtattgtcagcagatttagctactatggaaaatctttgaagaatctttctcaacatgatttttgatatacacatgctctaatttattgtgggtatattcaacagagtagaattgctgagtcatagggtgtctgcctgttcagtttttgttgacactacaaaataactaatgtaattgtgccaatttacttatctaccaacaatgtatgaaagttgtgattatccatatctctaccaaaacatgagagtatattttctttcaattcaaagtgtaattgaacttaaaataaataaatataattaaaactccattttggtaggtattataatccatggatggattacttttaaaaatttcattttttatttgttgctgatgtataaaatttatttcttttaaaaaatattggacggtcacagtggctcatgcctgtaatctcagcactttgggaggctgaggcaggcggatcacctgaggtcaggagttcgagaccagcctgaccaacatggagaaaacccatctctactaaaaatacaaaattagctgggtgtggtggcgcatgcctgtaattccagctactcgggaggctgaggcaggagaatcgcttgaaccctggaggcagaggttgtgctgagccaagatcgtgccattgcactccagcctgggcaaaaaagagcaaaactctgaaaaaaaaaaaaaaaattgaccttgtctgcagtaaacttgctgaactcactttttaactgtaattttttttttctgtaaatactgttgggtagttctatatataataatgccatttgtaagtatttaatttaatgccattttccaactataaggagcatttctagtttgtatttattgattttaagctcaattgtttgatgattagaaaacacattctgtataattttagccatgtgggggacatgttgatacatccgtgaaaacccagcatttggtaaattattttatatgttccatccatgtgcctgaaaagaataaacttcatagttgttggatacatcattttaaaatacatcaggtcaatttcgctgatttcaatgttcaaatcttatgtttccttgcttttttttctttacttattttgacagttactgagataacttttgcattagttttctattgctgtcataaaaattatcataaattttgtggcttaaattaatataatttactctcacacagtttggtcagtcagaagtcagagatagctctcaccaagctaaaatcaaaatgtctgtagcactgcatttctgtagactctgaaaatgaattcacttccaagctcattcagattattggctgtatttatttatttttatgttggtagctgtcgactggggttccttcaagagtattcttgcattttcaggctatattatagctccactggtgttcaaaaccagcaatagtggctaagtccttctaagtcttagattgtctttgatctccccttatgcctcatcttatccagttcctcttcccttgcctctctctgactctagccagagaaaattctttccttttaagggctcacactgagattgggcctaccagagtaatccaggataatctccctattaacttccataaccttaatcgcatctgcaaagctatttttgccaggtaagtgtacagatatctttgggaggctttaattcaaattatatgacctcccaaacatcaattttctaatttctaaaacagggatattccttccttgtaaagctactgtgaggactaaataagataatgtgcataaaaagagcttaccacagtgctcataatatagatatagctccataaacaatacattttaatttattttaatatactataggtaacccatgctttagaggtttttatagttccttcctgtctgcctcaggatggtaaaaataaataaatattgactgaaaaattttctctcaatgaaaagatcattaaaaaccagacatatataagctctatattaacttgagataaattcttcacatgaccaagaaaacattatgtctgccttgacttgctcttgtttacttacatcaaaataaattttggggggtgagatgaacctcaaaaacctgccatcactgtcgagaaagatttgtctccaaaacttgcataagaatgatcagcaactgtgtaattttttcttgaaaccaggcaaactatttacttaatgatacaattgtttaaagctaattgagtcttcacttaaagagagaaaactacttcaatgtcttatgtcttgctcatgagaaagacatttgaaaccttgttataacccgtgttcaacatgtagatagaggaattaataatgttttggtgaattcttgacaaactaatagaagaacatgtttacgaagagcgtaagagggtagcatttaatgcatttataaaagtgctgattgtgattatgatataataccataaatgtaaatcatatttatttgtaaaataaggtacatgaaagtagttataatttagaatactagaatgtttattgataagtagtgaggggatgattgacctaaggacttgagttttattcccaacttcgtggtcaattttgtaaccatcaatttatactactgctccagttctcagttttctcatggtgaataaaaagagtgactaatcaggactttaattttggaagcttcttttataaatctgtgataatgactttattatacctgtcttttgtattttaatgaagtgtgaaatattttgacattaacaatctattaaactgtgaacgatttttttggaaaaacatttagatctttcttaattgcataaacttcatgtcttatactaaaaggacaaatagtatgaaaaataccttgcaatcttgcacagaataaaactcatttcatttaattttattacaaacacagcattgtagatgggcaagatagggatatctatttatacacatacacatatatagtatgtatgtatctaattttaatgtatcttcctaatacataattcataatagataaaattcatgtcaactaaaccaatagataattcataatttataattcattggactaaactaagtactagtactatggaagaactattcaaatgaaaaatgagaataatagctaaatttctattttttttttgatgctatttcaagctttaaatgcactgttttttttttcaagaaagtaaatataaagagtatgggcaaaatcaaaggtgaaaaatatgaccatcaagtacacacatttgatattatcaaaccatagaagatatgaccatagtgtcaatgggataggatgacctcagttatctaaaaggaaatgcattgtgagaaacttaccagttcaacaatgtattgacagctttgcacagtaatatagcttctcaaaataatgtttaagatcaaatctttacctttcctataaattttatcactctgatgtttaggagtttagggtttgaagaaattgaagatcaatacatgtaaatattgattatttcataaaaataaatcaagtaaaagagatgaacaaaattttgagacttgcatggtagggaggatcttattctaggcaaaatgaacagtgtgagcaaaggctaagaaagggagatatttatgagatgtgagagagttaatctgaacaggataaggcattatcagggagaatttgagaatgttcagaatacattgacaaatggtcagattatggaaaagcttgaaggtctgccagaagaagtgaccttttgacacccgacaataatgagaaattgcaaaacttttgaaaagtagagttgcatgattaaaatgatatttgagaagttactgtttaacaagacactgaaaagattagagagggaagtggaaacagtcaaatcacataggatgctttgaacttcaaattgaacattataaatttctgaaagaaggatgaactatgaagagggatccaggggcagttagtgacatggatgaggctggaaaccgtcattctcagcaaactaacaagaacagaaaaccaaacaccacatgtcctcactcataagtgggagttgaacaatgagaacacctggacacagggaggaaaacatcacacaccggggcctgttgggggagtgagggggtaggagagggatagcattaggagaaatacctaatgtagatgatgggttgatgggtgcagcaaaccaccatggcacgtgtatacctatgtaacaaacctgcacattctgcacatgtatcccagaactaacatatatatatatgtgtatatatgtgtgtatatatatacatatatatatatagattctgtaagtagatttgttgcctaagataattcacctatcactttataccaaaaataaagttagcactcaaccgaacaaagcaaatgtaactcaaagggtgtatttcaaaataagatcatttatatataattaaaactagttacttggaaattaattagtatctgtcattacagtagaaactcattaaacaaaagtgactcaaagaggtgaagcatttatcgaccagtaattcgtcttgttaaatttaaataggagtttgtattttgtttttaagttatataatttagaaagtctcagattacaaggaacataatttcttcaaactttcatgaacacaagaatgttgaaataactaaaaaatatttttagtaacttcaaaaagaatctagaggttaaaggcccaaatgatctgtttaattcacaaattacagttattctcctgtaaagcaggcatgcaaatttttaagattaaaaaaaaatcttgaaatgaaaagatggtctggtaaaatatgtactatcacattaatgtcattcattttttcatgtgtctaacatacacataataggtcacattagaggtactctagaaatattttgtagcttaattaactaaaaataattaatacagtaaccacggtttaaaaaaaaataaaagtggttcttcacttatgcactttagccaaaagagaaaataaaacaaagcaaaacaacaaacaagcatgtccttaaaaagttacaatactactttttaaatataatttttctaatttgatcagcatttttctataagaattcggttgtgatttgtagttaatttttggatatttcagaacttgattttaaaatccagaaaataactttacatttatagaaccgcagacattttcttccagtatttaattagtatgaccacctcagaaatacaaaggcaatgtatttgtattagataaatgccttaggataataataataactcgtgttatgcctaagtaagcatgtagatggatctaggcaataaattttcaaagatgatgaaaaataaaatatctattattataaatacattatttttcccatagttaaatgaattcctaaaataacatcggaagtcacatacttcttctgagtactatttttttaatgttttcttgatatttctaaacagttaagctcataattttaaaggaatcatttataaacatttattgtatatagttagatacatatatcaacagaaaggacagagagagagtaaatagaaactgacctcattcactgtggcatagtagctttcatgcttgaaagtgggtgagttgtcattcctgtctctcaccactattcgcacttcatggtagataatagtgcccacttttttgttgatgcactggacctgcaccacaatggagtgtatgttcatcggtggctgcaatgtagaaattgcatcttttaaaatactaattaaaaacaaagcttctcatcactgtcaaagcactcgttcattcagtacatttttctattcttgtttatttttaaattataataatctcaaagaaaatgatcattttaaggacaagagaagacaatcataattaatttattgtttaattttgtatctcagcgtgtggaattcaggtagcattatgctcacagttagtggatggctaatgagcgcacccacaaaattaatgcttagaattgatgggattaaacgaagtttgcccctccaaagattaaagaagcaataatataaacttttaatttgaagaaagtgttaattaataaattcctggagaagagagattgtttaacttttatgtttatttatatttttgctggaatattatatgttcattgctgatcaaattaaaaatactgattaccaaaagagaaaatccaaaagccagccaactaaacttactcattctacacatttaaatgcttattttgctaatctttttcactctctaaatatgtacatattatagacacacagacacacagtgaatatcagcccatgtttataaatatagatttactatagcattttttgtataatactatgaagttatgttatgtgacagcaatattatacttcattgtaagcctatagcataatgtatccaagtaataatttaaaatgaactactccaggctattatattttgtcattataaaaaatacttcaatacatagtatacataagcatatgcttacttatctaataatttttataataaattccttgaacgggaaaggtcaaagatatacttcctcaagtgccatggctaacagtttgcagagctggaatgcacacctacaaatatttgactctagagtcagagtattgaccactacaaagtatttctttgtgatttttaaccccttttgagcttatgcaactttatctctaaatatgtcatttttgcagtgtcctatcctgacccctccatcttaaaaaccttgtctccaacctgacatctcctttcaaatttcttccaatttatttttctttattgcatttctcaccgaaaatttggctcgttgtatattttatgtacttgttttggtttgtctgccttcactagactggaagctcaatacaacctgtgtgttattttagtcatgatagtatccctctttccagtaaccagccctatgcctaagacagatgatctggagtcaaactgcatggcttccagttccataacctactaactgtatgatccaggaaaaagtacaaagtatctctatgcttcgtttattcatctataaaattaaggctaatagttacaccaatgagaattgtaaatactgcatgtgattagactatactaggcatatgttaaacacctaagggattacatacatatcctattttatttattaaaaaataaatatccaaaatagtgaaaaaataaaatctataatgcacgacacatttgtaaatgagaaaaatgctacagaaactatatctaagctgaaggaaatcattatttagtttcaagatatttttatggccaacaaagaaaaagaaagttgacttgaatttgtagctgtctgaatgatgctacctagaaagaataaattgaggcatcattgacatacgaaaagaggtctctagtgaaatcacacatagctctgtgtttttatatctactctatttctcctttaatcactgatataaatgaaggcattaaaatcatgtgtataaaatctgtgaatgttacaaaccttggaaggatgtataaatacatttaatgacaaaagacatggttcaaagtcatcttaataagtcataataatgggttacaaaatggtaaatttttgcaataataaattttatcctccaatttgtaatagaaaaaaaatcacccaaatgtaatagacagctacaaacattaatgtaaaaatgtaattgtgaaattttgatagctaaaagctgattttacatgacagcactgtaaatgggctactggaacactaatgcatactgtacattaattaataatatcagataataatatataggtagattataacaggtaccattttacaggtgcatagaagagaaatttgaacacttttgagaatgtataaaatgggaggattttaaatttaacaacatatgatttgtcaaatatctaaatggttgtcatggaaacatccattagttgacttactgtagtttcagagagcagaaataagaaaaatagttgaaaaatatttcaaagcatgttttcaccataagtagagggcttctcttaatccaaatttgcaccaaataattatgtgcctctatcaaagtatctcatgtaactcatatgcacctactatatacccataaaagtttttaaaaaataacaaatagagcagagattcttatcagtagaagagtatagtttatgttagaaataaatttatgccttcgcacttccaaatacttttcctctgccattatgagctaaaatatttgtgatgcttcaatttctttttttcacatttgtctttgtataaaataaagaaaaatcaggaggaaaaagtgacatggaatagaacagactattctataaaacaagacccatcactgaaatatgccagtttgaggataaaagaccattgaaaaagactagctcttagaagtttcctggaaagaatttgaattagatgacctccatttttactaccagctttcaagtgtgtaatagaccttttaaggcatgtccagcatattttaattgtaaattaaaaacaaaataaatatgtgtactgtttgtccttggcacacctcttggaagacaatgaggtgaattatgcacttttaaagttatttatcttccaattattgcaagagagacctataaaaacattctatctcaacttctaattctacttggagtggtaccactgggaccaaaaggtcaaaatcttatcaaatagaggatcaaatgcactgtgtactgaggcctcacttagtcctgctaagtacccataaattagatctaaccaggtcacctggaacagttatcactctcaactttagctccctatgcaactgttagtggcatggctagaacttagagggcaataaattataaccataatggatcacaccgaaggcaaaaattccctgtggctaatatataacacacaatgtaattttgtattggcatagattcaattctgctgtataagaaggtcatacataaaagtacagttctaataagtccattagtgagagtttagggactctaagatgcttaagaatgcattagggaaattttgctttatctttcataactggtggcaaaaataagccatggtaatttgaccttttctaattttctttaattgctttattcatcaaacaaagaagaaaaaaaagctaggtagaaattgtgttcatataactatttaaaactattaccattcatatatacctaaacatgcaagctattctttcaatttaaaaatgagtgcttaacacaatactctgaacgtatacttgcacatttgtgtattagtgtacctgtgtataggttatgatatgtgtatcaggaatgatatatatcaacaattaaaggatactatcattaaaaagtgggtttgagagtatgaagagaaaaaattttcccacaaaaatgtaaaaattttgtaactctgaaaaagaaaaaaatataaaatagaaatttttgttatgaatttctcaatcatttaggattcaacatgaaaattaaagtttttataggggatttgttgatattagcagtttagattatagcacaaatcttcaatccaatatattttttttctagaaaccaaatgatttggaagtcaatgatttggggggcagggaatgcatttttggcaaatctgtaggaatttatttttcataaagtataggcaaagtttgtctaattctcaggagtgaattttttttgtcatgatatttctgtctatggacttaccacctttataacataatcattcctatttcacaagtaatgtggaagacagtgaaaggaaataagacactgtgtgttttagaaacgacttttacataaaaaagcaaacttaaaggaaatggctggccagagttgtcagtgtccttcacaaattaaattttcacaatgaatagtagcatatttactgaagatattacctaaaaagaaaatatcaatttgtaaatacaattatgcatatgtgacatgtagatacatctatagatttttcacagtgaattattaaggacattcagtctatttaatggtaggtatttgttatatgaaaagtttaatgtgggttaggattaatatgacttagtccttggatactaatagcaacttttataaaactgatatgaggtgatcataaataaagtcagtcaaaaatactattaaataatatggattttagaacaaggaattgcataccagtgttattagaaaataatttatacagaagcagcatttaagatatctcttagtagcacataaaattcaactgatagcactggataacagtgatttcaaagtttatgttcaaaagaacatcagggaaggtatggtaagaaaaaattggatatggtcatgggacaataattacattagttttcttagtttgtagttcatacatttctaaataaaaagaaaattatatagacagggtgcatcttgaatctagcaaaactcaagagacagatagaaaacagtttgcaatgaaaaggtatctgtgggcacagtctctgtttcagcactctggttgtagaataggttgaatcaagacaggtggtagacaacaattagtttatatgagtgatgactaagaggtcttatactaaagttatgttgactgatggagatgcaagatacaaggtggagataaaactactaaacttagcagttgaatggacactggcctgggcaggggagtcaagccccttttgcagctaccaagttagagtctgaaagaaaagaagctaagatatttgatgttgttatgaacataatttctctcgtttcaaaagcttttaaaattttgcccaggattttgagataagtattataggactgtaccagagtcatacttttctttctgttattattttaattattgatattgtcatgaccattattatcacatgcccaatagtgatgagagcattttggccatgtgagacaatcatttagcatttcaaaatttttatgtgatgtgcctttattactgagactcttcatgttcaccccaaatatcacattctggttgtttctcttttgtgacttttaattttgtaactcttcctttctttttttaatttttgggtgctgaaaatttatgtaactttagtgaacaaaaaaataaaaataagacataaaaataaatgatgaccataagggaaaatcttataaaccaagttttaaaattataaaacagttcatagtcatacaatctcatgtaaatgctttctaattaaatacaaatatctgagcgttgggtatttttattctttatattcttcctcggaaattttcatgaagatcatgtttatcagcttatttttaacacactgttaaaaatgtttctgtctatattgtttgcttttaattctattacagccataattattcaaacgtccccattaagagacagtttattgcctcaatgagaaaatgtagaaaacatgatttgcatcactttctctggaaaataaatttttctctaactgttgctaaaaagatggtataattggatatggatctaccatgtggccctactccttgctccctggctatagattcaaaccagtgagtatttaattgttatttctctcagaaattttaaaacaaaacaaaacacagtgactttaagccttctttaatggccactgcatcaaaagtttatgaagaactggcatggcatgaacacagaaaacacttaaagtcaaatgaaaaacaaggaagtggagtaaaattataagtgtataaaggaatctgctctgcagagagaaaaatagagaatatgcacagagaaaggcagaaactagagaccatatggtccaagaccaagtagttttcctctctccctggtaaacatacaatttccataaaagtaaattattttttatatctatgctattggtattgttaatattctctcccatcagctggaaatcatttgaaggcattgttgtgtcttccttataagccaaataactttgattaaaatcagaatattcttagaaaagcataatttcataacaaaaattcagtggaaaattttctataaaaataatttcaagagcaatttaccactaagaagggttaaagttaattataggctagtgattataatacaaagctttcgccattgttagtaggatcaaactcaaattgttggttctattttgatattcagagcatatatatatatatttgaaatggaatatatatatataatatataaataaaaatatatttttgaaatggaatatatatatataatatataaataaaaatatatttttgaaacggaatatatatatatatataattttttttctttttgagacggagtcacactctgtcacacaggctggagtgcagtggtgtgatcttggttcactgcaacctccgcctcctgggatcaagtgattcttctgcctcagcctctacagtagctgggattacagggtacctgccacaatgcctggataagttttggactttagtacagacgggttttcaccgtgttggccaggctggtcttgaactcctgacctcaagtgattaactggccttggcctcccaaagtgctgggattacaggcatgagccatcacacccagcccatattttttattttgattcattatattcataaaagaacaaccaaaaaactttgggcaacaatcaaaagaattacattttaggtaaatgccctatattttaaaagaaactacaaatattttggtatttatcataataatatagttatttaataataatgtatattttatctatatttagcttttgggaaaaaacattttacattaaataaaatttaaaacagtgtaaataaaggtatatatatttacatatatgaatatcatagtattaatatatatttcattaatactggagagcatattttcaaatacaatctatataaaaagtgtgcactcactttttttaaaatgaattctctactatatctttgtagaaaatattaactaggatcatagagaagcatacagaagaaaaaatatcttattctatatcaatgtaaataatgttaaaacaataaagtaaaaacatacaacacctctccaagtaaactaagattatttcaaatatttacataatattattattttatttcagacattacaattatttagcaatattggtatggaagcatatagggacaatatatcgagaggaccatttagtaaaatggataaaactccctagtccagtaatataatgatggtaaatgaatttatctctataaaacaactaaacaattgtagaaagatgcatgtacaaaaattttcactgcagcatttttgtaattcttaaaaactgcaaacaaacttgacttccaaaataggagattcattttttaaaaatctcttatttattcatgcaataaccaatcatgcagctaataaaaataattatataaatatacatttgtttgcattataattttacatgtattataaattttatgtaaaaagtaggccgacagcaaaatgaacagcataatccaatttaaattaataagtattataaatatacatatcaacacacataaatgcttgaaataaaatgtggcagaataaacattaaatgttattttccctaactgataaaattatcttcatatatatgcttcttattttctgatatgtttaccataagcatatattattttacaattaaatgagactgtaatttccagtagtgattagatttggactaaaagcccagatttacctcactatttgtctagcagtaatggtctataggacacataaaacagatgggcactaggttaaggatattcagaataaaagcccttatgctttgatgaatgaacccctaaaagcactgtggcagcaggaaaacataattcacaagaattcaaagaattcataagtaataaagcacatagtaaactgtagtaaaataagaggcaaattgagatttattaaagactccaaattttagacatgaaatagtataaagtatcaaccactccataacctattgtaaagtggatcataaaccctgagcaatgatgtgaaatgattcaggttcactaagctgagtatctgacatttggatttcataagctgggaacttgtgggtaagcatgtttagagttactctctgagttttcccagggcccagtgcaattactgattataatccactaccctctgcccctctgtactcaagaaagactgagatgcaaataagtgagtacaaagttactttagagagctacttatacctattaatttttttttaatttttccagaaatgaaacatccaactacgttggtaatttagcaatttttttttgaggtagtgtctcgctctgctgtcctggctggagtgcattggtgtgatcatagttcactgcagcctccactccccaaccccaagctcaagggatcctcccaccacagtctgcagattagtgggactacaggcacgtgttaccatgcctgcctagtttttcaaattttttgtcaagacagagtcttactctatttgccaggctggactcaaactcctgggctcaagcagttctccccactgggcctcccaaagtgctgggattacaggtatgagctactgctgtgccaagcccaatatagatattcttaataaaaaaaaatttatgctatctgagaactacttgactggcatattaccatgaaactttttctcattttttttttcttttttgcaactatgtaagacatttccacagttttgcccttcaaccaatgcttactagttgtaaaagcaggctcctgtgagtgcacccaccaaactacatcttcaagccggcagctgagtgacacacttacatgttgccattgttggacagaaatgagttatagccatgcttgtcctactttgccaagggtaccacctcttttttctaagcactatattttcttcttgttcagaaattgacaagcttccaggatattaaaggggaagtctaacggttctccaggacacagatgttcccttcctttctcattcttctttaaatgagttaaagaaactgttgttgctatactcaggaaataaactcaaattatgtaaataattcaatatcatataaacacacacatagacatttaaattataataaacttatattacaggggcaaagaaaaaaaatcactaacatctctatccagaactcttccggtgctgttcaggaaaagcatttgcttaacaggatccatcaacacccagtaatccacattatcctttaaagaaagttctatggtggggtctggtcctccagcagtccctttgatcagcatgttgtccaccagaattgtacctgcaaaccaaagaaaggtacttgaaaacatattctactcatatgaattctttagcaaagatcatgctcttaaaccgcggctggctcacaatcagttttaaagctgaaaatactcaactgtatatctagcataagacagaaaatattctttaccaaaaggccaaagtatctgcattatattatttataaataatatttttggtggaaggcagagatacagacatggtgagttccatcatccattttgtgtttccctctaacaacataaatctgtttccccccatctatcacttctcacaggagttatcactgaattttatcctgaacaaaaggaaatgcctgtaatagcagagtctgatgtctcaattaattctgttagacctctgatgtgaaaaaaagatattgtgaaactaagaaaggaagaggaaatagatttttaaaaagtagctgagcctcccatggtgagaactgcttctttttatcttagagcaaatacataaaacatacatcttgacatgaaagacaaaactagtgtgcagaaatggaatagaagccattcttctttaagacatgtctgggttactctactagaacaacgcactaggccagtgtaacatttcagtgattgctttcttattattttttttcagcaagctgaattgtagacagtttttgaataaaacttgaaaagattatgtctctaaccctttctactgtgttaaagatcccatgcattttacatgtcgaatgcaaacagcactgatgcaactcaaataccatttttccctcacgcagcaatgatctctttgccaaataataatgtaccatggcttagagcaatcattttcaaccgatccattttattaaacttatagatatagaagagatgtggctatgcaagtaaaatgtagcctccaaaaaaacactagaataaatggcaactatcgagagaacacatcgccttaggacagcactcaagaatatacagagaatccataaatacgaatctggcttgaaaaatataacgaaaaaagtatctgttgcattttcttaaggcatgaaattggcctaaatgttataccgttgcataattacaagaaaagtggaaggctctttaaaatattttctcagtaatttaataataactataattatctataatatttctttatcatactactactaccagtctttatccgcctaagaaatgctggaaagaaccatgaatcttttgtaacaagccagaataatgtttaaacacaaatgttgtctcacatacacatacttttgtaaatggcacattttttgcactttttcacatactaggacataattacatgaatattgagtggaatgagtatttttatttttgactgaaatggcaaatacacaacctacatacaatacactccaaagtatagatcagatattgatggcattttattgcctataaatatgttcaagaatgtatatatattcaaggccccagtacatactaatttacaaatacttcacacaactcaccatgaaaagatatttgatctgtatttcaatatataattgagaaattgaaagggaatttattttctcatcaagaaaacttatgtacaataggcaggtcaactaacattaacattaataccttgactcaatagtgtttaagagtagcaactgcaaatcttctgattgtgtgtatgcatgtatatatatatatatatatatatatatgctccatatatatatgctccatatatatatgctccatatatatatatatatatatatatatatatatatatatatatgctccaagctgcgagcagatacactaagggaaggagccattgaactatctttacaaagcaaatagtttataaccagataaagttttaatagtaactaatattaaagtagtgaaacaaaaacactgtatctggatttatattttatttaaagattctaactttcatggaaaagatctatagttttcttgctctcagctcactcctgagttcaatgattgaaactcaacaaaaaatctttctactgctggtgtgttgaaagagttttgtttgcttgcctgctttcccctttagaattgtccatttgtattgccaaaaagaaaaaaaaaagcctctcaaattttcatatacaagcttgctttaagccaaaatttaggggagagagagagaagagagcaaagcttaggcagacatgatacaaggagcaatatacatattttttaaaaattaacctaagtgttcactctgaattgcctgaacaactgtgcccatacccctctccttagaagaatacgtgacacccaagctatagttagcattaagccagaaactcctgtctctccctatcccagcagtggtgactgtatctttccacacatcctaagttttcaagatctgaaaagctagtgttctagacaatattggcaagcagctaaacaccagaatactctgggtgtattgggataatgtgctctctttcctccttcgttactttgcaagcttccctttttgccaataaaccttttgcttaatgtgtttcatttgatgtttaaatgtattctcttctttgacttcattttaaatattacagataagttaaaaataaaaagatgggaggcacgacacaacactaaataagaaaactggatggctctattaatgtcagctagaacaagcaatgtttaatagtggtaacgagacatatttaattataataaagggatcaacaggaataatcctgagtaggcctgtcttgcagaataggtaatacccaagatgggattcaccttacatgaaattttcctttcatcataataaaaatggtggcagttcagaaaatggaattaaatttagtttgatactcatataatagaagttaagagagctggccctggaatggataggcttagaatccaatccataatccaccacttaccaactatgtgaaagtggataaccgcatttaccctcgatttttctccctacaaaatcagtactataagagaaaaggcatttctactataatactatatgtatgttcctgaaaaagacttgttctcttgtatttagaataataaaaatcaaaacaatcacaatcgtgttaaaaatattagcacagttaaatatttattgacattttcaacacatttcttggctggtcaatcttttacagccttaaatactgggatttgtgcttcatcctttaagaagtaggtattgagggccatttacctctagggacgttttttataaaaatggaaaacttcctctttcatttagcctctttattagcctattaattcagaaaaataactttgcagcttctttttatgtacttcctgattctcaagagagattaacatattaaattacaggagttcatgtaactgctaatatagactctatttgtacagaataaatgttcttcaatagattttccattttttcttaagatcttctcacatagctagccctttctttttaattgtgacattagagcttgccacccatacaagaggatagtgggcattaagtatggtccaaaaaacctgtgacatgcttctaccccaaagaaaagtctatgtttctatttcccatgtatatgattatgtggttacataacatgagattctatgttgtatacatgtgtctatgtgtctgtataacatgagaacacaaactgtgttgtgttctgagtccataaggaatacataacaacctgattgaacttggaagcaaatgcttccctaaccatgtttcagatgaaatggtagccctgacaattccttgattatactcttgtgaaaccttaagcagagtacctggctatgctgtgtctggactcctgactcaaagaaactatcaaataataaatgtgtgttgttttaaattacctaattttaatgatattgttatacaataacaggtaatttacacaggatttaatgtcaaaagatctatgttcagaatcttggccgcacactattaactaactgtgagcttaagcaagttcccaagatttttacaatcagcaatatagagttctatgagaaaacaataaaaatgaatgtaagtggaggcacgcaactacccaatgaataacatttttcatcctacagctactagcaatttatatagatttgagcatataaaggagttatatattatttttcattaaattgggaacattatcaacaaaatgattttaaatgtaaaatgtactttctgtacaactgaaataagagaagcacagaacatacttaaataccagcaagaaaaaaaaaagactatgtatgcatatgtaaaatataaaacaaaaagaaggcaacagtttattcacagtaaccgttgataacttttcatgaaataaaaggccatttcttgctggcaaaagcaaaaatgaacaagataataagcaaaaaaagtcatactactaagatcaaaaatgcttattagtacttattagcatttgctgactgtattaactggactaagagataaaatagaaagacgttcagggaattaccatatttaattatcagactggtgtaaatgggaaaggtttataccctcagaatattgcaatattttattattttcaggccatcaaattgctgcagttaaaattaaaagtacaagcataccatgccgtgtatgtgtgtttttgtgtgtgtgtgtgtgtgtgtgtgtgtgtgtgtgtttcaacataatgattaaagtgggtaaaaaacaatcttcataccccactctcctcaaccaaaaaaaaaaagaagagtatagaatctaatcaggcagttctgttcattagaaaaatatgtcccaggggttgaaatcaaagaaacaaatattggttattttattttattttatttttgagagagtcttgctctgttgcccaggctggagtgcagtggcgcaatctcggctcactgcaacctctgtttcctgggctcaagcgattctcgtgactcagcctccataatagctgggattacaggcacctgccaccacaaacagttaattttttttttttttttttttttttttttagtggagatggggttccgccatgttggccaggctggtcttaaacttctgacttcaggtgatccatccgcctcggcctcccaacgtgctgggattacaggcgtgagctactgcatccagccaaaaatatggttttaaaatgtatgtgaaagattgatttgaaaagataaaagccaaaaaagccctgcttgatgaaaaagctcaacctcttaacctgtgtctccattagaatcaattataaacctcaaattttgggtttttcttccattccctaaccaaacaattaaatctctaccaagctgaagatccccccccttttttttttttaactaaaacttcatttcaacttgtgaaattcctttttttagtgaaaatgcaactgtagaaagttgttgttgttgttagatatgtgatttaaaatataaactttttgactgcgattttaaacactatttcaaagttttaaatgattcgattcagtaaatttgtaagtgtgatttattagattgaaagaattgattaagtgtcttaagaaaaaaatcctcttgggtatgcttgcctacccttctagatgtttgaagagtttgtattaaatttatcaacatcacagtagtttaattattaaagattgcatatatagtactttggataggggaagtaagtttgttaagcttatgagttaatagaactttaatcacagaacaaattaaagttttttcccttagtttttcagtcttcctacggttatagcaggaatgaaaatatttacgttatatttatggtcaaatacgattttgattttatctgtgtcatttacacatatttaatattagttaaaactcaagcaatattccatgaaaagacaacccacatattcaaaaaataaacaaaaacacctaattgactgtaggacaacaaacaattatataagacaatatgtttaagaaatggatgtggaattaactggtagtagtgaatcaatgaacatatttcaacaactccatttatttcattttttgagtttctggttgatccaaatccaagtgtatattccaggcagagagaaaggtcacatcataatcctcctccatttctcctctgatttcagatttaatttttaatataagatatttaaaaccttttattccatagataaatttgtacaatagaaaatgtggttttttagtacctctaggagaattctgagttgtcataaccctacagttaaatctgttttctcacctataaaatcattcagattaacaattctgtaaacaataaggcaaaattatttaatatgttattgaaaataataaaacagatggatgttatgacaatactaaatgtgaattagaactatgttacagaaaaatgttttgtttctataggtaatttgcttctggaaacaattaattggaggacatatttaataaccatacgtgctcaagcagtttgcttttttcatgtaaaagtgggcaagtattaagactaaattctgtcatttttttctatggcagtgcctatcgtagaaaaacaaataagcttaagtttgataattaaagcagcaaaaatgtaattaactaaagagtactcaaatattcaaagttttctgataggcttatcatttgagaggttaatccagccaaacaaatttaatttaaagtactctctaactgcaaatgaagtaaactttctaagtcatattccttttcaatagcacaagtacttgccctttttaaaaaatcaaataaactaactaaattaaataagattctttcaggtattttctaaaggtcattttattcatttggtctgtaagatgatgaaaatcattttacacattgaagaagctatttcaaagcctgacgaagtactttactttcaaaaatattttctaataatcattgcataaatgtttcacctccttggttaaattgattcctttgtgttttattctttttgatgctattgtaaactgaactattctcttaatgtcttttttagcttattacttgttaggtatacaagtacaactgatttttgtgcattggttttgtatcctactactttgctgaatttagttattagttgtgtgtgtgtgtgtgtgtgtgtgtgtgtgtgtgtgtgtgtgtagactctttagggcagggatgtccaatattttggcttccctaggccacagtgaaagaagaattgttttgggccacacaggtaatacactaacactagcgacagctgatagctgatgagttacaaaaaaaaaaaaatcccaaaaaataatcttatgctgttttcagaaagtttataaatttttgttgggccacattcaaagttgtcctaggctgcatgtggcctgcggatcataggttggacaagcttgctttagggttttctatatgcagtgtatttaagaaagaggaagattgtttaacttcatataataataatcagatacttgaatatgttttattatttatacataatattattcaaatattaatcagagaaccacctgaaagtgattatctactttctcaacataactttttcccactataaacattcattgttatgcagaatatataaagaacttctgaaatccaacgaaaaacaaatgatctgattgaaaagtgtgtaaagaacttgaatcaatagtttttcaaagaagatatacaaataatcaataaacacacagaaagatggtgaacatcactaatcattggggaaataaaaatgaaagctacaataataaaccacctcacattcattaggatggctactagacaaaaaacctaaaaaatagcaagtgttggcgaggatgtggagaaattgaaacactacaatgttggttggaaagtaaggtggtgcagcccaaaatttcagttacacaaaagaaacaagttcaagagattaattttacatcccagtaactatagttaataacaatatattgtacacttgaaaattgctaagagagtagattttaagtgttgtctgtacaagaagtgaggtaatacatatgttagttggcttgatttaaccattctacaatgcatacacatatcaaatatcatgttttacaaaagaaatatatacaatttttattaataaattgaaagtttaaaataaaatcatatggaaattgtggaaaacaaatgtttcctcaaaaattaaaaacagtattaccacgtgattcagccattttacttctgagtatatactcaaaagacttgaaagcagtctctggaagaggtacttacatacccatgttcctggcagcatcattcacaatagctaaaacttggaagcaaattaagcatccatccatggataaatcaataaacaaaatgtagtatatacacaaaaggaatattattcagccttgaaaaagaaggaaattctgacacatgctacaacatggatcaacagtgaggctggtatgctaagttaaataagccactcatgaaaaaacaaatatggcatgattatacttgaaactgacccaatacttccatatattttttaataaacatagatgtgtactcttctgatctgaaagtttgaaatttaccaaatgatcttcaggcctctcaaagtatcaaaaaactcaccatatcaccacatccagacaatgagatgcaggatccctcattcattatgcttgcttccttgcccctctgtaattcctgtttcttgcacattattgcatttcttccctgctatataaacccctagttttagtcagtgagggagataaatttgagacagctcccatctcctcggcagtatcacctgattaaagccttcttccttggcaatattcatcgtctcagtgattgagtttgtgtggcaaacagcaggacctagaccaaatccctggtgttttggtaacacacttatatggggtacttaaagtagtcaaaatcattgacaaagtaggttgttaccaaggacttggggagggagtaatggggagttattgattaatggtatagagttttagttttacaagatgaatacagttctggaaatggatagtggtaatggctgcacaactgtatgaatatacttaataccactgaactgtacactcagatatgtttacatctgttcctcttgcttcacttgtccttatcgtatttgctacaaggcattaggatcaattatcccccacaagtatggaaagtcttttctctgttcaaacgttcatcagcatgaagggtccaaaaatggccagaggacaatctgagcttccaattagtcagaacaatagttgagtttcgttgtcaaagcgttcaacttctggtcctagaacccaaatgtcacccagctgaaggtcacagacaagaaagccaaaattattcacgaagatcattaagtaagataggaagagagatcactttcatcttcacttcaagttgcccaggctctgttatgtcatgccatctcctgcatagctattcaggagagggcatgccttcgtgacctctaatttaaagcatacgccacatactgtaagagaatgaccaaacctcatagaagttcatcttctactagccgttatctgagaattaagaattctatcccaccatcttcttctgctagctgcttctgaatggtaggcattgtagtaacattattggattaagctgtggtgtgagctctttgctatgatccttcaccttaaaataaaataaatcaccttgttggaaatgaggttgtatgtccaccagataatgatcaaaagcattggaaagacgttctctgagcacatgaatgttgtttcaggtagaaggtctacagacaacacaaatccatactgaatcatatttatccatataaggaccctcctccatgataaaagtgggtttaatgccactggtcagtgagctggttccctgaggaatgataccataatagggattcagatttgggttctattactggcacattgagtatcagcaacagaagtaaccagattagccttagtaatgctatcttcttgagcccacatattaatcccatttaggtcactatgagcactttacacacagggtcatttatttatccctattgagaccaggaagcccattctgttacagcgtccctcactgacatccctaatctacagaggaaaaaaaaacaaaacaaaacaaaaaaaaactgtagggctcttcaaggaagccagatgcccttttaccaatatacttgttaaatcttgctgaagtgcatgtcctctggttatcttagaagtgtatagataaaggctggtttatcagattacacatgaagataaattcattgcacatttccatcactctgaacttttaaactcctctaaaatagggcttctcaattttaatgtgcccatgaatcacctagagatcttgttagaattataacttatgatttagtagatatagagtaggagggtagagccgtctagttgatgctgcttgtctgtgtgtctcactttatgaaagcaggctttatcacaatgtttctaaagtgtggtcccctgacataagtatcatcttcacacgagaacttgttcgaaatccgtatttgcggctccatcccaaactattgcattagaaactcagagatcccatttcagcaatctgtgtttaaatagccatccatgaggctgggaatggtggctcacgcctgtaatcccagcactttgggaggccgaggcgggtggatcacttgaagtcaggagttcaaaaccagcctggcaaacatggtgaaacaccatctctaataaaaatacaaaaaaaaaaaaaaaaaattaaccaggcatggtggtgggcgcctgtaatcccagctacttgggaggctaagggaagaaaatctctggagcccaggaggcagaggttgcagatcgtgccattgcactccagcctgggcgacagagtgagactccgtcttaaaataaaataaaataaaatagccatccatatcattctgatgcttgttgaaatttgagaaccttgttttataatgtgctgtaaaagttcagacattttgacttcattaactataagctattattgagacttggtttcagttagccaatctagcagactattaacgccacttttcattgtggtagccaaaacatcacaccctgaattcagggtgaatgcattcatgcaaaagaattcagcttcagcaagttttgtattttgttgtccattgtctaacgtctttagaattcactcccatgcatgatttctagctccctgccaatagtgacaatgacctataccttttgttttgttttgttttgttttgttttgagacagtctcgttctgtcgcccaggctggagtgcagtggtgcgatctcggctccctgcaacctctgcctctggggttcacgccattcttctgcctcagcctcctgaggagctgggactacagctgcccaccaccacgcccggctaatttttttgtatgtttttagtagagacagggtttcaccatgttagccaggatgatctctatctcctgacctcgtggtccacccacctcggactcccaaagtgctgggattacaggcgtgagccaccgtgcccagccaacctatacctgttttgtagtataggctatcttgttttaaaaaagatcttatattcctgtcttgactaaaagctaacatttcttatggccctagaatcaatgagagatggtataagtgggtcatgaaaagaattgacattagctcttgaggaaactgtccaaatatagttactgtaaggctattaggcagaagaggactagagaaagtgagagggtctatgttcactagccagaaagttcatgaaattgagatattcaatgttttcaccattatcattttcccatctcatgtctcaatgtcccttttcttccccagtgccaattttcagtgccttttctataggttaagaggatcaaaagggttgagagttccaagtatgttgcatctctgcaacacttataatcataaaaagatgggctccttcaaagctgccctgatgaccttctgtttccccatgtgctcttattgcattttatacctgttagtttacattttccctatatacattctcaagtatatagagaatatacacttggttgtcatgagaaaccaaatgtaataataattacaactattgctacagtgagtaattgctgcagccacttgatcatccaatactctatacctgcactcatcccatgccaccacaggtgtcatttgagtaattgtgatgccacacctggcaaaaattagccacatgctatgtgaatctcccacctccacgaaaggagtttatgcatggatccttaatatgcacactccaatccaagaatctcattttgagttattttttttttcttagagacaagtcaagcaccaattactataatacttggtgtaccagcaagaaaatgtcaccctcaaatttagataaaccaatgtgtttttagtaaaggaaagcttaagagaggtgtgagtagggtataggggaactataagaggtaatgtcatacactgacaaacaaggaatacagaagaaaaatttcatcaggaaaaaaaaaaaacaacataatctaatggggaaatgtcatataacatgagccatgtttagaaaagaaggcagccagcttggagagaacctatgcaacacatacctggctattatttacctctttcccttcatattctcctttctttgcccatttgtggaagccaactgaatgtcagatggctcaggagccttctgatgcaatccatgcatctctgagaaggtgaagagtggatgtaaaaggcaaacagatgtatctgcacattacctcctcaaggcattgtcttctgaattggtcttgtcaagagaatctcaatcaacaatgggatatagattcgggagaaattgagaggaaatttatgagttaaagcttaagtgattggcttaggaaagcaagtgccatatagtgtgaggcataataacactgtggtactggacattgtttagttgtagtttcctttatgtgtctgtataaaatcaacttttagttatataatttgctctatagtacaggtactttgtttcaatctctctctttccactataagaattgcatacacatttgaaagctagtttaatttaaaaaaaagtactaatttggccgggcatggcggcttacacctgtaatcacaacactttgggaggctgaggcaggtggatctcctgaggccaggagttcaaggtcagtctggtcaacatggcgaaacccatctgtacttaaaatacaaaaaaatttggtaggcatggtggtgggcgcctgtgatcccagctacttgggaggctgaggcagaaaaatcacttgaacccaggaggactatgttgcagtcaggctagattgtgccactgcactccagcctggcttgggtgacagagtgaggctgtctcaaaaaaaaaaaaaaaaaaaaaaaaagaaatgtattaatttattagcttttattgtgagtaatgaaagattatacttctgtccttagatcatattgatagtatttataacgttacataattctatattttgctccaaaaaaaaatctgtggccaggcacgctggctcatgcttgtaatcccagcactttgggaggctgaggtgggaggatcacttaaggtcaggagtttgagaccagcctggccaacatagtgaaaccctgtctctactaaaaatacaaaaattagctgggcatggtggtgcgttcctgtagtctcagatactcgagagtctgaggcagaaaaatcgcttgaaccctggaagtggaggttgtagtgagccgtgattatgccactgaactccagtctgggcgacagagcaagactcaggctcaaaaaaaaaaaaaaaaaaaattgcattgctgcaacatgagaaagctgctcctctagtcagagtatggctaagggaagtacatcataacttttaatcactgatatgtgattaaaattttaaagttttgataacattttaattaatgatttaagatgtttggctaatttccatctgaatttagattcaagcactttgcaagcctgttttaatctctatgcttaaaaaatctacatattaataaaatcagccttactacatacaagctgtcaacaaactctgttctaaacacagtggtggtatgaagtcaagtacctttctagctaatggtagtcagcttacacagttgttcaatggggcaacacaatcatatctccaactgttacagagattgaaatgattatcatctgaactactgcacttgtggcaaagttttctttctcaagaaggtttttggtaaaatacagatctatcaacaggagataccattacatttttagcacttaccatatcatttgcagagggatagactcagaatatgatagttgccatgaaaaatagtgaacagtaaaaactgaactaaatggaatatagaacacaagtattggaatgggaggcaaacgttaagaggaagagatatgggaaaatatatcaactcattattcaagcttatttaagcttcatttacatcacaaaaagtttccattcacaaccttttcaaataaaactgaaaggtttccatgatattttaaaaatataatctgtattttatcttaacaagaacttggaacaatattctatccaccattcctgatccaaacaagtgcccaatcttcatctatcttgcctcatattttcagtataaagagcccattcactttttagggaaaaaagacacaaataacacaatggcacaattgttaagtttctcattatatacaaccctatagctaataatgcacatgtcatttccatttctaggttgactaattttgatgggcagaagtgctctaaagtatgcttttataaacctcatatcacgtggtactccatggctgaaacatggcttaatgcatgttttaggatggtgaaggaaggagagaagggaaaaagaaaagacgaagaaaagaagaaagaaaaaggaaggtgaaggaaagaaagagagatgaagaaagaaaatgaaaatatgaccatgttataaagaaaattgaaaacatataattattttttcttaattttagcctgtgtagaaactcttaaggctgatgatgagatagatattttttgccataaattacatgaatctattcatttttacattcttattatatagcattagaatatgttgcattatatgtagactccttagaagatacacgtaaataaaattatcggggaacctgccccgatattcatgtaggttcttttctgtttttcctaagcatctgccagcttgagaagtaaagggacagagtacaaaagagaaaaattttaaacctgggcgtccaggggagacatcacatgtcggtacgttccgtgatgccccacaagccacaaaaaccagcaagtttttattagggagtttcaaaaggggagggagtgtgcgaataggtgtgggtcacagacatcaagtactttacaaggtaatagaatatcacaaggcaagtggaggcagggcaagatcacaggaccgcaggaccgaggtgaaattaaaattgctaatgaagtttcgggcaccattgtcattgataacatcttatcaggagacagggttttgagatcaactggtctgaccaaaatttattaggcaggaatttcctcttcctaataagcctgggagcgctatggaagactggggtctatttcatccctgcagcctcaaccctaagaggcaggcgcacctgggggcgctgtttataagcctatacctccaggtgggtattctctttcccaggaatgtttcatgctgagaaaaagaattcagtgatatttctcccatttgcttttgaaagaagagaaatatggctctgttctgcccagctcaccggtggtcagagtttaaggttatctctcttattccccgaacaattgctgttatcctgttcttttttcgaggtgcccacatttcatattgctcaaacacacatgctgtacaatttgtgcagttaatgcaattattacagggtcctgaggctgtaattacatcctcctcagctgacaggattaagagattaaagtaaagacaggcataggaaatcacaagggtattcattggggaagtgataagtgtccatgaaatctttacaatttatgtttagagactgcagtaaagacaggcataagaaattataaaagtattaatttggggaactaataaatgtccatgaaatcttcacaatctacgttcttctgccatggcttcagcaggtccctccgtttggggtccctgacttcccgcaacataaaataaaaaaaaaaaaagatgctttcaacttagtgactattattcctgtctatctctatgtgcatgtattacacacacacacacacacacccacattaagaacccactaaatattgttaagttcttggaaaatatgaccttaagtgaaatgacatacaataggtccttgaataacatagtcatttagatataattataatacgcaaaaaatggattttgttatgcatcgttttgattaaagtcacagtttccaagaacctactgatgacattaagtttatacacacacaaacatgcacacacacaaacacacacacacacctacacacacaaaggtagttatacacaatatactgactgccttataagaatgttttttctatcttgtaataatacatgagtaccacatttttcaatgcatttaatcatgctgtatctgagaatgtgacttattaagtcccataaatatatctaatacattttagagtataaatgttcaatgtattattgtagatataatatgaaactgtgcatgggagtggagtgaggaataattgaagaaaaggctcttgctgaaccaatttacctatgggagatcagaatatgccaccccaatttaggatggtttggcataaggtttgttgagctgaaggcaattaagaagcagatgaagaaaagctctctgcctctatttacctaaaaggacgatatacatttacaaagacaaaaaatatcccccttcccctctaaaccggggaggacaaatgttatccactgaagagaactttagactgttatgggcctggagatggcaccagaggaatctacattaacaagctttacttagcctttatctgccttttctttgccttgcctcaagttgctgtctttagaaattcaaaatccttttcctttgtcatgtcgcttccctaaaactttactgttctttgttgaacaatgcgttatataagctgaaattcaaactcacctccttggcggctactcattcccttgctgtcttccatgtatatatgaaatacacgtcaataaacttctctggcttttctcttgttaatctctcttttggtccatgggtccattccaactaatactttatcagaattgaggaaaaaaatattattcctcttccaaatagctatttagtattttctggctgacagagcaagtgtcttgacagagaactcacatttcattctctttccaacactcttcttttgatacactttaattataatccttaaaaatcagtctctgtgttagaagttgacatgatatatgaaggaaaagggccactttttaattctggaagttaatgcaataacataaagtagaaaaatagcatattttgaaatatatttcatgtcaaacacagacatatccttctaaaatgcagcatcaggaaatacttaggcataataacaaaagttcaaactatgatttcaaaacagagaatttgacaattcaagtatggatatgataagcctttattctgatttttttccaaatattccgacagtggaaaatgttcaaacaaaatttgaaggaggaggactgtgtactatcttattttccctcaatatttttcttatatactttaaagtaattttattctgcaatattgtgtcgaactatgaatttctcaaccattgtttctgaattgcaataaagtcaaaccgagcaagatggctttaatattgccctcatcttgacgaaactttaaacacttttcttcctgactgcatgtcctgacctttattttcttagagtgtttacttcagaaaattttccattgtaaattcttcctatgactctttgagatgtaaatagtctcccagccacttgtgagttttataacccagggatgtcttaaaaaacttggagacatccctttgaaatattgttatccagaaagatattttcccagtctcccagtttgtatggataataggagcctaaattccataagcaacaattaaacaattaaatgtggtccaaactcagggaacaaccttcccttcacttcctccaatgcttttccactaaaattttcttgcattgtgtttcaaaagaactgagttcaatttctatccactattgcaatagccttgaataaagtcttgcctgtttaactctatctggtataatttttcttcaagagaaccttaattagtcaagttctattttggcaatgggattcatattggaacttaattttatattataaaaatggataaataatcacaaacataaaatatgaatatatgtttccaacaacattgtgtgcatcaaaccaggcactaaatggcaaaggtataaataatcataataacaacttttgtggtgatagagttttttctagatgcactagatatgctgatattcttaaaataaaaattcttacatattagccaaaagatacttctgccagacaaatgttttattcattattacaaggattctagaccttttaaaattaagatattctgtttcaaagtcaatgtacaaattcccctaagttcttaaaaaataggggcaggtttcatggtgacctgttcaaagatctattgctgagatagattttagtaaatcaatttggttcactatcccagttggtcacaaatatgagtttttgttattacttcaattatcttattcattgcttactcaaaataccttttaagtcttatcccatgcagagatcagatggtaaggtttttaaagtaactatatgactatcagacttatttccatgtaacttgctttatttttgcctgtctttaagattttattacataaaaagtaataaaaattaattttaatgtattcctaaaatttcaaaatcttgcttgtttaaaaaaaaattagtcttaattaaaaaaacactatggaagaaaataagcctttaagtgatctatattatcctaatgatgttgttatgttacttaaatcaaaatttgtgaaaaaaataggttcacacttctgaatctcaaataaactttatagatcaaaaattaccaccaaaggtgctcagaaacaatgactaaaatttccatctctagcaattttttatataacaaaattgtcctaacaatactagctaataaattagagtttggttacaaaatgaaccatgataaaatctatcacagcaggaaaattttagaaaaggtcaagaccacttatgtgatcttaccttcaattttagaccaaggaaagtttgtaagtgaaatttaacccttcaaaaatgccccccaacatagtatcttattcttgtgcaacctggaaaaacaaaaaaaactgatattagaacctaggttattttatttgctgctggattatttgcttatttgttgttttaaatcagaaaaaaaaccccaaatattctggtagcctagaaataatcaatagccttgcagacaaccaagtatccgggttgccttatgaactaagcataggatagaattaaactagacactgctaaaatgaatggacaatttttagtggtatgtatacaaaccttaaagttcaaataatgtaaatggccgacatcaaacatattttctaaactatagaattttacaccaaacagtatgttctgccacagtaaactgtctctggctttcttaaaagtgatttattttatactgcaaattattctgtcatgtccacttggcatatatgtgttcctttctgattttctcaacaactctctcttagaaggaaagcattttctttttagaaaccattttgaatacataatcacatacatgtaacagaacatttaaaaagaaactgtttcagccaaaactatgctacctactctcagtgaagagagttgcagacaacttttgtaggacatggaaaagaagccactgaagttcagtgtgtaacatttatatgattaaatataatataaatataaataatataatgattaaagatgggaggctcaggtagcttggacactgaggatttgggaggaaagcaatattacagtgtgataattgcaagttatcaacaaagagtcatcagacttcttgcatttctccataagcttgatgacaagaacatcaggtgggtttctctgaaaagaactaaatttacagaagttagagaatttagagaaattagttgaagggtgtctgactttcacttgacaattttaaagggtgaaagtctaaatgaagaacttttgcagattaatggtctgcggttaggaaataactgtattccaactagagatgagtctcaagtgagtatttcccaccagcaaatgtgggccatgcaagagagtagacaagaaggagatgatctcaagcccagcccaagagaatcaccatgaggaatgaggagacctcagcagtaagacgctgggctgtgcagccacatccgcgggaacagcaaaagttagtgaccagaagacaaattctccagccatcccaggaattgccagaaacagctatccaaatttggaggtctccaaagaatctgcctacgtggttcacaatctcaggagttgccaaaatcagacctagagagtacagcaatgcaccctttcttttctttttacctctaatgctttttccagggtcaaacctggaggagatgaaaatcagtatttagtaagttgaagaaacagagatgaataaggcagagagagagcaaggttgttgacacccaggttctaaggcagctgggatgcctacaaaaggatatccaagcggaaaaaaattgaagtagatttctagccaaacttagaagtcctctgtgtctaatgtatttcagagtaggagataaagtatttgttggattagcacattagcaaaattatctagagaaaggaatacatgtgtaatgtccaataaaagccagtgattctccaattgaacataaaatggactaagttgataagaaatgtggggctctttcaacaaatagtttaaaatcaaaatcatgaaggtggataaaatatttctttacccccagaaaataaacggataaagctacttctactatctttgttatttttcactctactagccctaattatttcattactaacttatcatcaattgaaagttataaaatgcatgtttccatcatgatactatgtcatatatattttaaaagatggttataaaagtcatctgtcattattaaattaaattttgagtcaatatatatttgtattgggctatgaatatgcataagaaattaatattctgaataatatgtactctttcagtgccctggaaaagacaataggagcctgatacaatttgtcattcttgcacagtgacagttaatcgaaaattattaattcattatcaaagtatcatttccatgacaaagacgagaggaaaacatgcagactgtgtccagatttcttccagatatctaccagcaaaatatcaccaaaattaaacaatgaaagatagacgaaaagagaaaaaagccagagggagaggagagagaaagagagagaatgattatgttttacataaaaaacagtaaattgaattccttacttgatttttataggtattgttcatctagtttgtagtaaagggaacatagctatagacaggaaactgtcattgttgagaatttggagcttaaaagtattcagtaattttaaatgcaggacatgtattttcgaaaccattcataattaagaaattaaaaagattttagtaacatttgtgaaaaacagaaagaaaattatttaaaagtctttgctcttcagagatagtgcctggctcttgtagattcctttcacctctacactatgctaaaacctggctttgtctaaaaacaactttagctatagatggtcactttctgtaaaggcttttctttgttattgtcatagcattacagaatattgatgacttcaatatcacctacacagaaaaactgtatatgacttttggaaaaaaaatgagagatttagggcaagcaaagttatgctgttgtagattcaaaaaaaaaattgacattttaggttaagtatattttcaatgtttcaattataactgtaaatctataaatgctggtagaggtaacctcattagaaataactccttattctaagagcaaagagaaacctgaaatgctaaaatggatactcattcttaataggatcaagaaacaccaaatacccgtcaaatatccgaagattatattcaatgactctgaacaaggaaaaaagcaaaaaattaagtgaaacatgaatgaaagaaattacagaaatctaaacaaaggtataatctatattaatggattgtaaaactcagtagcttaaggatgctaaaatctcctcatgtaatgtcaataaaaatttcatcaattttgaataaattgaagaattaagtctaaaacatatacaattcaaattacaaagtatatgcccataatttatgactttactgcttaattctaccagcatataaagaagaacacatcttaaacaaactattacaaaaaataataggaaacacatactattttggtttttgatgctagcataaccctgataacaaacctgacaaaaatacatcaaagaataaaaagtacacatgaatatcctcattaacacagatacaaaaatacttaatgaatttatttagaaaataaatcaaatccagcaatctataaaataatgcattatgaccaagttggttttaccaagaatgcatggttggtttaatgtataaaatacataaaatcttattaacagagtgagggaaaaaaacataactcaaacaacacagaaaattcatgtatcaaaagtaaacgtgttcaagataaaaaatattaagcaaattaggaatagaaagtaacttcctcaatctgataagcaaaatatttacattaaagaaaacagaactaaattaaagctgacgggaagaagaaggcaagattatacaatcttataatttctattcatcatggtagttggaattcctagccactgaaataaagcaaggatcaatgacatatattaacaacaaagaagaactatgctcctatttagaaacagcatgatcgtttatgtataaaatattaaatacagataggccaccttttattgctttctttattagtttattgaactccataaatacggcatttttttaaaagtttgaagatttgtggcagtccttcaaataaatagcaaatttattagccattttttccatgtgctcacatcatgtctgtgtgtcacagtttggtaattcatgcaatatttcaaattttttcattgttatatctgttatgattatctgtaatcagtggtttttactattaattactattataattattttgggatgccgcaaaccattcccacattacattgaacttaattcatgaaatgttttgtgtgttctgattgctccacctactggccattctcccatctttctccatctcttcaggcctctgtattccttaagacacaacaatattaaaattagaccaattaataaccctacaatggcttctaagggttcaagtgaaagagttgcacatctctcaccttaaatcaaaaactagaaattattgagcttaatgaggaaggcatgttgtaaccaagataggctgaacgctagacatcgtgcatccaacagttagccaagctatgaattcaaagaaaaacttcttaagggaaactaaaagtgctattctagtgaatgcacaaatgataagaaagccaaaaaaccttattggtgataagtagaaagtttgagtgatctgaatagaagatcaaacaagacacaatattttcttaagccaaaacaaaatccagagcaaggacctagctctctacatagctatgaaggctgagagaggtgaggaagccacagaagaaaaattggaatcttgtagatgttggttcataaggcttaaggaaataagccatctccataacacaaaagtacaaggtaaagcagcaaccacatgattacatcaatagatgcaggaaaggctttcgataaaattcaacacacattcatgtcaaaaactctcaaaaaagttaggtattgaaggaatagaccttgaactaataagagccatatatgaaaaactcacagccaacattatactgaattggcaaaagctggagtatttcccttgaaaaccggcacaggacaaagataccccctatcaccactcctattcaacatagtattggaagttctggccagagcactcaggcaagggaaagaaaaaggggcatccaaataggaagagaggaagtcaaactacccctgctagcacaagacatgaacttatattcagaaaccctcaaaatctaggcccataagatccttaaattgataaacaacttcagcaagtctcaggatacaaaatcaacgtacaaaaatcactagcactcctggacaccaataacattcaaggatccaaatcaggaaatcaatcccattcataactgccacacactcacacacacacacacaaacacacacacaaacacacacacacctagaaatataattaaacaggaaggtgaaagatctctaccaaagaactacaaaacactacttaaagaaatcagagatgatacaaacaaatggaaaacattccatgctagtgaatagaaagtattatttttgctaaaatacctataatatccaaagtaattcatagattcaatgttatttctattaaactaccaatgacattcttcacagaactagaaaaggctattttaatattcatattataaatattcatatttattaatgataaaatattctattttaatattaatattcaggccccaaaaaaggacctgaatagccaaggcattcctaagcaaaaaatacagagctggaagcatctggctacccaacttcaaattatactacagggctacagtaaccaaaacagcatggtactggtacaaaaacatgcacatagaccaatggaatagaacagagaacccagaaacaaggtcacatgcctccaactatctgatctttgacaaagctgacaaaaacaatcaatggggaaaggactccctatttagtaaatgtgtagggagaactgacaagccatatgcagaagattaaaactagaccccttccttataccatatacaaaaatgaactcaagatgcattaaagacttaaatgtaaaaccaaaaactataaaaacccatttctctggacacaggaacaggcaaagatggcatgaccaagatgccaaaagcaactgcaacaaaagtagaatttgacaaacgggatctaattaagctaaacaggttctgtacaacaaaagaaaccatcaacagagtgaacagacaaacctacagaatgggagaaaattcttacaaactatgcatttgacaaaggtctaatattcagcaactaaaaggaatttaagcaaatttttaaggaaaaaaaccattaaaaagtgggcaaaggacatgaatagacacttttcaaaacaaaacatacatatgagcaacaagcgtatggaaaaaaatctcaacatccctaatcattagagaaatccaagtcaaaaccacaataagataccatctcgcaccagtcaaaatggctattattacaattaaaaaagtcaaaaaatagcagatgccagtgaggttgcagaaaaaaagcaatgcttatacactgctggtgggagtggaaattagtccaaccactgtggaagagagtgtggtgattcctcacggacctgagaacagaaataccatccgaccctgcaatcccattactgagtttatacctgagggaataaaaattgctctatcacaaagatacatgcatgtaaatgttcattgtgtcactattcacagtagcaaagacatggaatcaacttaaatgcccatcaatggttgaatggataaagaaaatgtggtacataaaccaaacttggaatgcggtacattccatgtgtaccacatggaatactatgcagccatataaaggatgagatcatgtcttttgcacgaacatggatagagctggaggtagttatccttggcaaacaaatgcaggaacagaaaaccaaatactgtatgttctcacttataagtgggatattaatgatgataacatgtggacacatagaggggaacaaaacacactgaggcctattgaagggtggagggtgggaggagggtgaggatcaggaagaataactagtaggtactaggcttaatgtctgagtgatgaaataatctgtacaaccaacccccatgacacaagtttacctacataacaaacatggacatgtactcctgaacataaaataaaagttaaattaaaaaaaaaaactaaaaattacatgcaatatttgtagtggtacaaatatatttatgtaactgtaaaaaagagagatgtataagaatatatacaaaatgtaataatggttacttccaaacaatacatgaaggctagaagttgaggtgttttttttttaatctgtaaggttttaattcttttaaaaaagaaaaagtattagtgtattgtttcacaatttttaaaaaatgtacaagaatgttcttatttctaccatattggtctgcttctttgtattttttctggcccaacccaaatcagtcttttcaaagtttatctacattggttagagatggagccttatagaacattgaattaaaggcagacatccaaacagttattgtatggaacagatctgcgtactaaatatgaatgtgtgtattgtgtgtgggcttatagtattaacaatacacattatgtctttttgttttttatgtgtattgtctgtgtacctgtgaatttcagtattcgtgagctatgcattaatgtataccacagttaaataaatgaattagttgcagaaaaaggaagatcaaagttggaaggctttatctatctgattttaagatgtactaaaaagccacagaaataaataaataaatgaataaataaataaataaatggactagaataggtaggaattagtcaactttatccttaagggccagatattaaatatttcaggccttgtgggacacatatgaggtgtctgtcactttttgcccctcttcctcctcctttctcctcttctgcctctttttctacctcttattttgacaatactttaaagatgccaaaattgttattagattgtgagccacataaaaacagcccaggagtcataatttggcaatttttggaacaaaggcaaaaaacagaaccgcagtagcctttccactaacacttcacaggaatttgatggatcaggaaaaacctttgtaacacatgatgctaggacaactgggtatccatatgaaaaacaaaagttaaccttaacccctacctcctaacaaacacgaaattaatcaaagaaggagcaaacgtaagagtaaaaggccaaactacaaagtatttagaagaaaacaggggattatcttcataacctgctatgaaacaacacagtaagaaacaaccataaaagacaactttaatatattagagtttcttaaaaatttaaaacttttattcttcaaaagatacctctacattaattataaactggaagaaaaatatttgcagaacttgtgtctaacaaacacttgtatgccaaatacacaaaactctatgacaactcaataacataaggacaaattttaaagtggacaaaacacttgaaagaaacttcctgaaggaatgtgcatgaataagtaataattacatgaagtgctcaatatccactgataaaaatttcttaaataggcaaaatgaatctatagtgatagaaaacaaatcagtggttgcttggggaaaaggatggagaaaattgattggaaaagagtacctgggaactctttagagtatttaaatgttttataccttgtcagagtggcagttacatgtgtgtatatacttttcaaagctgtatagttaacgttggtatatttcattgatttcaatgtaggtaaatctaacctcaaatatccataaatataataatcatatggaaggtcacttccaaattggtggaggaatagttgaaaaaatagtctaatattatcattttttaatctggataatggctccaggatagtttgttatggcattcaatttattctgtatatgactgaaattttaaaactcttaagctaaaaagcatttgtcacatgtttttgctgaaatattggttccttgtaatttctcacttaattcaagcagacatctaaaggtgatttattttccacccagaaaactaagagtacaaggattcacttgtgtccacaagggaatcaagtgatccaggagaacgtgcttcactattttttgcttttcctgacccttaaacagcttctaattcctcttgctaaaaaaggaaaagggatggctgggcgtggtggctcccacctataatcccagcactttgggaggataaggcgggtggatcacttgaggtcaggagttccagaccagcctggccaatatggcaatacctcgtctctactaaaaatatacaaattagtcggggtggtggctcactctcgtaatcccagctactagggtggctgaggcatgagaatcacttgaacccgggaggtggaggttgcagtgagtggagatcatgtccctgaactccagcctgggtgacagaatgagactctgtcaaaaaaaaaaaaaaaaaaggaaaaggaagcaaagaaaatagaaaagttacttcctctaaggtaaccctaggagttttcttcactatatttaggaacataattagctgtttttttaaaaaaaaaaaattgatgcatgcttgctttctctctatatagaactatattttgcagaagtgttaatgatgttttgaaggtgacaatgttatcccacaacatataatttcctctcttaaaagtactatctttgaaatgggctcacataatatgtaaatatatggggataaatgtatagtctcattacaaactataagaattattccatatatgtaaaatatgaactactataattgggtgtaaaaccaaggttgtaaatttaattttaataatttgcctataatatttatcagtccaaagtgatttgaaaagaaaatctattaacatgttttacaatattcttacattatttctatcattatgtatgagacaaatcatgatgtgacagcatgtgacaagtgtagcagatgctgtggatcagcttacacaaaacttattccaactacctcctttgcacatgtttctgaaccgcataactgagaagctaaaattatacttaaaggattcaattgcagctatgattctatgtatgattggggttactctgacaagattattttttatataagacattgttcagaatgtactatgaaggggacaggtgttacactttttgcagttacaaatcggggtggaagtgctgtggttctggtgttagctgtggttctgtagttggcaatgttggcatcagctttctggaaccaggcatctggatcatgggaaaggcagcatttcctaggtgatatggcttggctatgtccccactaaaatctcatctcaaattgtagctcccataattccctcatgttgtgagagggacccagtgggagataattgaatcatgggggcagtttctcccacagtattctcatggtagtgaataagtctcatgagctctgatggttttataaggggaaacccctttcacctggctctcattgccttgtctgccaccatgtgagacatgtattttgcgttttgccatgattgtaaggcctccccagccaggtggacctgtgagcccattaaacttctttcttttgtaaatcgtccagtctcaggtatgtctttgtcagcagtgtgaaaatggccaaatatactatagcagatcagttatgttgtggttttgcatctcattcctggcaggtcaaaacagaatctatttcttccaccctttcaatcatatgtgaactatttatgccacttaataagtcccttcagcttgaagaagctagggtatattgttttttgtaactaatatccctaactgatattgcagacttcacataaaaacatcctgttgaagatgaggaactagaagattctttccccagggacatatgatattaaaaaaaagctacaggtagctggtctttactgtgtacattatcaacctcttacccaaaatactatagtggtattcactgctataactatttacagtatattcagctgttttcttacagtcttagcaaaaccatcttctcatctgttatgacttgcatgtaccccccaaattttgtgtattggaaactaaatgcccaaactcatatgttgatgatatttggaggtggggcctttggaggaggtaatcaagattagataaggtctttagagttagtcccccatgttgagactggtggctttagaagaaaagaaagatgtgagctgacttgggtgctcttgccctctcactatgtgctgccctctcaccatgtatgatacagcaataaaaccctcaccagatgccgatgccatactcttggacttccaagcctccagaaccataagaaatattttttttctttattaattacccagtccacagtattctgttacagcaacagaaaagcaattaagacaccatctcacacctggttttgtctataccttgtgagaacctcacaactgtaattcttctgtataacacatcaattaaaatagaatctagacaaaatgtcagtattaaaacaatcaggaaaacagggctgggttgataataaggccacaatatttgctgcctctgagaatttgggaagggatggatttgaagaagaagttttctgcttgcatatctagttcttattcatatgcacacaagcctaaggggaaaaattcaggctcatcgtccttttgattgcttaaaagcatgtagcagcttccaatttacctttcctaaagaacaagtcaggctgcagaaagatcatggttttgaattcagccatggcttttaatttatttcttttagactttgcttgactggaaagctctggaagctggggttcaaaggcaattgtgtttaaagaaaatacttagttgggaatattctaacagcaactgatgggtttaataattcttgtagatactatataaaattttgaatagctagtatttaggtaaataattgcaaagaaacactcttcttttggaataaattacatggagtcctgttgctgtctacttgcaaataatctcattcacgttttgatgaaactcacaatgtacacattttctgaggaaaatggaaacaggaggcctcctgaagatacaataagatgattatatttattttcaaacctttaaggaaagctcctgcaagttaggctaaaatgtaaattttagtgaggattctattagaagttccaaggcaacagttactttcaaaaatgatagacccactgtgagcaaaagagagaagataaggactctgaccgagctggcattgttgaataaggggccctgatttgctgctcaatagctgactctgcaggtttcaattataggaatagctggaataatactgctctacaatattactggtagaatttgcaaagaattgatatatagagtttaagtatgtgtctctgtatgtgtgtttgtgtgtgtgcatgtgcagcacacagacatgcattatgaaaagggagttattcaagtaaaaagcacctgccgctaccataacaggtatgatctaggctgacccatgatgcttgggtgggtggtgggacattaagaatagaacatttaactacaggcatgcttatattccagttatatataggcccactgcacctctaaattgttgcactagagtctttattttggctggatttaaaggccacttcccaaaatttgtgcagaatctttgtagttacataattaaaaattgaaagaatttaaaaaatgacaactgtagtctcactgactttttaaaataaaattaaaagaccagtataactgtaagcccttgttcagaaaaatgttaattccttacgatctagactcagaatgtggggtttgaatcacaattctatcagtcactagcaatgtgatcctgagaagattacttagtctctctgtcccacagtgcctggtttataaactgggaataatatttattttaaaggattaaatgataagctacagatatgtctttttgcagtgtgactagaaaatagtaaacacgtaataagtgctggttgctgctaccataatgatcagtgtatttctatattgtttatttctggatatcagtacttttgatataagactagacagtgaattcctcaattacaggggctatgtctccagtaaacaagaaaatgcctgtcacacagcactcacattaaaagcttagttgaattgatacaacttgtcagagagactaatactgagggcacgatggccttatcatcagcatatcctcattactttgactagattatttaatttattctcttttactccttcttacttctacttcagttaaaggcaactggggagtatagaaatttgaatatttagctttttggggctatgtccgtagtttattcactacttagggtgacctgtgcacatgctaaatgattaaagaaggcaaattctaggatggtaagtagagaaatgtgcattatagattgaaggcatgtgatgggcaaaagagcctgaggaactgacaatagatggaggaactgacaatagatggaggtcagtaaacaaactgaaaaacaaatgtaagggaaaacatctgataaaattaaaaaataaatatcttatttaaaaatatacatcttcttaaatatatatttatattttaatatatatttaaaattatatatatgttaagtaaaacagaagttactaaaggaacttccacctttgtatgtttgcttgaatattacatctttaaaatagcttttgcaagagatgtttcacaaaagaagttgatcttacaggtattgtagttttctctaaaatgcctaaagattaatactccgcaaagtatttcagtcaatttcaagttggggaatttggatgaccaagacatctctgttctctcaattcctcagaggacatacaccgaagttagttgtgatagtagttattatgcctattaagggtgagatccttccaggttctaacttctattgtcctcaaacacagcactctgaaattctagcattaatgactgttactggctacttacaacaagcaacttcacttggatctaccatccagtttccaagctaccaacattaccttgttgcattgtttttgttgctgttgtttctttttttgcgacagagtctcgctctgtagccagggtggagggcagtggcgtgaccccggctcactgcaatctccgcttccctggttcaagggattctcctgcctcagcctcctgagtagctgggattaaaggcatgagccaccacgcctggccattacattgtttatgtacaagctagatgataaggaccaggcaacacttgtgctatcatattgcatgtgtgcaaggctacacagcctgttgatgcacacaggagagactaagaaaggcagacctggccatggcctacctacttgcttactgaactttgtattccacgaaagaagggagcatgaacatatgtttagcaggaaacttaaagtctagcaaatttcctggcccatagtattgtattctagttgtttgttaaataaatgaatggtctgtatacaatatagcatctctctctctctcaacgaatagcaaaattttttaatagacaagtaacgaagggccttccaatttaatgataataatacatggttggctatctattacagctctttgtgattgttggtttgtgaatctgaaggcactatttctcaaagtgaagtccaggaaccacttgatcaaaggtcatctgagttgctgtttaaaatttcagattcctggggtcacttcctgcatctccacctctgacaacaatattcaggaaactatataatcaacagtctaccaaggtgattttatgtacactactatttcaaaaccttagtgctagctcattctctaggtgaacaaatgaaacaagtataaatatgataaaaagtaagagatctattgatcatatttctacatgaagagattttctatttcagaaattgaagtaatcagctttttaaaaaagcctttttgggaatcaatgtaagtttcataattcagccagctgaccaataaatattaaaaaatgtttaactttcttatatttcatcatttaaaaaaatgagaaattattccatagtctatgtctgtctgtatacattattcagctcccacttataagtgagaacatgcggtattagactttctgtttctgagttatttcacatacgataatggcctacaattgcaataatagacattggagacttagaagaatgggagggtgggaggagggtactggatgagagactgcttaatgggtacaatgtacactatttgggtgatgattacactggacatttggtaatcatcacccaaatcattacccaaatagtgtacgttgtacccataaagcaatctctcagcctctcactactacacaatatatacatatgacaaaacaacacttgtaccccttaaatttacacaaataaaacactacaaaagaaaattgaagaatgatcctatttataatagtgacatgaactaatttgaaaccatgtactcataggagatataagaagaaacaataacatgtcctagaaggccaaaaactgaagacttgaatcaaatgaaagacatatcattatcttgaatgagaagattgaatattacaaacgtgttcatttactcgaatctacaaacttaacattaatctacaaaattaacataattccaatcaaacatttttggagggttttggacctggcatgtttacatgacggaataaatgtgaataatcaccaggtaactctataaaaagaaagttattaagacagagttctcctataatgaatgacaaacataatattgggctacagaacagaagtaggtatacaaatatggaagaatatattacatttattttgaaattaaatttttgataaagttagaattttcagtcagtgaatacttgatactttatttaaaacacagttgtcaactttttactatacgtcaggctatatgaaaatattaactgatttaagtctctttacaatcttacaaagacttacaagttaaaaattttaaatttataattttagatacatgccattatcagcattatataacacatgagaaaacgaagcccagagagtttatgtcacttgctgaaagcaacagcaatagtaagtagtagagccaggttgtctgaatgttctttaataccatgatataagatttaggctggcacttgaagaaaaagaattaaaatcatactagagttcttattttaaaagcagattaaaaatagaattttatttcatttaaatgaacaacataaaaccaggaacgtattagaaaaaaaattggtaagtatttgcatcaattgatgtggtaaaacgtgaaatgtgatatcaagttacataaaggaaaaatattcaaccagaaataccatttcacatagaaatgtttaaaatgtttcatatttcacatagaaatatttaaaatctatacctctaaagtatttatgaaaaaattcaaaatatgataagaaagtacattgtggtatatgtttaaattgtggtaatatgtttgtttttttcctattgtcacagcttaattattgataaggtctttatccacaaaaggggttcaaactgtgcaatacatttttgtcacactaattacaaaggttagtattactatgaaacaaaagtttcaagatcaattaaaaaatatggatgttccaagaaaaattgaagaaatttttaaaaatagtcaatagtttaaaaaaatcagacagagaaggaggtaataaaaagagagaagtactaaagtaagtaacaagagaagaaaaaaaggtagaaagaagaaaataaatattccatgttgtcaagaaggcaggagattctcaaattttagcaatgggattatttgaaagtaatttagaaaatagttaagtatttatgcaaaattattttaaataatattcacagatgtgatatatgtgaaaagaaaatagttgaacataatcaaaaaaattcaaagattataaaatgtattattacaatctatataccacatattatattggccactagggatgatataaaggtaaatttagtgtgacagacaaacaatgaaaatattagaaatggtagaaaggtgactttattgacataaacaaaaatgacaaaatgagaaataaaatgggaaatgttgtatgatctcgattgggtaaaagacaatttatctacatgtgattttcccatacaaatcatttgatccaaatggtatttccaatgacaactgaaaatataaagtgaatttaaggaggtgaataggtataatattttttaaaaaatcgacttttttattttttaaagacaggttctcacttggatgcccaggctggagtgcagtagtgtgatcacagctcactacagcattgacctccctggcgcaggtgattctcccacctcagcctccagagtagctgggactacaggcacatgccaccatgccaagctaaatatatatatacacataaaatttttaaaatttttactttaagttctgggatacatgtgcaaaacgtgcaggtttgttacagaagtatacgtgtgccatggtggtttgctgcacctattgacccgtcctttaagttgcctctcctagctccccaccccccaaaaggccctgatgtgtgttgttcccatccctgtgtccacgtgttctcattgttcaacccccacttatgagtgagaacatgcagtgtttggttttctgttcctgtgttagtttgttgggcatgatatcttcgagcttcatccatgtccctgcaaaggacatgatctcattcttttttatggctgtgtagtattccttggtgtatatgtaccacattttcattagccagtctatcactgatagacatttgggtttgttccatgactttgctattgtaaatagtgctgcaataaacatacatgtgcatttgtctttatagtagaatgatttatattcctttgggtatatacctagtaatgatattgttgggtcaaatggtatttctggttctagatccttgatgaatcaccatactgtcttccacaatggctgaactaatttacattcctagcagcagtgtaaaagtgtgcctatttctctacagtctcacaggcacctattgtttctgactttttaatagtcgctattctgactggcatgagatggtatctcactgtggtcttgatttgcacttctctaatgatccctgatgttgagcattttttcatgtttgttggccatgtagatgtcatcttttgagaagtgtctgttcatatcctttgcccactttttgatggggttgtttttttcttgtaaatttgtttaagctccttgtgacttctgcatgttaagcctttggcagatgggagactgcaaaaattttctcccattaatatgtttttgtagagatggggtttcaccatgtttcccaggctggtctggaattcctgggctcaagtgatccacgcaccttagtctcccaaggtgctgggattacagatgtgagctacctcatccagcaaccaaaattttttagtgttattcgccaatgctgctattaaagaattacatttcagtttacacttacgtcgatctactttaggaatttgtatactgatttgcatttatccaaattggaattttttttaaatactgggacttttctctcacagaagaggtctgagatcttagtctagcataaatgacgaaatggggagtgatagaatagaaaaccaagagaaaagaagttatttaagagattaaaagaaataattatctgaccctttcacatagtcttgggtgctgaattgcaaattctgctgtttctgctgtgacagaataataataattttcttttcaatgatatagagatatttaacaatgtttactatttcatagcactagcaaaacaggaaaaaatgcttgatgtaataaaattatttcacccgattattaatcaaatatagaatgggagaatgtatattaacattatttgtcttttgaaataatattatcacaaatattaacaaactttggatagctttttgatatcttaattcctgataattgctactaattcatttctaagtaacaagtacaatataaattccagatttaaattaaaaatatttgatcattcacaatgctatgactgtattacatttcaatattttacctcgtgttattttctccataaatagagtggttatggttcacaggtacacatgctatttgtttatttatttcattttgtagagagggtcttattattttgcccaggctaaaatgcagtagctattcaaaggtgcaataaagtgcgttacagcttcaaactactggcccgaaaagatctggtttagcattctgagtagctggaattgcaggtgcccagccactgtgcccagccacaattgccactgtgcccagccacagtcagctttttcaagaactgtttaagataacaggttagggaaaatcaggataatattttgaggggaaagaaggtaaaatcaattaagacagggtgcacagagtacttgaatggtacagctgatgtttcatcctttgtactaaatggtgtgtatatgggaattggttatattattttgactgtttgtagtcatattatgtacatatgtgtatacataatttaaaaataaaagacaaaagtaatataagctaaaattatagatattaatattaattttatttaaatataacaaagatttgccagtattcaaatgtctgcaattatccttaaaatgcacagaacctatgtttaggtatagtatcactgttcatccagccttcattcactctaatctactcttatctaaaatttgtagtgtaagtaaaattacattcggtatgacagaagacaaattacagtattagaacattatggaaaattggcataacattgtacaatcacccataactttattatttatcattttgtaacttttttattatattagtcaaaaaatctaactgtacttaatagctaatacatatattatttgattttttaaagactattattaaaataataataatttgggggtgagaaggcctattgaaaaatgaccaacatataaatcataaataagtttgatgcaacaaatatttgtaagtcttataggtaaaaatataaaaatttattctaaacaaagctaaaagacaataatatgcattgggaaatatttgcaacattcacttcaagggttgatgtccgtagagaatttttacaaattaataaacatttaaaaagttgaggagtggcaatagctatgagagataatttacaaacacataaaaaccaatattaaaactgtttaatctgtaagtacatcaataaaaattttattatagtagttattttatctattaaattagaaaaggtcaatacaactgataatctcccaagggaatatatgggagaagcgctttctcatacacttataatatattgttagaatgccattaaataaacatttggcaaaaatctatatcctctgtcaaaacaatttaagttctagatctctagaatccacatatacatatacatatatacatacacacacacacacacattcacacctatatatcaacaactcaaatccaactccaattctttcataagcagtattttgtccaacaaacaaatttatctaaaattcttcttggcttttctccattatagagccagcaattttgtgtagctctacctctaattccttcatttgcatttatttctgctttcaagcccttatatgaggcaaatgggattaatttatttcattatcttaactagattcattgctttaatttgtcaaactctgattgatttgctcaactcaatcttgtgtgttcaagaacttaatgtggatttctgttccacctcatgaaagtcttttccaaaaacttgctaaattcttgactcaagacattccagttagtaatgcatttctctgctcaaatacaatagaagtgtgctctaataaatactcttcaacaatgtgcagttatttctccccaactatcaattccccttaaagcagaattttactaaaaatggctttatccttctgggaataatcagtaaaatggcaattggagggtgaatttaaaatatactaaaagcagatggcagaacatgagtgcagatttttactacaaagcttaggaagaacaaaaggaacctgaatagagaaaatgcagaaaagctctccctgggctattaggatgtagagagcagaagtatgtttaggagcttcaaagagtctgtctctttgcaactgtttatcttaggactttaaggaaataaaaggtgcaagtgaaccactctggattataaaatagaatttcacacagaaaaatcaactcagttaatatgcatgttgcttacatggaaatgttgagaaatttttagcaaatagaaagtggtagatggtaggtatatataaaataattgcagaaaaaatgtgaaatgaagatgtatggtattacttttatatttaaattgttaatatgttgcccataatgctttatttcaaagaatgaaaaaccggaaaaatagttccttcctaacttcccctgcagccttgtcttgtggagcttgtattttacttcatgagaaatgccaaagatatgtcatttaagctgaaacctccagcagaattagccagaatatttgggaaaaagatgtttccagaaaaagagctagtataaatgtccttaagcaagacggagctcatgatgattgaggaacaacaacaacaaaaagattatttcacccaagaaaagtgaattgggagtacagatataaatgatgagatctgaatacgattcatggagcaggtcaaactaggatgtttgggtgtggtctaaatgaatgggtggcatgagttgttttaaggagaggagtgacatgatttgacaagttcttaagagatccctttgattactctggggagaatagaacataaagtagcagaaatgaaagcaaaggggagatagtgggaaataattgcacatttataagcaagagatgatgttggctgggactctgattatagcaacagatgaagaaaaaaggaaatactgagaatagttgattggatttgctgacattctcaacataaatggaaatcagtatttttttctaataaatatgatatgcataaatatttttaaatatttaattcttttaccaccagtggggcatgagtagacttcaggaaacatgccagtacagaaccatataaatgtgatcattggtagagataggctttaataggcatttgaatgtctccctcaacctggaataccacgaaaaaagcttttcgcttcgcatgttgcattattatcataccctatagctttctaccattttcagttacttaatattatgttttgcctcaataaataatagtactttctcttattgtattgtattgtatttgcagcaattattagtgaagttttacgtttcaatattacatctaaaacaaaacaaaattgtcccatactattttccattaaaacacgagatcactatgacaaaaaaagctaaaatgtcatgaaatgacttaaattggatgagagtatatgaaatacattaagaaataatctctgactctgtagtttttttatttgtaggttttactagaacatgaaatcaatatgtgaatcctggctggagtttgcatctaaatgtaataaaataaaatgaagtttaatattatcattgaaccattagtgtacattagtgagctggactatataaaataaactttattatatttagcatttgatttttatttatgtatattataaaatgaatatagtttatattataataaaaataaaagaagtagtatgttaactaattcgtataagatgcctacaaactacatacctgcctaaatttttgacctgtgaaacttcaatggtttgtgttagggcctacatttatatatgtacatgtgtagtgtatatatacatatatatatatatatatatatacacacacacacacacactatatatatttttgtgttatatatacacactatatacacactatatacacactatataggtttgtgttagggcctacatttatataggtacatgtgtagtgtgtgtatatatatatatatatatatacacacacactatatatatatatatacacacactatatatatatatacacacacacactatatatatatatacactatatatatatatacactatatatatatatataaaaatatatatatatatatttagggagggcattgttaatcctttaattttaaaaattttaactttgcagacaaagttgattatacctgtggcagaacaatgcatacagcaataaataaataaataacttttattttctgtggagctcccagaattatgaattattggatagattgagatttgccgaggtcattttcttagagttgcaagagcataggagaaagtcaagggaaataataagcagcacttgatttcctttaccacagaggatgggattctaaaaccaaattatctgactataaatcaagacctatcttttacaggctatgtgattgtggatgttacctcctctatgcttcaatttcctcatctgtaaaatggaattatagcctaccctattttgtagtatagtgaggataaattgagtgaatgtatgtagttcctagaatagagcatgacacatgataagtggtcaataaaatattgtttactactagttatgtgacagtcacttcacacatagtaatgatttaataaaggagcaagaagaatgtagagcacagcttctcaacatcggcactacgacattttgggtcagacaattatttaatgcagagggggccataggatgtttagcagtgtctctggccagtagtgtacctcctcctctccaagttttgacaattgcaaaggcttccagacattgacaaatattccctgaaaagtaaaattgtcccggcttgagaatcacaaatataaagtaaccactcaaagattacattactaattttgattgaatttgaccagcattatgaaatcaacataagcttaagtttctacacttgattttgtcattgtcagttagggcagcagagaactccagttctgaaaattctgagcatgtgctaatagcctataatataatcaaaactttcattttgaattgtatttcttaaaaaatagaaaacgtattaagcagcaacatggaataattaaccacaaaaatatggaacataaatctcatttgcctaatatctcttttgaagtcctgtttcactgtataagtattatgtgttttgtttcacagctagatacagccagttttttctctaagcctaaggttactcctcaaatttatggtggctttttgctcttctaagtttctataaaacttcagcaacctgcagcaggttgaaatttattgatatttagttattcaccaggccatatttacagtcagggattgacttacccaaaccagatgctccccctgccagcagatcactaggagatattgcaataatttccctggttactaaattagcaaaagattctcagggagagagaagggcaagatggcacagtttaatacttactattattcttttattctttaccatcattccttttgaatggattaagaatctgacatacacataacttactaacgaaagggagttaggtgagagggaagacatatttgtctaagaaaagtcttagagaaatattttgaaaagagatagaaagaagagttggattggagtgggtgggtagggaatcacagtaaggagatggatcattcacaatttctttagacatggtgaggcagccacaggaagtctgaacttgttgaaaccctaatccgaagccaaaaaaagtgctcaataaggtcatactttgatcacctctgcctaaagcagttattcacaccctacttttgggagaggaaacatctacaaacctttgttctctttgtttgttagcagagggatgacatgaatttgggaaaaaagtttgagagacagaatgagatttagctcaaacaaatgattgactcatgctgggttgaaaatgtgctctagccgtatgtagaaagctgaaactggatcccttccttacaccttatacaaaaattaattcaagatggattaaagacttaaatgttagacctaaaatcataaaaaccctagaagaaaacctaggcaataccattcaggacataggcatgggcaaggacttcatgtctaaagcaccaaaagcaatggcaacaaaagccaaaattgacaaatgggatctaattaaactacagagcttctgcacagcaaaagaaactaccatcagagtgaacaggcaacctacagaatgggagaaaagtttgcaatctacttatctgacaaagggctaatatccagaatctacgaagaactcaaacaaatttacaagaaaaaaacaaacccatcaaaaagtgggtgaaggatatgaacagacacttctcaaaagaagacatttatgcagtcaacagacacatgaaaaaatgctatcatcactggccatcagagaaatgcaactcaaaaccacaatgagataccttcgcataccagttagaatggcgatcattaaaaagtcaggaaacaacaggtgctggagaggatatggagaaataggaacacttttacactgttggtgggactgtaaactagttcaaccattgtggaagacagtgtggccattcctcagggatctagaactagaaataccatttgacccagctgtcccattactgggtatacacccaaaggattataaaacatgctgctataaagacacatgcacacatatgttcactgtggcattattcacaatagcaaagacttggaaccaacccacatgtccatcaatgatagaatggattaagaaactgtggcatatatacaccatggaatactatgcagccataaaaaatgatgagttcatgtcctttgtagggacatggatgaagctggtaaccatcattctgagcaaactatcacaaggactaaaaaccaaacaccacatgttctcactcataggtgggaattgaacaatgagaacacttggacacaggaaggggaacatcacacactggggcccgtcaagcggtggggggaggggggagggatagcattaggagatatacctaatgtaaatgatgagttaatgggtgaagcacaccaacatggcacatgtatatatatgtaacaaaccggcacgttgtgcacatgtaccctagaacttaaagtataataaaaaaaaaaaaaaaagaaaagaaaatgtgctttttcaacaggtaggttgaaaatgtgcttcagcatttaggataccagatgtaaacatccatgcatagaattagaaaggttcaactttcatggctgctatggtttgaatgctccctccaaaacttatgttgaaatttaatccaaaataggataatattgagaagtggactttttaaagaggggattggatcatgaaagttcctccctcatgagtggattaatccattcgtgagtggattaatgggttatcttgggaaggaaactggtggatatataagaaggggaagatagacctgagctagcatgttagcattctcagccctctcgccatatgataccctgtgctaccttgggactcttctgagagtccccacaagcaagaaggctctcaaaagatatgccccatcgaccttggatttccaagcctccttagctgtagaaaataaattcagttctgtataaattacttagctttggatatactgctataagtaacataaaatggactaagacaatggtcttatcctgaactttgtaaactagaattggctgtttagcttcagcatgtatttttttatagattcaaaataatttcattttgaattgcataatgaaggaatgtcataaggttttcagcatatagaggctctaaatatcagtctggcattgtgataaagcagagagtttaaaccaagtcctatttgtgacacatgacctttctttctggttacagctcagtaacataggaatggatacttaactcaaggataagcatataatacatgaggctttttttcaaaattttgatttagaaaatgaagtattctagtatgttaattatagacatttcaactgagaagtctaatagcattggaccagaatagtcacagcagtccaaagccatggataaacttaagttaaaggcaacaaataataagagccttccacattaatctctatcagagaagatgataaacaggtgaatggggactagaaaccatgcagctttagaactagacataaaacaaacagctatctaatgatttcctatttactatgagcccaagatattcttgtatcctctcagttaagctcctgttttactaaggaaatttaagtaagattctgtctcttgcaagaaaataacatctaagacatcttcgaatttaatgctgctttaattttgtttataccagtggtccccaacctctttggtaccagggattcattttgcggaatataatattttcatggacagggttggggggaaggtttcgggatgaaactgttccaccactcagatcatcaagcattacactctcataaggagcgtgcaacctagatcacttgcatgcacagttcacagtagagctggtgcttctatgataatcaaatgctgccagtgatctgacaggaggcagagcttaggagtaatgctcactcatccacctctcccatcctgctgtgtggcccagttcctaacaggccacggaacggtaccagtttgtggcctgggggttgggacccctgttttacactataacatttgcacacgtctctcatggcctgtctttcagatctgctgtttgtctcgactcaagtctagctacctgaaaattagattttttttttaaattgaatttgaatatcttaaagttgaatacacagtctccacttttacacggcccctactgtcttacatcatacctctctagccctggaagatagcaactttacattcacttttcctgttttagggctattattttatcttcagttatcaaaatctatctacttttaaatactttaacttgaaaatacatagtaagcaattatggattatttaaaatagttttcccatgagtataaaaaaaaaaagaatagcaaaagcaatatttgttgagtatttaaaagtgccaggcactgtgcaacatgctttgcttaagtaaatgtttgacaaaatagaaggtcttttaaaagttccatgttttaacgttaataaccatatcaagataaggttagatattctatcaaattaccatttttgtgaagataggccttttctgctatatagaatctcctcaaacctgagtgttcacattatggattatctagtatactccacagctatcaagtttgtttgtgtttctttctcaagtaagctatcttatttatcttatttctccttatttcttcagacttttcctctcatttctttctctttttctggttttttttttttttttttttttttttgagactgggtttcgctcttgttgcccaggctggagtacaatggcatgatctcggctcactgcaacctccgcctcctgggttcaattgattctcctgcctcagcttcttgcatagctgggattacaggcatgcaccatcacatccggctaactttgtatttttagtagagacggggtttctccttgttggtcacgcttgtattgaactcctgacctcaggtgatccgcccacctcagcctcccaaagtgctgggattacaggcgtgagccaccatgcctggcccctatcctctcatttctaaggaaatgacaaattaagtattttatgcaaatacagtgtagggtcatttaaaatattttttgtaatagatgtctctgtacataaatctatttaattttttcttttacaataaaaaggtattaatgtgttttagtttcaccaaaaatttcagtagaccaactgtgtaaaggtacacatttatatcaatttttttgacctagtaaaaactaaagagggaaagttattcaaatatttcagcataaattccctttccttgaaattgcaatcgtcatgtgtagctacaattgctcagtattactctgtagtatgagtagctacaattcctcagcataagaaacactgaagtagacaattgttaagaaaacaaagtcataacaaaacaacaaaaacaacaaaattaaaaactaggatatagaaacattaactaaatgttactcttgaagccgatataagagaaattattgtactagacactgtggttcatcatccagatcccatcttcatgggaacacatcaatcccacactcataggggatatcagcagctgaccattcacatctgtacctttcacgaaatattgccctaagacaaactaaaatgaactaacctgcccaaagcggtgtctcctttcggagagcatccattgactcatagctggctaatgtagtgatacaaagatgcaactgctttgcctcaatttgggacaactctgaaagatgcccagtaggactggctgaagactcagttcaaagttgtcaaataaagtaaaccatgcccagttgaatttacattgtttagtatgagtatgtcccatgaaatatttaggaattacataaactacacattattcatgatttatctgaaatttaaattcaaccaggcaacttgtaccttcacgtggtaaatctggcagcttttacttagttgcatctgcattgtaggtaagcatgtcggtatgcacagacctctcttccgtgcttccttacaagtgcgtcccagaaaacaagtattcatctcagagccaacgggcattgaggcattcgataatcatactcccaaaggtcaaggataaagaaaatatcccaaaagcagcaagagaacaaacaagcaaacacataacatacaatggagcttcagtatatctggcagcagattttcagtggaaaccttacagccaggagagggtggcatgacacatataaagtgctgaaggaaaaaataaaaaataaaaaacttttaccctacaatagtgtatccagtaaatatatcctttgagcatgaaagagaaataaagaccttcacagataaacaaaagctgaggaacttcatcaataccagacctatcaaagaaaaggttgttagtgagcaagaataaattatctgaggatacaaacctcactggtaatactaagcacacagaaaaacactgaacagtgtagcactgtaatggtgatttataaattactcttgacttaagtagaaagaataaatgataaatcaatccaaaataataactacaataacttttcaaaacatagacagtataataggacatcaagagaaagagcaataagttaaaaagcggggggagattttcaagtgtagaatttttattaggtttctttttggtgtttgtttgtttatgtaaccagtgtaaaattgtcatcagtctgaaataatggtttgtaagataatatttgcaagcattgtggtaacctcaaattgaaaaaattacagcagatacacaaaaaaaggaaaagaaagaaattaaatcctactgccaagaatatcacctccactattgtaagaaaggaagaaggaagtgaagaccacaaaatcatcagaaaacaaacagcaaaatggcaagagtaagtccacacttatcaatgataacttgtaatgtaaatggactaaatgcttcaatcataagacacagaatggctatggctgaatggatttaaaaaaaaagacaaattatctgttggctataagaaacatttctcctataaagacacacatcgactgaaagtaaaggcacggaaaaatatattctatgccaataaaaaccaacgaaagagcaggagtatctatactcatataagacaaaatggatttctcgacaaaaactgtaagaagagaaaaagaaggtaattatataatgataaaagaagccaattcagcaagaggataaaatgattgtaaatatatgtgtacccaatactggaacacccagatataccaagcaaatattattagcgataaagagagatatagaccccaatacaacaatagttggagacttcaacaccctactttctgcattggacagatctaagacagaaaatcaggaaagagacattagacataatctgcactatggacaacaaggatctaatagatatttacagaacatttcattcaatagctgcaaaatacactttttccttcttctcctttttttttttttttttttttttaaagacagagcctggctctctcacccaggctggagtgcaactgtgtgatctcggctcactgcagcctccaccttctgggttcaagtgattctcctgcctcaaccttctgcttagctgggattacaggcatgtgccaccatgcccaactaatttttgtatttttagtagagaccgggtttcaccatgttggtcaggtggtcttgaactcctgaccttaggtgatccgccagcctcagcctaccaaagtgtttggattacaggcgtgagccaccacacccggccaaaatacacatttttctcttcagcacatggaacattctcaaggatagaacatgtgttagatcacaaaacaagtcttaaaacattcaaaaaaattgaaatatcaagcatcttatctaaccacaatggaataaaactagaaatcaataaaaaattaattttggaaatttaaaatatatgctcttgaatgaccatccagtgtttcagtgaaaaagttaagaaggaagttcaaaaagatccaaaacctatgatataacaaaagcagtactgagagaaatttatagcaataagtgcctacatcaaaaaagaagaaaatttcaaaataaataatcaaaagatgcatcttataaacctggaaaagcaagagcaaaccaaacgcaaaattacttgtagaagaaaataaataataaagacaagagcagaaaaaaaaattccaatgaagaaaacaatacaaaagaataatgaaataaaaagtttgtttgttgaaaaaataaacaaaatggacaaacttttaaccagctcacttagcaaaaaggagaagacccaaataaataaaagtggagatgaaaagggagacattacaactcataccacagaaattcaaaggataactactggctactatgaacaactatataccaataaaatggaaaatctagaggaaatggataagttcctagacacatacaagctaccagaatagacgcaagaagaaataaaaaaactgaacaaccaataacaagtaacaagattaaagctgtaataaaaactatcccggtaaagaaaagcccaggacccaatagcttcactgctgaattctaccacacatttaaagaactaataccaattctactcaaactattctgaaaaataaaacaagacagaatacttcaaaactcattctatgaggccagtattatcctgatatcaaaatcagacaaagacataaaaaaaaactataggccaaaatttctgatgaaataaatatcattgcaaaaatcttcaacaaaatactagctaaccaaattcaacaatacattaaaaagattattgaatatgacaagtgagatttatcccaggtatgcaaggaaatctcaacatatgcacatcaatcagtgtgatacagcatatcaacagaatgaagggcaaaaactgtatgataaattccattgatgttgtaaaagtatttgataatgttcaacaacctttcatgataaaatgtctcaacaaactgtgtttagaaggaactaacctcaacacaataaaagctatatataacagacccacagctagtattatactgaatggggaaaacctgaaagcctttcctcttatatctggatcatggcaaggatggccactttcattactgttgtttaacacagtacagaatgtcctaggcagagcaatcagacaagagaaagaaacaaagagcaccccaactggaaagaaataagtcaaattatccttgattgtagatgttataaccttacatttggaaaaacctacagactctatcaaaaatctattagaactgataaacaaattcaggaaagttgcaggatacaaaatcaatataaaaataaaaaattttagaaataaaaaattcaacacatttacaatagccacaaataaaataatatacctaagaattagccaaagaagcaaaagatctctagaatgaaaactacaaaagactgatgaaagaatttaaagcatacaaagaataaaatggaaagatattccatgttcataggttggaagaataaatattattaaaatgtccatagtacccacagcaattcacagattcaatacaatctatatcaaaataccaatgacattactcacaaaaatagaaaaaaattctaaaatgtatgtggaatcataaaacacccagaagaaccaaagctatcaaaaaaagaaacaaacaaacaaaaaaaacctggagaaatcacattacctggcttcaaattacactgcagtgctacaataatcaaagcagcatggtctgggcatacaaacagacacatggactaatgaagcagaatagagaacccagaaacaaatccacacatctatagtgaagttattttcaatgaagatgccaaaaacatacattggggaaaagatagtctctttaaaatatggcgctgggaaaactggatatccatatgcagaagaatgaaacttgacccctatctactgccatataggaaaatcacatcaaagtggattaaagactgaaatctaagacttcaaactatgaaactactacaaaaaattgaagaaactctgcaggacattggtctgagcaaaagttccctgagtaataccctacaagcacagaaaaccaaagcaaaaatggaaacatgaaatcacatcaagttaaaaatcttctgcacagcaaaggaaaaaatcaacaaattgaactgacaatccacagaatgatagaaaatatttgcaaactaaccatctgacaaagtattaataaccagaatatataacaagctcaaacaactatataggaaaattgataacccagttaaaattggcaaatatcaaatagacatttctcaaaagaagacatacaaatagcaaacgggaacatgaggaggtgctaaacatcactgaccaccagagaaatgtaaatcaaaacaacaatgagatatcatcttacaccagttaaaatagttttatccaaaaaacaggcactaatgaatgctggagaggatgtggagaaaagggaatcctcttacactgtgggtgggaatgtaaattagtacaactactatggagagcagtttagaggttcctcagaaaactaaaaatagagccaccacatgacccagaaattcaaattttaggtataaacacaaaagaaagaaaatcagtatatcagatatatctgcactcccttgtttggccagcactgttcacaaaagccaagatttggaggcaaagtgtccatcaataggtaactacatttaaaaaatgtggttcttatatacaatggagtactattcagccataaaaaatgagattctgtcatttgcaacaacatggatggaactagagctcattatgctaagtgaaataagccaggcacagtaagacaagcataacatgttctcacttatttgtgggatctaaaacttaaaacaactgaactcacagagatagagagtagaagccttggaagggtagttgggggtggagggaggtggttaatggatataaaaattagtaagaaagaagcaacaaaacctagtatttggtagctcaacagagggactatagtcaacaataatttaattgtaaatttaaaaataactaaaaaagtgtattggactgtttgtaacacaaaggataaatgcttgaggggatggagactcaatttttcatgaggtgatttttacatattacatgcccgtatcaaagcatctcacataccccataaatatatacacctattatgtacccaaaaatattaaaatttaaaaatatttaaaaatttacttgtaaaacagcctcaggccaatctttcaggagatattgcacaagaaggcattgttattataggagacaacagctccatgtgtgctattgccccaaacacctttcattgggacgagacgtggacgtggaagacagcgatatagatccacatcttgtgtagccctaggctaaaatgtgtttaacaaaaaaatttaaatgttaaaaagtatacatttaacaaaataaaaaacttatagaacaaggatataaagaaagaaaatatttttgtgcaggtgtacaatgtgtgccttaagctaaatgttattacaaaagagtcaacaagttaaataaaagtttattaagtaaagatacagtaagctaagattaattactgaagaaaaaattaataaatttattgtgatgaagtgtacagtgtttataaagtctacagtaatgtacagtaatgtcctaggccttcacatttagtcacttctcattcactgactcacccagagtaacttccattcctgtaagctccattaattgtaagtgccttgcattggtgtaccactgcttactatttatacagtatttttatcataacttttccatgtttagataatcaaatattttccattgtgttatagttggctacaatttccagtacagtaacatgctgtgcagacttgtagcctaggagaaataagctataccatatagcagaggtgtgtagcaggctataacatctaggtttgtgtaagtaagtacagccaatcatgttcacacaatgacaaaatcacctaatgcatttcttagaaactatgcctatcatcaatcaaggcatgactgtatatcagaccactttacttatccaaaatgagccttgtgacaaattcactctctagaacaaaattggatgatgaattagtaaaaagaatcccttaacacaaaaattatgacattttcttacatcttttactttgttagaccaagaatagaagacttttcttctcactagtaactgcaatcaattggtatgacttggagtaccaggtatatcactcttggcaacacatctatttttagtaggacaaaactgatgtgaaaaactgaaaatctcttcaataagagcattgaaactaggaaaggggtttagtgagatttagtatatgtatttatttacttctctgtggtttttaaacttatcttacttcctctttttaaaactctgtcagatttatcactgatttcagaattacaatctttaccatagactacaaatccctgagtagttatgtgatttcctcccttctatcttcccagtccatctcataccatacatttattggtcttctatgtcctagacacaccagccttttaagaggactctttattaatcacaaagatgttgaacagatgattctgacagcctggaattttctctctccacttttctttttcttttacctaggttgaattcattgtttagatctcaactgaaatattccttctttgtggaagcttcaccacatgacccagattatgctaggtctcataacatgctggggccttctcaatattgtgattaaccatgagcatgatgtattttgcctggactatattgcagacaaagggcggactgcaaatgcagctgccgaacaaatatctgtggaaagaaaaaatgattccttattttagacctctactctgtctcattagcattaaatgtcacacaagtcttccaagcttatttatctgattttccaacctgagataaaatagaagcagctaatagatacacagcacagtggaaaggcaatattagaaataggttcagcaggacaggcgcggtggctcacgcctgtaatttcagcactttgggaggctgagaagggcggatcacgagatcaggaaatcgagaccatcctggctaacacggtgaaaccccatttctactaaagacacaaaaaattagccggtcgtggtggcgggcgcctgtagtcccagctactcgggaggctgaggcaggagaatggcgtgaacccgggaagcagagcttgcagggagccgagatcgtgccactgcactccagcctgggcaacagagcgagactccatcttaaaaaaatgaaagaaagaaaagaaaagaaaagaagaggagaggagaggagaggagaggagaggagagagagagagagagagaaaagaaagaaagaaagaaagaaggaaggaaggagggaaggagggaaggagggaaggaaggaaagaaggaaagaaagaaagaaaaagaaagaaagaaaggaaggaagaaaggaaggaaggaagaaggaaagaagttcagcaatggaaaagaaagtaagtcataaaagtgaattagaatgcaaagtcaaagaacacatccacatttaatgggtttttttttgtttgtgtttttgaaaatttaattgaagaaagtaaagttaccctggcttataataaagttagatattataacaaaagataagtcagtgaccttaatatgcaatgtgttttggtttactcatcagataaaatatgttattaatgaacaaaataaaaaaatctaaaaaaggaacatgtagagaaacctagagcttagcagtatagttctctgaaatattaataagttaagaaatatacaccaatgagaaatgacttcagaagtttcactccaagggccattatagctctggaaattcttaaaggattcattaaattttcaagcacagaaatttgttcatttaattgatttttatatatgctttttaccccttttgttagttctgatcatccttaacctacacaccaaatatgctacaattaaaaagagaaagctcataatattttaatccccaaacataaaaactgaatttattaagtacctactaaagtctagaaactttgttacacataccacataattttataactaaatatgtaacatcacaaaatcgagattcaaaatctaacattggtggaaaatgcaaagcatgagtttaataagatattaaccaaaatgcacacctctgtctctgctataactacctcacctctggtttgcactagacttgggttgccacttgatccatagagaaccgttattaaaaacaaaccagagagtaattatgtcaaaactcacaaagccctgatttaaatcatgagaaatctgaataaagcctcccttgtcacacctgtctaattagcacggactctaaattgaggaggggagccctaaaaaggaattttgttgtagctgtaaaaatgtatactctttaccagcagttacaaaaacaaataatcttcatttgaagcaagctctccaatttttcaccaggatagtgaatgagcaaagctacatatatcctgcagagttgctagacacacaaagcaaaggatataggtattacactaattaacaacaatgggacaaatcattaaacatcaagtagaacattcagccaagatgatgaacaaattatctgtaagctaagattaatttgttactgaagaaaaaaattaataaatttagtgtgatgaagtgtacagtgtttataaagtctatagcaatgtacagccatatcctaggctattaaatgttataagtattagtagtagcagtattggtagtattatcctcttttcaaattttaaccacagagcttacatatgtataatgataacatgataaataggaatcagtttttacattggttttgatggttcacactgtctcaactcatggtatcttgttagcaaaagtgcctctattgtccagttaggcctgattttagtctggcatacaattaaatctaatatgtggatgcacataaacagtttgattagatttttggggaagtaggtttctgcagacatgagccactgcttgaatatgcaatatactaatccaatcaatcaccttgatacatttagttgttttatttttataattctctataacaggtttatcagtcaaatttattggttatacttattggtgtaaatgaagaaatactttttttgttccctctcatcactacctttaaatatgctcgttggaatctctttttcccatcacttgagaataactccagccaatctccagctatctagcaatttccaaacacactttcaataaaattgaaagacaataaatctatttttggtaaatttgacttactttcaggttttaaaaaggtctagttgcatgtaaattaaaactacaattttgcaaccaaattaaaacattttccctacctgttcctcacctagctcagaattgatatgtaacaggaagacctgtggttgtttatccagatgtccttcttttgtctatggctccattaggattgtaatggggaaaacaagaatcatagcaggaagaattaaaagaaaagagaaaagctttttttttttttttttttttttaaataatctcatctttatttctattgagaggcaggcacccaaatgcttcttctgtcggggagtgaatttgtaagttctttgtaactctgtgctacctatttgttaacctgagtaatttgttctcctgctcacttcttgctaacacttgccagcggatacctgaagcctcttacatcttctgtggcatgcacttggcctatatatagcatattcattcacctaaagtgggaagaataatctggcatcttttctctttccccatcttgccatcaaaagctgcctcaacgagcatgtagccttcagaattttgaaagccagaagcaggtaacaacttgccatgtttagcttcatcttgaaactcttgaggacacctatcaaactttcccaaaactgtctcatcatgtatggttccattgcaggatgggtgcaatgctgagtgccagcaggggaggaatatcccattctttccttcttgaaattgcccccagtctttttgagctctcttcctatttggaaggagaactaaagcaagtttagttctcctcacaaaagagaaaataattgaaagcactctcacttaggcagctaattcactgtctatatgataattcttagaatgcctagtcctctctttacataagagcacaggtaattgaggtcaatgaaggttgtagagtcacagaacttgtctggctactttttattaaatcctgcaaagacttaactattcttctgtaatttagggataccggtcatttaatagggaataaacaaaaatctgagacataaggaaattctgtatccattctatatatgtataaattatatatagaaaaatagtttagaagagttaatatcaatttgaaaataggaattttaaagctgtgaataatacatagcataaatatgtataaggattcagcaaaatgttagttgacatgtggctaaataaacttaaagtttaagaaagataagaaaagaaaccaaatatgcataaatctggggacaaaatttgatattgctgctaataaaaaggggaggggcatcatattgggaagcttcattaataaaagtaacaaattatgagaacaaatagtcttattatagtttatctggtgaagcattttaatgaggcgtagttgtctgttccattacggaaagagttttcttatgtgtgctctggtagattttcatgtggccacactgaaagatactcccaaatgtctgactaataattctatttataggcaactgttctgaaggtttaaagtaaggaggatgaagttcatttggaagcagtggggaaaaaaatggtaatgctgggctttgaattttatggatgctgtagctgttctttatttttcaataaataaatgttttaaatgccatgttttttagctattgcagttaaactgccctcatctttttgcccagcaaaaaacccattaagttattcactgagattgactctagattttttataaaattaataactttgctaccagtttctcaaaaatgagtagaaacgacttttcaatgcaaatgccagtttttgctacagtgaaattattctgtctgtagtgactatttgaacatttatgggcaataggacattgagagatttagtatatgaactacgaatagatttatccttagattatctaatacatgttttccaccttgcaacataaaacctgatctctttttaaagtcctggttgttctgaaaaatgaaatgaaattatagtaaatggaattttgactggggggaaaaaaacttcacatgatttaagagaatggatgctggcaattgactatctactgtttattcaaagcttatagattagcaaccagatgtggcagaaagttggctgtttttcattcacaacaaaaacgatgctgtgcttaatgaacggaggtttgttatcccagtaataagtaaaaggaacatgaaagcccttgtgtttaatgcttatgcaaataagctatttgcaggtggcttttgggcagaaggtaaaatagtttcaaaactgggtcaagttttttaatcctcaaaaattgccagctagaggaaaacctcctaaaatctttattatgctatttgccaagtaaatgaaatgacatcatttatcatttaataaattacatatgaaaattcttttccttatgatttcatcaatcaacaaataaattctagaggattctagatacatttatttggcatattttttaatgcggtatcaaattttgtggatattcttttagagaatcaatttcttaaaatggcattgaacatttaatttaaaatgcccttcttgaaccatacatgtttattagaaaattattttatataggttgtccattaaaaaacaattttctatgtatgtaaacatttatgataactgctcaatattttggtccatatttatttatctacctatttattacacaatacaaatattacactttgtaaaattaaaggcctagtctaatattactctatgtcggaagtaaaataattcagagaagtctatattaaaagacaagataaaacacaaaatgatgagaatcacaaaaccattgccaaattttcagctatgacatttattctccatgtggccttaggtatcttactctcttattttaacctttgatgactataaaaataatttgttactaagaagccctctcgctttagtagctgtgactataaaattaagaacataattcacaaaaagtgtttgagtcttcctgaaaacattttaaaatatcaattaatcattgcacaatacacaatcgcctgatcatttgctaaaagagggttgcattctcatctctgttcactctgtcctttctgagactcatataggtgtgagagctagaaaaaatattaatgtgtagcaattcagattttctcattgatgaatcacttcagcagtgcacagaatactttgtaattttaaaaaggtgtttttattaatatacttctactattctaccccaatcaacagcaaatttacctaaatcatgagactgctggaactgctaagttttataaataaaagacttaagaactactattaaaccctgtgaatcctttatctacaatgagaatgtccatgagtcagctcttctgaccctctggccagtgttctggagttactgatctgcaactttctaattgaactctagcttggtatgtgagagcagctgtgggttaaccagcggggcgacatttaagtcttgacattgccattaatgattcaccacctgttgcaagttcaataagttattcacacaccaaattgtggccacagaattcattgagataaactaagttagaaggattgggtgtcaataaatgtttgctaaatcagaattgttaatgatagaaatccgtagcttaacaaagttgagaaatcttgtcttcttaacgtgtatttattgacttcccaggatatgtcttagtgaggaaacatagcttctggcatttattattagagggataaggaataataaaccacagtgattgagagacagggaaaggccgggggacctagagacacagtaacagaagaagtttaattggctaatgaaataaacttgagataagagagcagagaggaggttcaagagatgaaaccacatattcctctctatctgctcccaccatcaagggaattaataacatattttataatgaatccctgataaatattagtgtataattgaaaatctattaaaatgactatttctcagggtgcagaaaaatattaaaacaagtaaagttgccataagatggaatattatattttcctgcatgtctgcttcaaggctgaatcctaatggtcatgtatgtaggtaaattattcttcctacagcaacttctgggaggtggtatgtggtggggtataaaaggccaggggtgtagtgagggtaaagtgtaagtactttgatcttgagccttgactatattggacttgggatctcagaaatcttggggataaaccgtggattaaatccataaattcataaagtgttggttatacaacgggtagaaactacgtgccacttttggagggacagtctcctttttttttaaaaaaaaaaaaggccttaaaggctatatatatatatatatatatatatatatatatatatatatatatacagtcttttttattataataaatactattttgttttttttaaatgaaacaatctgcacatatacaactccactctgaaggcaattatttacataattatgcataaattcctatagttatgttagtagttgcctttcttcagagtggagtcatatatgtgcagattgtttcattttaagaaaagaaatatttatttatttgattaactgaaattatgcttaaaaatgattaaaatgcacagatctgtcttcatgaagtttaaatgtcttataagaaattaaagtaataaagactacaacatttattatttaactgtaactgtagtgggtagtaaaagagaaagcccagtgtgttggctttcagtagtaaaaaacccaacttgtggttaggaaacgccattgtttattgtatctaaattaatcaagttgtatcctgtaacaggtttcctgttatccactcgtcttccaacttctgaagtatgctttaaatgacaagggagaaacccagacactacattttctaggatctcagcacaacagagctccaggtgaaattatgctaaatagtggcatgagcgtgagatgtgggtggcataaagaagaggtttagagtgtttttctggtgacctcctgtttaagtttgacaagcatctgaaatcactgctagcaactttcccataattattgtgtttccagcctttatgaaaatagcagcaattttttttcctttctttgcctatgtacaccatctaatcatgagataagtctccttcttagtccctatattaaatatctttttacatgaaatacatagattgggatctttttctgacctgttcctgtctgacatattcttcaactctaagatgagttcatactcatcttcggaagcccctgggaaatgggaagttttttttcatattagatgttggtagatatagaggcccatcctttaataaacatctatgtgccagaaaatgtactaggcacttagatacattattcatgtaactctacacaaatgtatcaacaacacaaaaaaaaatctgtataaaataataattattatatcccttatatggaaacagatccagagaggaagatacactagcacctgtaaatagaggatccaagaattaaacatccatctgtcggactgactacaagctctttctttttcataaaatgctaatttctctcctgcttctaatatttgtatcaaaatttgtcatctattgttattgggtttataggtgggtagtgactccttggcttctattttgttctagtggattactgtcttctttattttcattctagtgtttattgagagtcctaattaatcaacctggctgctctgacttccatcagctcaccattgtctcttttcccagctcataatttctgtaacagagctctaagctatgctaaacttctgctatatgctgtcagcctctctaaatccaagtgctcttatctgccaagtttacatacacatgtttaaaatcttcttattgaatctacatacaaagtcttcatgtcttcctccttgaaataatagcattgtgagagaaaaaaaatcttcattctttttaaaactaattcagaatgtctaggtaacacaagaacactctgcaacaaacaagaggtaagggaatatttacctggtatttctgtgcctcattatcattctcactcattataaaattggtatctgaaaaaaatcttgctgtaaaaacaaaaagtaatgtatagagagtataaacaaagagtttgcttcacatcataaccattatgcatcccattgccaaagggaagatagtacactacatgattccggggaggagcatcattcacatagactatagtgtgcatggcacatgcaagagaccccacagtactacccgctttgttctctttgtagacacactcacggatgattcatactccctgacctggagtagccaaataaagagttgcatcagtttattatcattctttccagaccactttctaggtattcccattatacattccttcaaatagaaagattttattctgtaaattgcatcgcactgtacacatttttttctgaaatctgaataatttcatacagtttcaactgtgagagtacctgacagactgacctaactctaagctaaaacactcataaactagcacagaagcttgtcatatcattacacatttatccattgctctaaattacttatagtttttcctgaaacatctattaatattgcagttatttgagatgactgtgagcttactatttgccagtgatgacatgagcaccttggtttagtctagtgcctggcatttaataggaccattctatttattttcctaaactctggcagcaagattagctctaagcatatttttttatcacaacaatcgtccatctttaactacatgtgaggaaagcactttcttatattgcattacacatttttatatggccacagaaatccttacttaatctgacaaaattaagataaatttctttctcctaagttcaaggaaagaatcattctctactgtttccaaggagatgattctccttttctcaattgccaattgtctactgcttgtcctgggttccatcttttcatatgtcatgaggattctcaccccagtgttctgctcctctgagtcaaagcccttgacttttcacttctcaattgttttgtttgtaatttttttgcttttatttttttctccataaatgctatgaaagtgtatgtaaaaatttacccatcttttattttatatttgttatcacattttattcacataccaaactatacaggaaatgaatataagcacatctttcttagtaggaggtagaagtaaaattttgtttagaataaaaacagaaaaaaagagaatccaattccatatcaccagtttgctcctgaatgtgcaataagtttccacttatgagcttgctactgtacacaacgcaagagcttttaaaaaattgtctacatgatagtggttaagagcgtactttaggctaggttactttaaaaaaatatgtcatcattacttctgccatcaaaagctaattcaatgtatcataattgttaaagttgagtagggttaaggattcttctcattctatggtttccttataaacacagtttctaataaatgtctatttttttctgtgaaattaaaccactagatattgctgaatgtctgtatatttcttacatttctagaatctcattcttaatttttttcttatatttttccttcaccaaagtcttaaaacctatgcacctggtgtctattatttaaattctgtgatgtattttatttgactttatttgtgtttttagtcttttcacagaaattagtttattgtgatcttcttttccaaaaggacttaattcatatctcttttccatacctatcttcattagcaggttgcatttcagtttcttcagtgcttttttagataatatattttactacatctttcttcacaacactgtatatgctctgatgatcaggtctctcattttttttaagttcttgtcccctttgggacccatgacaaagtaaagggcagattttttctcacctggcttaaaagtaaaaagccttcatatgtttctcctctgattcttcttaggcccagcatttccaaaaacaaactagtacacaaaacattagagttgcaatgatacttcaaaaggttcaaatactaatttttgtctgctttctctctatagttttcttgtagagaaattttctgttatgaaggttgaactatttgctatatgttaatattttccaaataaagtttccaaactgatatttaaatacattctctcatattcaaacatattctgaactactttctgttgtgtctctagatcaatatttataaaactagacagttcatataatttttttcctttgctaactttcaagatcatatcaaaaagtactactgttgattcggttttttgtgtttcattatttgaaactgtattgacctttttcctcttatttctttatcatttcctgttatttcatctttgtgagtcttcccattaatgtctttttctttttgaattatttattttttaattgacaaataaactgtatatatttaagatgtaccacatgatgtcttaaagtatacatacattgtggaatggctaaatcaagctctttaatgtatgcatatttaatatatgcattaccttgtaattgggccccttgagattttagtatctcagcatttttagtgcctgagatttaaaaaagtcggattaggctcttgcttgcttgcacaaaagccaacatcccttgttctcacaatacaattgcaaactgctgatgtactgtttctttgtcaagcaggagaagataacttcaaggtaacaaaaaacattcgcagaaggaaagaatgcctataagattgttgcaactaactgttgagacccagaagtctggttgctcaggatgttatcagagattaaagaaacacaaacttccccattggttccctaaaactccccctctcttactctctggctgcaaacaaacctctctgctttctcttattgttaagacatatctgacagatcttgccccgttctcgctttggccaagtggaataaacttttatctatctctaagcgttggtgtgtcagtgtttggtttcgactgagcatctggtacatgagcctgaatttgggtctctacaacatcttcacctagttactatttttgtgtgtgtgtggtgagaatacttgaaatctactccattggcaattttcaaatataaatgtattgttattcactgtagtcaccatgatgtgcaatcaattttttgaacttattcctcctggctaactggaattttgtgtcttttgaccaacatctccgcaatttcccccatgccctagcttctgatgatgaccaattaactctctgtttctatgagttttacttatttaaactctacatataagtgagattatgtcatgtttgtttttaagtgcctggcttatttcacttgacataaagtctcccaggttcatacgtgttgttgcacatgacaggatttctttcctttttaaggcccattaaccttttgtagatctgttactgaggtaatcaaagcttactggacaattatgttatttgagtaaattgaaacataacagcttataaagggtcaaatggtagtaatagcctaagaaataggtttggaatattatttcttagcataaaagacaaagataatattggtcagagtcttctaggcttgaattcttggctacttagattttatcaagtaaattgtaaaaggataaccaatcaatatttcacatgtatttctgtatgaattttgatttgacaagaaagactgtgaaaacaaaaccactattatctgtgaactacctaatgtggaaataaatatccttaaataaaaccttgagaaagtatattactcaattttttttctacagatatcccatatgttataatatttaactgaaaacaaaatctttcttcttaagaaaagattttattcagttttagaacgttaaagtttctccactctaatatatacagaacttctctaacctttaaaaatactgctttgcttattactcatgataattgggccacatacataattaaaacacaccatttattattttgccatgtgaaagtggcatctggttccccaacttgacttcaaactgtaattttaaacaaataataaagtgttttgaaacattaatgtcattaattgtcttatctattgtctatgttcatcaggagctgtgacatgcccaaaggaaggtaatcagaggaaggaagagaagaagctaagttctagagaatccattaatcattccttagatgactgaccattttattattttcccaagtaagctgaggctgacaatatcatgaatcatttacatatatcagtattcaaatgttccatttttaaattgggagggggtatgttttagaatagaataatgaaattccctccatctcctcctaatgtacatcattaagaagaatctaatggaaacataaggttctaaggctcttgttggaaaccataatcagaactggaggaattctcttatggaaaacattaaaaaaaggaaattctagcaatagaattcattgttaaagctgtaagttacaacaatattgtctctgcatgctgactgtaatcctctataatcttcaaaggcaaacaggaacagtaataatcttttcatgtactcttaacttccttctctgaaaggctagaaaatgtcttacatgtagcactcatagtgtcatttaatcaaacccagtttctatttttcttcaacttctagatgaatggatgcttagtctttcgggcacaatgtgaatttcttaagggtctgtagactacatctcctatttttacttctcaaagtttctctcaaattgtgataaaaagtttcactctattggtactgttaactgccaaccactttgaaggcctcctcctccacttttttctttttccccatatctaggcaagcagtaagaaaactcagagtctctattccttggctacggcagggaagttcaaaccatttaaatcctgaactattggggctgagggtaagggactcacttgggcccaacccttaaccccattaaataccagaactccactgactcttccttaggtttcacttcccactgaacctgagccctttttgttgtggattattttgccctttagtaggtaataataccatgtaagtaataaatttgtttcatttcctttcagtcttgatatccataaattactaggggcaggggtggtgtagagttgcctagtattcaccaaataaagtaaaaacaacacacacactgagagaaaaatctagagaaacattcccacattgccacacacagttttcttgcttgcttctggtaaatataaccttctctatccatgagttcaattaacaactttggataggaaatattcataaggaaaaatggatggctgcatgaaaggagagtgttctacctgactttattcactaatcaggatatgcctaaaaactgggtggcaaaaactgaactgtaggttttgagaaagattctaataacaagaaaaatgtacaaacatttttattgttgtttatccctaagcaagacagcataacaactatttatacaacatttacattgcattaagtattacaagtaatctaaaatggatttaaaatatatgagagaatataagtaggttatatgcaaatactaggccattttattaaaggacttgagcatctggagattttggtatctgttgggggatgggaggtagggcggcaggtcctggaatccatcccccatggatactgagagacaaacatacatagaagctacaaaagcaaattacttatttcgcctcttgctgttgacttaaggaaaactatgcactgtatcatcagtatagagagttcttgaaaagcctagatcctcccaaagtttgaataggtgttgcaaatagcgagatgtggtgatagctcaaatagagaacctctcgggaaaaccatttccacatttagaagcaagtttgaagtggcagatgactattccttttttataaatatatatatatatatatatatatatattatactttaagttctagggtacatgtgcacaacatgcaggtttgttacatatgcatacatgtgccatgttggtgtgctgcacccattaactcgtcatttacattactttttctactgaaaatattttcttggcttcctgtcaagtaatgtgagttgcaaaaggcattgaagattggaccaactaatgaaatggaatcaggacatggtttcataaaataagagtgtttttttgtaattatttatagtttcttcctttttttatttttttaacttatttatattccaaatacggtttgtcatttagctcaactttttattttgccccacatatcttcttacggcttcttggtttaataggataataaaatttctaaagcaggctggtctatggcttccttaaattaaccctgcctcttctcttacaaaagttactaaaggcaaatataaataatcatgaccaacatataaagatatgaatgagatttacagagaataactttactcagttatatagcgttacccacaaagggaatttactagcttcaattgaaaaaaaaatcccatgacacctatgatatttacttctgtcatctccacattcaaaagaaaacaaacagattacccacatatttaatcactttttattttacaaatgctctgtaaacaaaatgcttctcagacctattcaatacaattaaaatataacatagctttgccaaaaggtgtattccaaagttatcagttagatttattaactgataaagattagcaatttaatgtgaatgttttctttagtgaatatacagaattctctcaaagttaaattattaaaaacatacctaaattcacctaactcaaaaatgtagtattcttatactcaatatctgcacattctcacatatacaaaaatataatctaaatgttatttttaacaatataaaatttgtttctctctttgttattgccaagattgcactgactgttgaaatataaaagaaaaacagcattaaatcaggtgtgataaaatcacctttttctgtttatcttcactactggcatttattggcacttggaaactatttataaactcatattcttattgctaacatcaattattatgcaaatacttgaaatttttactgacttcataaataatgcatgaaagtctatagacttcaactagtgagcattatcttttgtggtttataaatacagaatacagaataaggtatagtttggatgagtctgaacaacagatgtttctgctttatgaattctggtcaaatcatttggaaagagttttgtttatacaataagcatctgcgttttggaaagttaaactaaaaattattttgtcattttctctaatagcttgggacctacataaatctgttaagttgaccttaaatagaactgaaggtgatagtagaggtatttaaaacaagtttggatagtttttacacatgtaaatctataacatacatttaccaaaatctaatatttaagaattaatggaaattatacagttattccaactctaaagttttatgacacaaatatattacttagatagtatcttcacattaattttgtttaaaaatctccattatgctttagaggggatttcagtgagaatatatataccccatcatattttatcaagctgaaaactgattatgcaactttttgtaagtacagagcaagtttaatccatttaactcatgccagacttcaggcatttaagaataactatcaagtattcctttaagaatttttctttacaggctagtcatccttacttccttcaagtaattgttaatttgcttgatgccaggagctctaaattatgtagaattcattttactaatttccattataatatatatttcgtatatatcatttgcttcctcaaaacccacagttcagtttttgccacccagttctgaggcatattctgattagtgaagaaaagcaggtagaaaactcttttactaaaaataaccaaaacatagttgggaggaggtgcttagggcatacatttttgaccttgtttacctcttagccaatactaagtgctttcacatataatcctataaaatgcttctcctccatgctacacttgaataatcaaaattttgaggttatatatatataatttcacaattgcctttttctttctctattcaacaaattctaccccttagacactggctttctctgtttcttctgtggtagttgatagaattttacctatatttatgctaataaatcaattatccagctatattttgcacaggggtcctgctaatcttcttgaattcttccaattttagtatacgtgctgccaaagcaagtgccagctatttttgaagaactgatatgtactcctaagaacacaagataaagagaatcctaggactaaagttggtaagccagttttttttttccatttcctattctttctttttacttctcgtcttccattctagagctgattcacaggaatccttcaaacacttcttggataggtctttctggagtcccttcaaaagttcctgtttatagatgcacataagatatgagagggtctgaattcttcatgagtccatctcttttgttggaactcaagaaaagagactagactggagagtagaactagattttttgagtcatgtgtaaataatgactacaccgcatgtacacatttagatgctgtccccagttcaagagttctgtccactgtcaaaattcatgtccacctggaacctcagaatgtgagcttgtttgtaaatcagtttttgcagatgtaactagttaagatgaggtcgtactggagtagagtaggccctaaatccaatcactagtgtctctataaggaacacttttacactgttggtgcgactgtaaactagttcaagggttgtggaggtcagtgtggcgattcttcagggatctagaactagaaataccatttgacccagccatcccattactgggtatatacccaaaggattacaaaacatgctgctataaagacacatgcacatgtatgtttatcacggcactattcacaatagcaaagacttggaaccaacccaaatgtccaacaatgatagactggatgaagaaaatgtggcacatatacaccatggaatactatgcagccataaaaatgatgaattcatatcctttgtagggacatggatgaagctggaaaccatcatcctcagcaaactatcgcaaggacaaaaaaccaaacaccgcatgttctcactcataggtgggaattgaacaatgagaacacatggacacaggaaggggaacatcacacaccagggcctgttgtggggttaggggagggggtagggatagcattaggagatatacctaatgttaaatgacgagttaatgggtgcagcacaccaacatggcacatgtatacatatgtaacaaacctgtacgttgtgcacatgtaccctaaaacttaaagtataattttaaaaaaaagaaaaaaaaaagaaagtgaaattcagacacggagacagagaagcacacaaagaagaaggtcatgcaaagaaggaggcagagataggaagaaagcagctacaaaccaaccagaaccaaggatttctgagagccctcagaatactggaagaggcaagggaagttccttccctagagccctcagaggaagtacagccctcagaggaagcaccttctaacctccagaactatgaaagaatacatttctgttatttttaagccaccatgtttgaggtaatttgttacggcagctctagaaaacaaatatacacaggactcttctttccaataggtctgaaatataaatgtatatttatatacatctccttgaatatataaatataatagagattaaatataacagatttatagatttataaacatataacagatttatatatttataaatataaaacagatttatataattttgtaaacacaaaatagatttatatagttttataaatgtaaatatatgcatatatatttaatttttaattactaaaattttttctataggctctcaataaggcaaatacacaatgaccaaacagaataataattgcttttcatttatagattataaatgcttttaattgatagattataaagaatttcatttatagattataaagaattactgtgggcaattaaatcaaagccttttcaaaaatggtgcaaaactaaatctatagtattcaactgatgtttaataaatattaaacattattaatatttattgttaattttaattaatttttaattaataattaaaattattaatatttaataaatattaataagcatcttattcaactgatgtttaataaatatttctgtggattattcctctgaaataatattttaagaatacacatgcatagacataaatgtacatacatggttcaatgtggtgttttattccttgcctataattacacgggtaaaaagaatgcatatttatgctgaaatgaaaccattttgctttctaaaaagaaacccagacacacatttctaagtgcaatgacagcaaatactgatacattcacatacattcttttgtcttttgaccttttcaagcaaaatcgtgcaagtatatctaggttacatctgattagctttcacatgttttagcaggttttgagaaattttgttttataactttgataaggtttggctgtgtccccacccatatatcatcttgaattgtaattcccataatccccatgtgttgtgggagggatccagtgcgaggtaatttaatcatgggggcgattactctcatgctgttcttgtgatagtgaatttgttctcacaagatatcatggttttataaggggtttttccctttttgctcagcacttctccttcctgctgccatgtgaagaagaatgtgtttacttccccttccaatatgattgtatgtttcctgaggcctctccagccctgtggaactgtgacttaattatacctcttttctttataaattaccaagtctcgggtatttcttcatagcagcatgagaatgactaatacagaaaactggtagtgcagagagtggggcgctgctgtaaagatacccaaaaatgtgcaaacaacattggaactgggtaacaggcagaggctggaaaagtttggagggcttagaagaagacaggaagatttgggaaagtttagaacttcctagagatgtgttgaacggttttgaccaaaatgcttaaagtaatatggacaactaagtcaatgttgaggtcttgatggagataaggaatttgttaggagttggagtataggtcactcttgctatgcagggagactggcagcattttgccccgcagaactttgaacttgagagagatgatttagggtatctggcagaaaaaattctaagtgctaaagcaatcaagaggaagcagagaataaaaggtttgaaaatttgcaacctgatgatgtgagagaaaagaaaatctcattttctggggagaaattcaagccaatagggaaaatgtctcgaggacatgtcagagaacttcacaatagcccctcccatcacaggcctgaagccctaagagggaaaaatggttttgtgcccctcttccgacaacccatgcagcctcaggacatggtgctctgcatcccagctgcttcagctccagccatggctaaaacgggtcagtgtacagctcaggctgttcttcaatgggtacaagccccaagccttggcagcttacacatggtattgggcctgcaggtacacagaagtcaagaatagagctttgtgaacctctgtctagatttcagaggatgtatggaaatgcctggatacccaggcacaagtttgctgtgggagcagagccttcatggagagcctctcctggggaaatgtggaaaggaaatgtggggttggagccccacacagcactgtctagtggaatagtgagaagagggccaccatcatccagaccccacaatggtagatccatccacagcttgcactgtgcacctggaaaggccacagacactgaatgtcagcctgtgaaagcagctgaagggggggcataccctgcaaagccacaggagcagagctgcccaaggctgtgggagctcacctcttggaaaggcataacttggatgtgagacatggagtcaaaggatatcattttggaactttaaagtttaatgactgtcctattggattctgggcttgaatggggcctgaagcccctttgtgttggccaattacctctatgtggaatggatgtatttaaccaatgactgtatccccattgtatctatgatgtaactaactcacttttgatttcacacgtttgtaggcagaagaaacttgccttgtctcagatgagactttggacttgaactttcgagtacatgctggaatgagttaaaactttggggaactgttggaagagcatgattgtgttttgaaatgtgagtacgtgagatttgggagggactaggggtagaatgatatggtttggctgtgtccccacccaaatctcatcttgaattgcagttcccataatcttcacatgtcatgggagggacacagtgggaggttatttaatcgtggggttggttaccctcgtgttgttcttatgacagtgagttctcaccagatataatggtttataaggggtgtttctcccttagctcagcacttctgcttcctgctgccatgtgaaggacatgtttacttccccttctgacatgattgtaagcttcctgaggcctccccagccctatggaactgtgagtttattgaacctcttatctttataaactacccagtcacaggtgtttcttcatagtggtgtgagaatgaactaatacaatctttttcagcttttgtttcttagggatgcaattcaagttaaggtaagagagtagtgtagtataaatcagccttgctaagacttctataaatcatgaattcagcagctaattcaaagcacaattttgtatatggtacaaaagtatctattgtagatgactaatttcaactctaactatcaaagtgacaaaaaaacgagctatcaacatcagccctcctcaaaaatgtatgcactattttactaatagtaacaactaaacaatgagcaatattaggaagattaaaacccataatgtaatgtactgtttgacagccaaagactttaacaatgtcctattctttctagtacctctggacgctttattcttctgctaacgtcagccctcctaatctttcacattacattcctatattgcaccatttcagaattttctgcctcacagttggaatgttaccagatactcctcagtgtatggaccacctgctattgctctcagctcatgtttggagaaaactggtttatgtaaaattttattttttttcttctggtaaatgaaagctaatttgcaatatgtttccatgggaaaattctaggcataaaaattatataaccacatctaaaattgctaaacaatattttttaaaatacttaaaatttaatgataaatcatagtcataagcccataaaataaagtaatatcaaaatgaaaattaggaacacaaaactatgtgctacagggaaaaatataatccaaaagttctcaaacagtctacaatatctataaaatctgtgtattgagtttctactctgcattcagcactgttttatgcccaaacataatacaatattcctgtttcaagtggagaagtttgggctgtatatgggatgttgtttccatacatcagtggccactgaataacaataaaactcacattctattctcatgaaggcatgcttgtaatggctactgccaaatgagactctattttacaatagggtgtgtatttcttatgtatgttttatgtatctcccttatttaaaggatttctttccatatgcttttcttttattaaagttgaagattctgttctactttacttttagacaactaacttttgttgtttattccatagagtctctatttgtttctcaccaatcaatgttgggcatgaagccaggcccaacagaagcccttagtccatggagaattacttttattcacactaccgtaagaattagtatcttaaaaattttccaatatgtgaatgtagtgcttagaaaactttaatcattctacattgcctttggcattacaattaaatatctggcttaatatataaagcctttcacaatttaacttaatggcagttatcttctctccatacaattcactcaacctcaaaacttaaaactacataaccattcgtggttctttgctttttttttctgtttgccaggctgtatctaagttatatcagattactcaagtgtcatctcttttatacaccctttgtgatgcttgcagggtgaatctttcctatggctaatagtttatataaacatctatcatagcttatgtttttagttatatatttacttgcagaacttgttctttgattacaggcattcaccatacatgcctccctctgacttccttcaaaacatacttcagtgactgaactcaacagtcattgtagcttagtagtaaaaacaacgtattcaggggccaagattcttgcctttggatcccagggtcacgtactagctgtctgaccttgagcaagttacttacttaaactttcagtatcataagtttcattactagtgtgctcatactagtgtacagcaggttcttaaataatgttgtttcattcaacatccttccattgtaacattgatgagaaaaaacaaattcctggtgggatccactgcatgtatacagtttgcaccttctccccatgtctgcgtgggttttctctgggtactctggcttcctttcctatctcaaaaatatgtcgtgttcattggtgtatctacatggtgctaaaatgacagagagagagaaacagagaaagagagagagagagtgtgtctgtgtgagtgtgcccttgatagaacagtgtcatgtacaaagtttgttcccaccttgtaccctgagttgcccagaaaggctttggacacctgcgacaggaacaagaaggcgaataattatcttacttgtttttattaatctttcttaaaagtacatatagctcatgtttatttcaatatttaatattataaatatttttatctttatttagaagcttgatgttttcatgaaaagaattatgtcataggaacttgactcttgtttatatcaattaccctatgatcaagtttgttcctatataagttgttttgcatgaagtcgtagttgtcaagaacctatggaggatgttaagtgaggatttgcagtataaaattcttaggttatttggagaaaaatgacttaatataattagtcccataatgtaaagattttagagattgacgtgaagtcagtgttttatgaggatattagaaaaagacaggtgagagacaggatagaaataagaaaaataaatattgaaaacatcgtttccaagaaagaataatttctatatgtaatcataaaattgcagtaatggatggatttactaaaaaatctattccagtgctcagatgaaggaactgaaggcctgtgaagtcacacaagtttaaagcagatataggaataaactcctatttcactggtctcttccagagaggtttttgttttatccttgactaaagtctgcaacgtgttttccttatgtcaaatcttgctcttaatgtttttaggcattctgtgaccttttgttgactacttgacttagctctttctatttgccattactttaaatgtatattataagcctgcattgaagtttttcaaaataaaaacatacccaagctgttcttttccacagatgatttggggaataaaaaaggagaaataatacagtctaatttcactattgaaacagagatcagttgaactaaaacagaagaataaatggggtataaagcagtccactaagatattcataatttcatactgaactctttaggaattgtgatttcttaactagattcatttatttatttgataaagttttactgaataccggctatgtgcctgactcatctattgattagcaagattaacatggttcctacactcacaatgctcacattttgctgtagaattcataataataaaaatcatcataatcataaaacttgaaatagggacaactgatagccatggaagtacttttctgaaaggagtaatattaccatatttcaggttttaaaacgtcatttcagaaaaaatatttggagacagttggaaggaaggtagagtatatgcaaggagaaggagacaaacaagatgctaatgcaacagggcaccaaacaccaagaaataagcaagtaaaacatggagcgggaatcccagttttttgcagaagattaaaagagaagccttgagagacatgtatttggtataatacacaaaatatcatcatgcatttaatatagggagtgagggaatgaaaggcatcagaaataactttcatctctctggcttgagaaacattgagtagacaatggtggcatttaatgagataaggaaaatggagaataatatattttatcgaggtagcgagttgaaggatgatatgaattttgaaccactgagtttgaagtgcacttgaggaactccaacgtgggagagtgttaaatagccaatgctaattagaaacattcattgaaaaatgtatttttaggagaaatcatgacattaaaactagaaagaacatatttttgaataataccatttatattaatgtctgataaacagatacaaagtgcctaaaggattcttttttataaattattgatcattcatttaaatgatactagattagagaatatttacatcacctgctataagagtgacagcatattagccaatggtattcatgctcgactatgcaattcagaagcaacatcaaagaatattcttcattgtgttcataaactttctcttaagtgaataataaagaaaatgtaatgcctagcaacattttctagcaattattcttctgcaatgcatgaatacatatttgtgctattgtagcattaggttcaacctaattaactcagaaaatcatttatgcacaatagcctatctttcatgtacagcagatcatgtacattttctttactttttgcaagttgtatgtaacattagcacacaaaaaaatagtggttgtggttctcggttcttagcactgctgtttatcacatccatgtccatgctagtttttccatgtgtgatttaactaccaagttaaccatttgagattagaccatctcttggatttatgactctgtgcctataatattcgagctgcctataggtctttataagcatatatagcaacacatgttgtcaacaacaacaactgcttagatattaaatagctgaaacctctggaattaggcaaactgtgtgcaaatattaaatattgcttcagaccttgagaaactttttttcaactacctgtgcacatatttcctcacctgtaaaatgaaaccaatgataaaacagaacctccttctttggactatagtaagaatttaatatttaatttttaacaaattcttatggtaaggacttaatatttaattcttgacaaattcttatggtaatgtttaattcttaccaaattcttatgataaggatttaatatttaattcttaccaagttattagggtaagaacttaatatttaaaatattcatttttcagcatatatgaagttcttagaatacctactagcatatgataaaatcttagagaaatttaacaattttattataaattagattgcttaatatataatcatgttacatgagttgagatagtcaatgcaaataaaaaataatcttcactggttatccttttatgttactcagctttcaatttctcataccatctcaaagaaaatgtagctagtagttatttttcagaatctgagaagtgttctgcaaatgtgcgtaataatttttgtcaatgttgaaaatctttaggactttctgtaaagtcgatatttaatgagttgaactattgtctttagcatttatgtcctaatttttggaaggaaacacacacacacatatatatatatataaaatgaaatcctatcttacttgacctaaaactgcacaaaaatttatatttgctgcgtttattttgcattggtaatatcaattttcttccatctgaatacaagtcatttggaaaattccttacatccaagttcttcagctcctatttgttaatcctttctttctttcttttcttttcttttctttttctttttcttttcttttttttttttttttttttgagatggagtctctctctgttacccaggctggagtgcagtggcatgatcttggctcactgcaaactctgcctcccaggttcaaggaattctcctgcctcagccttccccagtctggaaatacaggcacgtgtcaccacacctgcttaatttttttttttttttttttttttttttttttaagtagagacagggttttgctatgtggcccggctggtctcaagttcctgactttgtgatctgcccacctcggcctcccaaagtgctgggattacaggtgtgagccacctcgcctggactatttgttaatcttgatcttgttatatatcaactgctgggttgctccatgattttcacattctcttcctttagtttgtattgtgttggtttttgtttctttcataaaacactaaaaatgtttacatcattttaaaacatttcaaacataaaacaatatcctaagtagcttaacagtagagtccacacatgttgggtattaacgtaaaaacttttaagctcgttataagatcaatcagtctgttcatatcagtactcaatgagaacattaacatgttcaactctgttcagtcattagagaagcatatataaaacatattccaaaaatctaataagctgagtgaatgccaataggccagtaaatattgatataggatgttgctttgatggtaccaatttcattttatatattgtaaggacttccacctactattagagtaaatttcaagctatataatctcacattaagtgtcatttgcaatctgaacccaacaattcaaaataattatgttttaccaactctaataataataagacaaaaaataatggctattacttatcagtaagcaatctgagacctagtaaggatagatgacttatccagggtcatagtgttagctggtgagagagccaggagttgaaatgaggtggtttggcctcagaaactttgcactaagcccctaaatgtattaacaacactacgccaaagccttgccaggaagcgtttcaccatcttccagtgggaagccaagtaaacataaacttttaataaaactgtctgagtactgtcagagaggtataaacacttctaccagacagtaatttttttcaccatcctggaagaccctcaaggtcagggattatattttatttgactttgtattcccagagcctcccatgacacctaccccatagaggacctcattaaatgtgtgctgttgttttatagcaaagtgattccaaagcggtagtagggctagagaaaaaaaaaggctttacagtatgtacgagcgacatttgaactccgtcttaaaaaaataaatataggtactcaaggaagaaacacagagaagaggacatttgagacagagaaaacaacatgtgtgaacaaggcctgaagtgggagaacaatggatatatctaaataataggcgtttggatgtagggaagccagagatagtgtcgggcaagattctggacaggggtttgtggcggtttaggaaggaaaacctttatgtcaggctttcaccttcatagcttcacctgcacagccagggctctgttgcactggaatcagtagagggaatgggtacagtttcaagaagctctccaagagctgggaacaccctatttgtgcctcagcgtggttgaaatttagtctctccatttatgagcattacaaattttaataaaatgcaacaagggcacagttggggagaggttataaatgactaaaacaaaaggagattttaatattgaagagtatagaattaagttttcaaaaagttcgaaacagagtgcttatatataaatataaaataaataaatgtgattgacattaatttattaataacaaaacttgcaagaagataaatctgcttacctggttttaagcattgagaggaactaggagtttatatgcattttgggggaaatatatttaaataatatttttgtgtttacacagaataattataatagcttacagatagtaaaactatcatatttggggttattgtctcccctagacaaaatctataactaacatctatatttacaatgtctaggctctcatcaaataataaatagtgaagtcaacataggtaccttatcccatgtaattcattaatctttacacaagcctcttaaacagtgctccagtatgatagtaaaataccatgtcttccctctccggttgaccttatttccaaggttgagtatctagctagctagctattttaaacaagagcaacctaattctattgatttaaaagacagaataatgatcactgcaggagacagagaaagtgaacagttaaaaaagatgtttcactaagctaagggaggaaggagggcctaaatttagtgttggagattgaggttatgatacaaggtttacagactaaaaagcaataacatgccatgaagtagtttaaccttttatgttttcttgcctctgtacttctgcaccctctcacaccactacatttgtctgcaatatatttcccttatcctttttaaaataaagtttcacttttaataattaaaggtacataataggtatatatatttctatcttattattgatacatagcatttgtatatatttacaggggacatgtgatttttttgttacacgcgtataacatgtaatgatcatgtcatagtatttattccctagaatacttttcatctcaatgcgttaaaaatatttcaaatactctcttgtgtctatttagaaatatacagtacattgttgtttagtaactaaagtttactctcaatcactggaaattattctttctgtttaaatgtatgtttagacccattaacctactctctttatccttcccacatacatttcctagcctctggcatctagcatactagtctataccttcatgatattaccttttttagccccacatatagtgagaacatgtgataattgtttctgtgcctgatttatttcatgtaacataatgacctccattttaccccatgttgctgcaactagtgttatttcatgcatttttatggctgaatagtttttcattgtgtgccaataccatatcttctttacccatttgttggttgatggacacttaagttgattccatatctctgttattgtgaatagtactgtaataaacatgggggtgcaggtatctttttgatatactgatttcttctcttttgaatagatatctgttaatggcattgctggaacatagagcagttctatatttacatttttgagaaatcctcatactgttttccacactgactgcactgattgacattgccaccaacagtgtataagagttcttttttctccacatcctccccagcatttatatatattttttgtcattttgataatagccattctaactggggcaagatggtatctcatgattttgatttacacttccatgatgattagtgatattgaacattttttcatatatatgtaggttctctgtatgtcttattttgagaatgtctagtgcccattttaacaatgtgttgagatccttgtataatctggatattagtcccttgatgaaagagtagtctgcatatattttctcccagttctacagattgtttctttactctgttgattgtttccttagctgtgcagaaatttttctgtttttgttgcttgtgtttttttaggtctcagccataaaatctttgcctagatcaatgtcctgaagtgtttccccaaagttttcttccagtagttttataattttgggtcctaacactatgtctttaattgatcttggctgatttttctatgtagtgagaaataagggtccttttcattctttccatgtggatatctgatcttgccaacaccatttattgaagagggtgtattttccctagtgtaggttcttggtgtctttgtcaaaaatcagctggctgtaaatacacagatttatttttggacaatctatttctgttttatttgtctgtatgtctgtttttgtatcaacattatgctgttttggttgctatagccttgtaatatcttttgaagtcatgtagtgtggtgactccagttttgttcttttcactcaggattgttttgaatatttggcctctttatgggttctacataaatatttttctatttttgtaaaattgccattggcgttttgatagagattgcaatgaatttgtagattgttttggtatggtcactttaatgatgttaattcttccaatccacgagcatggaatctttccatttgtttgtgtcctcttcaattgcttttatcagagttttgtaattttccttgtagaagtatttcagctctttggattactttatttctaggtattttattgtagctgttgtaaatgggattgccttcttgattcttctttcttagctaattcattactggtatatatgaacaccgatttgtgtatgattaatattgtatcctgtaactttatttaatttatatatcaaatctaagaaattttaggtaaaatgtttagattttcctagatagaagattatatcatctgcaaagaggaaaaatttaactttttcttttccagttcgaatgccttttattttttttaatccatctgatgatgctggctaggcctttgagtactatgatgaactgcagttgggaaagtgagcatctttatttttttccagttcttagaggaatggctttccactttttccctttcagtattatgttagctatgagtttttcacatatggcctttgttatgttgaggtatgttcatcctatgcctaatttgttgagtttttatcttaaaggatgttaaattttccctatttctctgtgtctattaagatgatgataagattttgtccttcaccctctttatgtgatgtatcacatttattgattagcatatgttgagcaatctttgcatctgtggaacaaatcccatttgattatggtgcattatcttttgttactgtttgtttcaatttgatagtattttgttgaattattttgcatctttgttcatcaaggatatcaagctgtagtttttttttttttttttttttttttggttattgtttttagactcttgtctggtattggtatgagggtgatgctggcctcacaaaataaattggctgaaattccctcctccccaaatatttaaaataatgtcaggagaaatggtgttagatcttcttcgtaaatttggtcaatttgtcagtgaagcaatccagtctcaaacttttctttgttgggagactttttattgttgatgtaatcttattactcattgttgataagttcaggttttctatttcttcctaattcaatattggcagattatatttttccaggaacttgttcattttttctaggctttcaaattagttagtgtagggttattcgtaatcgtctctggtgatctcttgtatttcagtgctatcagttgtaatgtctccatttttctgatttatttgggtcctctttctttttatcttcattagtctagtgagcagtttataaattttatctttttttggaaaacaactttttgttttgttgaccctttgtattattattttcagcctgtattttgtttagttccactttgattttttattatttctttccttttgctaattttggtttggtgtgttcttgcttttaaaatttattgaggtgtatcattagattgtttatttgaaatctttctactttttaatgtaggcgtttattgctaaaaactttcctcttagtattgttttttttctgaataccatagtttttggtatgttatgtttcaattttcatttgtttcaatacattttttgattcctctcttaattatattcttgacccaatggtcatttagaagcatgttgtttaatttccaaatattaatatagttttcaaagttcttgttattttttattccactgtgttctgagaagatacttggtatattttgattattaaaaaaattgagacttgttttatgtcctacaatatggtctattcttgagaaagttctatgtgctgatcagaagaatgtgtgttctactcctgttggatgaaatgttaggtaaaagtattttatgtttattgggtttaaagtgcaatttaaaggcaatgtttcttttttgatgtttttgtcaagatgatctgtccaatgctgacaatggggtactgaagtcccccaaatattacattattgcagtctatttgtccttattgatctaataatatttgttttatatgtctgggtgctccagtgtttgctgtgcatatatttacagttgttatattcttttgctgaatttattcctttataattgtataataaccttgtctctgctgtttttgattaaaattcaactttatttgatataactgtagctactcctgctcatttttttgcttccatttgcatggaatatctttttccatccctttacattcaatctatatgtttctttacaggtgagatgtgttccttgtaggcagcatatggttgagactttgtaatttttaaaattcatgtctttttgtttgtttgttttagattcttgctctgttgcccagtttggactgcagtggcacgatctctgctcactgcaaattccacctccaaggttcaagcttttctcccacctctgcctcctgagtagctgggactacaggcacgcaccaccacatccggctaatttttgtatttttgattgagaccagattttactatgttggccaggctggttttgaactcctgacctcaagtaatctgcccgcctcagcctcccaaagtgcagggattacaggcatgagccagcatgctgcccccatccctgcctttttttaactattaagccagtctatatcattgaactacaaaatttaatcaatttacattcaactttatttttatatgtgagggcttagtcacatataattcaccacacatacatgcaggtggtggtgaagtcttgctggggacagggccatcaggtgggccagtctttggcccccattggcggcagtgcaggtcaattatgtctttccctaattttcagggctgcatacactagcactggtgtcagcaggtctatgtaagcaggtctatgcaattctgttgtccctgtgtggcttgcttgggtgttggcagtgacagtgatgaactgggtgggtgagtgggtcctctggctccaaggcagtgggtttggtggtaatagtagtggagggtcaatcctctgactctcaagccatctgtactggtgttggtggtggctgtgacaggctgcaatggccagtctctaggcttgcagttggtgcatacatgcgggtactagctgtggtggtagcataggttgagtggactcattttcaagcccctggaaatagtgctcagctgctaatagtgtaggtggggcaggatgatacacaggcccttgaagggtgtgcttgtgcactcaggagggtagagctacatcacatgggccttccctcagccccccggtagtgtttacagtcactggctgtggtatacaggggtggagtgatccccaaacccccaacagaatgtttagatgaaggtggcagaagctgcacttgcagcactgctgtggggttggggtggggaagcagaggttactttcagttttagtacacacgagcagatagctgaggaatgcaagtttcagccctaggtgacagctataaaccgggcagcctttcttcggggtgcttttaagcgtgtggcgaccctgctgctaaaggttgctgggtcactgtcagtgcctcatgctttggtcctagcaacagtagccaccagtggtgcctggctgcaggtgggggaggtcagtggcgttctaggaatctggagaggcagaagttggactctagggcaggatgcaaactggtggggactgggctctcaaaatagcactctgctgtggctgcttaggcttcagtgtgggtatggcacccattcttaactcccttcccagagcaatgctcttgccatccccatgcagcttcctatgatagtttcagtgcccatatgggttgaaggactctaccatggctaagatttcaggaatctgctgtggaaatgtggaccactggggagcatttgcttactctttctccagactaaggagcctctgcatactccttgccaattgtagccaagcgggctgcctcgctttggtctcctttcttgccttaggtgttttctgtcacatctctgttgaattccagcattttttcttaggtgatctattcaaagtgtcattatctactccttattttgtgaaggaggtgagtaccggatgctttccatcagccattttgaaggcgccccttcatctctttattcactgatcaggtacaaagacccttgaaaaatgaatgggttaagggcatcaacaccccacacaattgaaaaaccatacgtgatttttggctactccaaaaattaactaatatccttcccttaactagaagtcttactgataatatattcaattaacatataatcattctgtatgttacatgtattgtacaatatagttttacaacaaagcaagctagaaaaaatgttattaagaaaatcacaaggaaaagaaaacatatttattgtgtattaagtggaagtggatcatcataaagaacttcatcctcatcctctttaagtatgccaaggaggaggaagaagaacaggggttggtcttgctgtctcagtggtggtagaagcagaagaaaatccacatataagtggatgcacaaagcccaaacttgtgttttttaacagtcagctgtattttttctaaaaacgcttctcaggctatccaaacctaaataaacatgtatttattttaactactgtagaaactattgccatgcaatcatttagcaattactcatacaatgtcttatattagtttctgttttatgtgagcagctatttagatctacttttgtttaattttctgaaattatttaatagaagattttatactattggcatatagtaggcatttaaaaaatagctgacttattgcagaatcttctattttaaattttatttatattttttgattttttttttactatagaatatagtttcctgcatattcattacaaaaacatgaggtatgataaaagagcaaagtgttatatttaaaattaatccttcaaacaatgaatcaagtgtaacaatatttccctaggtcagaaactttaaaatacttaattttataagttaaaaagaatgttttggtaaatactgcaaaatacttttaaaattagagctgtatatttttaaacatctttttttcaaaaaagtaattatacatattttgagtaatgctcagtcatagcacagaatataaaacataatttttatatgacactctgatttatgagagcacaaattactttttagcattaagccagtgcaatcatgtgggtcaccttccaaatataaagaaatagggggaaaggaaagtgggcaacttagtaggctatgaataaggtctaaaagagtgtgttcttatatttatgttacaaaaataaagtgtgtcctttttgaaaacaaatcttaaatatattttcaggcagattctacatattgttctgctgcaaaaaatgttgttttaacatgtttcccctaaactgcatgacttagaactaaacataaaaatggtatttggttgctgttccaaatgttatgcaaaaaaaaaaaaaaatcaatttgatgggaaaactagacaaattagtcagtgggaattaggtttattaagaaatttcacctaatttttgttgcttttaatagttgcagttttaactgagtgtgaagaaaagttgccaagatgacatatgtcacatgtttcttcaattcatacatcctcaggcactagccaaaagccactgtatgtgtgtttttttcaaaacccacgtatgaaacaacagaaattcctttaataaataatgattgttatctactatgtatcagccaatgtgctaagcattggaaccctcaagaacgtcatgatctgcaaggaacatataagagacacaaatccagaaaaattaaaattaaaataaaaacgcatggcagtgatagcaacaggcacagtggattgtcgtcaggaaggacgtggggtcaaaagaagatttcagaaggaaataataactgaccacagttttagaaaatgggagcgagcctggaaaggagtggacaggtgtttatgcagacagagttgcacataggtagaggcatgggaagagaggaatgaccagatggtaaaatatatcctatatacagaggagcatgtaaattatcttcacagttgaaaagagttattttttaaaataaactcttctataaccattcttcaccatttttagagtaaaaaattgttgatttaaaaatgtgaggaaacacagacttctacataattgtgtactttgtttcacctaaatgcaggtgacagatagacctcagtgaggtggctttctttttaatacagaatttttatagatcagttttagataatggccacaggagtcattaagagccggaaaatggtaagaagagacaacactagcttaaagtgaatgcaaacacatactctttgagattttgccagatacgagtcaaaaataccttttgaggaagaagttctaagaaagtaaaacataagcaagaatatcttttttaaggggatatttggaagcatattgagcaagttattgccaactaaaacatatccaaagatactggatattgtccttgataaatgttctagaaacttttaggactgagaaatactagggtaagcaatgaagaaagagttggagagaaaaaatttaatggtcattttgtttgagatgagaatgaattttctcgtctgtctctctgtttctgagcacgctatgactgtatgcaagattttcctacttaacttcacagttttccttctattttattgttaacacttccattctcactaatgtggttggtaaaataagtactttaattatttgcttgcacattcaatattaaaataccatgctgtcttcagtttattatgagttcaattttcaagacactataaaaataatataacaatccattaaaagggtattctaaaatattttgtcattaggttattattttattatcttcaagtaaacaagaaatacatgagtaaccctcagcatattataaaaatgtgccaataaatttaaagaaaatttataaacataggaattctaataatttttctatatacatgaaggtgattattccaaattccattagattttctaaagtattatatattttgttatttttaaattctctataaacataattgtgaagccactttaatcaaataattagaaacaataatttgcaagcttgcaaaagaacacattacatatacatcttttaaacaattaaaatctaaagagtgattcctgataaagtaaatttagtgtaaacagaaatgcaaataaataaaactttcatttctatattcgaattgcaaaaaaatttgcaataatgaatatgctatttttcttgcttgtaaattatggtcaaaagatgtctgctgaatccatcacaatagtatcctaatttctcaactagaagaaattttagcaataaaaattaagtttagaatgataccaaagcttagattcttcaatacaaagaaaaaaaaatagtctcaaatcaatccttgttttacagatgaggaaaaattggatccaaaaatattaagtgatttgttcagttatccaggtaggaatttcaggatcaaaacaggaattgggtttgttatgtcaaatcctatgctaaagcctgtaaataagcttcttccaggtcattaagtcacctctatgaaagtatttatctcagtagttcatatgatgacgatcctttttaaatgtaatcaactaaggtagtactccctaaggatagggttaaacacagcaggttctcaggacaggctgctgataaatagacagagatctaagtgtgtagtaaggaagaacagtctatgactgagttagttaatggacgaagtataatccataggaattttttatatgcctttgaattacataatttattaacaaaacactaaacaaaacataaacctctctgaagctacaaatgtcacatgactgaaatcctggcatattttgctaaatagaatacagtaaacaatcaacactgattttgataaaatgtttcgaggtttttcaatgaaacaaattctttgaacagagtgaaaattaatttttacagattatatcaatacaaatgttacataaaacaatttcttaaaaggaataaaaactaagttctacagattatataaatacgtccaacctcttttacatggaaaacagtatgaaatttagcctattctgatatgttttcacaattttatataatctacaacttattctcctaaacttttttttaatgttagacttttaattgggctacttacaacaaagaacaaaatgttttatcatacatttttccaagtattttatataagtgtaattaagtttcatcatgcaggttcaagtcgcattgccacgattaagtggctgtgaactattgatttgacttatttaacatttcagtaacgactaatgccagtgattattgcactgtatggaagttgcaaaaaataattataatattcaacgtttattttacttgaaacttaaaactttatttaagaacatgaccagccatcttaatttaccttctaactaaatcattgtttgagttgtatatgtttggaaaatttatgtaacatttttaagccttaatatcactatttataaaattccgattacaattcttacttgcaagatccctatacatattacagattatgcatgtaaagcaactaataaagtgtttggcacccaaatcttaattcacttgcatttaatcatgctggacctatacagacctttaaacagtacagcaattataatcatattatatttttttctgaaatatatcttatttatacatatttattcagataagcaaaacataattagcagaaataaaaatcagtgtcatttattatcatttttgcattgcctctgagggcaagagatttctattagaaaactggtatctgtgatatttatggacatagctgcaggtaaagatgatgatgatgattgtgcaggaatgccatatgaattatttcaaaagtggtaataaacttatattgatccatttttacataaactgtcaacaaattcccccaaggccaggccttaacccattatatatatataatgaaagtgttaaagcttgtagcataggtcctggaagtgccctataaatgtaatcactatgcatattggatgtaatcactatgcatatgatatatatacatatatgcatatatatatgcatagtgattacatatatatatatatatgcatagtgattacatttatagggcacttccaggacctatgctacaagctttaacactttcattcataataagttacatggtctttttataacactatgataaggctattttctctacttaataaatgaaatacttaagtgcctgactgaagattacacacatagcataaccagattgcaaatatagggagtctgaatccacaaggcatacactcaaggcccctcatgctgcctgatgttgctgctgtagaaaggacacagataaatagaaagtaccatgactgactgttgtctagagttctttatctctgtattttgaaatcaacagattatctaatggattaagataacataatcattttctttcagatgaacagctgtgatcaatttagcaggtggtaactttttttccccagtgaaatgggaaaatgttagggtacattacaggtaataaggtaaattatttgataaaattttcatttcagttgcatatatgcatgtatgtatactggatcattatataaaaggtgtttcttttaggttataatccaaagaagttttgaaagctgagtttttttaaaagggtgatcagaaatttggaggaaagacagaattgtttgttcataacatgtactttcaattttgtggttatgtttcaactctttacactatttaccttcagacttctagaaaccttttctacactccaggttctttttgtggtcatctgttattctgtggtcatctatgaatgaacaagcatacaggcccatcatggggtcaaacctgtaatcctgattccatcatcactcttctctcctatcttcaatttgtcatcaatttctaaagatatattagatttgcattcttctttccagtatcaaattttcattaatttatttcagacaccatttctctttccttaatttctgttccaacttccttctttgcctccagcctatcttgtttaatccattctccttagtgctactgagggagcctcctaatccataaataggatcatgttacctccctgataatttatttacatctttctcattaagctgacaataaggtgaggctcttcatggttcagctgtaacttactccagccttatctctcagaactcatgacttaaatactacaaaatagttcatgcaaaaatctgaaattttctcagagtactttctgctccatttttctgaaaatgttctcccttttcctttcctcacacatactcctctttggccaattcctacatatcctttagtcctcatatgataagccattgctcaggaagccctcctggatcctttatttcttggttgggcatccctattagtgttctttttatttttattactgttcctataacaacactcatcatgatgtgctagaattgcatctctacgcatctgcgtccatcaccaaacagtaaattctttgagatcagtgagtatgtgttttgcacacagagtatggcatagggcctgttgtgtactacattcttataaagcatgtgtgttgaatgaatgaacgaatatattttttaacttttattttttcttcttgagacagagtctcactctatcacccaggctgatgtgcagggatgcaatcttggctcactgcagccttcgacttctgggttcaacaattctcacgcctgagcctccccagtagctgggattacaggcgtgtgccaacacgttcaactaatttatgtattaatatattttagtagagacaggctgttctcaaactcctgagctcaagagatctgcccaccttgtcctcccaaagtgctgggattacaggcatgagctactgcactcagccaaataaacaaataatttttctttttaaaatgaaatacttacttggcagagaccacctactgttacgcaatcattctatagtctttaaaatctaacactaatttcaggtatcaaaatttatatttttaaatgtttatatatttattgtcatgtgagattttatggtggtcaagttcaaagggcccaaatatctagtcgccctaataatattttcagtgtttttcaaaagcttacagattttgatcatttactaatgacactccactgctcactcaaagctacactgactagcacaaatatcctgcttctttgcttagagtgaggctgctagttggcgcattttgatgagaaattccaatcggcaggcatatgcagatttggatattttttaaaaaatgaaataagacattttaaaagtaacaggtttacagagaaaaagtttactaaaacaggtcctaaggaaaaagactttgaaaccagttacctagcaaactataaaagctaaatgccccaaattgtaatgatagccagttgcaccaaaattcaatgttattcatattttatttttcaagataaaaaagttactatgtattgccaagtttgaaactgaatgctctatctcattcctttaagccaaatctttacaagaaaaggatttctacttcaaaagaaagtgacacaatactcataattaacataaaaataagcatttgcctaatttcaggagagtacattaagtcattagtataagtggtgttttgctttgcactctctttacattattccatctctttccatctgggagcaaacttaacaagcaatttaaaaataattggtgaattaaattgtcattggtggcctcattttcctttttcgcgtatgtcttcaacagacttactctagcagtaccattaatacagctgcggtaaaaaaaatctgtgcaaatggcatgttataaaattaaatggtaacatattgtgttgcttgggatcacagtcaagtctagaggcaaaatagaaataacagatgcaatacaaatgtagagttattatgtgtgtcatactggaatctagcctcacaaaattagcacaatatgctctacctgaggataagctagggaaaagaaaaaaaaaaaaaagaaagaaagaaggaagattgtgccagcaacataaatggagacatagaaacattttaatcttaatatggtaatacgttttgaaaagaaattgtacatagattttttatttaaaatttcagaccaagagaaatgccttctatattaatatagttctccaaaatgttttttggatcatgaaatttctgacattccttttgaatttagtgaatttactagtttgaatggtcctaattaaattcttccctaaagctatttacagaggtacctcctgattttattagtcctttagtgatgctgcatgtctggtttggagagtaacttccagcaaatgaatagtatttatgcttaaaacttaaatgtgtgtgtgtaacatattgaatacgtaatttaatataatatctttaatactatgctttactaattatctaatttatgtgtgatacatcatatcatcatatagctgcctgggtttgttttgaattgtaatccaaaattaattatctcaattataataacttttatctttacattaaaaagtaaaagatcccttttcctcatcctcatagaaaaaaataagaatgttaaaaagaatcaaaactatgttttttggtgaaattactggctccatttatttgccctcccgctacttatgcttttttccatataactttgcagttccttctctaaaaattccctctacttacccgtttctgaacaaaaatatctcacttctcacagaaaaaaatgagggatttgaaaaaataatactgttaaattatataaacatatagtaagcattttcttacaactgtgagtgtaaatgatgtcacattgcatttactatccaccattcactacctcacttcaccgcctcagctaccacaactctcagaataagtacccatctccagaaaaaactcttgagtctgtttttagtgatttgatttagatgagtgttaaattatttgcctcgaaatataattatgactcactagagttgaaaataaaaattactattataatgagttctatgagctagatgaacaagtctacacaccatttgtaaagtacagtggttttgctagctagttggtagaatcacgatcaagtgatgccatcttggccagccatcagcaaactgtaatagctgatactgataattatgaataacagcaaacttgaaaataattacataattaaatacttatttgtgtaatgagctgcttttagaatctatgccagtgggtcaagtaagaagaagtaattggatcagtaggagacatttagtagttaagagacttgcttgtgcacacctaaaaactcaatggaggttaagtagcatatcactgccaaagagattctctagcactggtgggcctcagcaaaaccgtaagtggccttgtgagactgtgggactttagcacattactgcaatagactcataatcttatctaaatcaaagactctgaaaaaaagtgttatttgctacttaaaatgcaaaccattctacttcaaaatatatagaggagaaagaggacttgtcccaagataaaatgtgtcacatttgacaactatcaaccttatcagagtctaaaacttatatgaatacatgctgaaagtggatgctcttagttgtatttatccccattattaaacctaaatagagaagatcaaagccaaggactggaattttgaattattagtagctacaaatttctttcttaaagctttctggggcaagtgattgtcaacttcatagagtagaaaatcaaattaaaatggaataaatattattattctgaagacaagtgttccttttttcatagaaacattaaaagtatttgctaagtatgataaaacacgtatttctagaaaacagcagatataagacagtgattttcatttttttctatcgacagtataaacattagtatagaagtatgagagcccgtattgctgatgtttggagactaacattccttgcaaagagatgtctatgtcctttccaactctaataatctgtgattctataatttgatattaagcgaagattttagtaacacctaatttctgaattgaaaagaatttttaaaattctcacccacttactcaatacttgattttcttctatatgaatagcacagtcatatagttcatgcttgagccaaatttatattagcctaaatacatttttgatgaaatatttttgtttcacaaaaattcttatattacaaaattttctctaatatatatatgcttactgcattttaaatcggtctggcgctactggaaattgcttcatattaaattataagaaatttaataatcaataataagtatttggctgggttaaccatatttcttacataacaaatgctgataaatatatgtgtgtgtgtgtgtttgtgtacatactcttgtcaaattctaattaacaaaaatgtttaaaatatgttgataaatgcaaataaacattcacaatattattatgatttcatacatgttttgcatcaaaaatggcaacttgctattatattaatagctacattttaattggggtctcactaatctagaggctactctaatagcttccatgtattgaatgcttcctttgtctggaaagatagacttttatatgttaacattggtaatttctgggtgatgggactgcacatcattttatcttgtaattcttgattttgatatttctacaatgaacaaacattaaaaacacgattttaagatgttataaaatatatattatcctatttctcttttatttttatttttcaatagtttttaatttttatacaagctttggtcagtgagtaatggtacttccacagagtacataagatttcaatgtccaaagcaagtcagtctgtattgcatatattcagagctccatcaagtaaaattcaatgttaatacagaggtaagtgttaacagagaggaacaatgaaaaatcctatttaggacctgacttcaaatctcataagggatcagaaataccactgtactgctgaaagtgttttcctaggaaaaacagttttcatagcatagctcgctgagaactaactgatttttggcaattagatcacccatttttgagttaaaaaaagataacaattgaatatcatttgaacttctaatacctattaagaaaaaagttatttaaaaatgtttggaatttttggttggaaatctatgcagttttgaaattaaaatatcgattgtgagaatagtctcattcaaagttgaaatacactcttcagtaacaaaataatactgaaaagggtgagtgcaatgacaagaacatcatatgaacagatattatattctggaaaaagtataaaagcagattcaagtgatagagattgatatcccaattaaattaaaagaatgcccagaaaatcagcataattttcaataaaaatgatactttattatgagtaggtaagtagagagtgtatttatttagatgctccccactggtgtccttgtgaaaatggatgtcaattgtgtcaataataagcaatgctacttgcacctcaatttctcagaaggtgttcaggaaaagaaggtaccaggtaccttagcaggcaatgggaatgaggttgggatatttgaaaaataaaaaagggaaagattaactgaaacacttgtaaggagatttagatctccaaaattcttctttaactcacaatcaattgacttcagatttgcctatgcccatatatcacccctcacacatcaagattagaagcaagcacatatagcagtggcgaggtagtgaatagaacaaagtagccatttgtagcccagaatcagaaatgtaggaagtgatccagagaatagagcttgcatactgactgcagggggactatgcaaggagtaaaatattaatttctaggcaggtaccagaatctaaacaatgataagcaggtatatatctaccagctatcagaaacaaacatggcagagattcaaagtagagagtcaggcagactaataaaagataacagtagtcaaacagtatagaaacaatgtaatgatcacaaatgattctgtttctgccatccttcttctaaaattctatatgtgacagaaagtctaaaatgaaacaaaataatatggaaattataattaaaaattattcttgactgagttacagtcaacatgaacatagggatatggacaacagcaacattagaggggtcatatttgcagggtctttctggagtcaagtgaatttggaattacaacatggtatgtgtttaatgctcagcaattatgttatgagcaaacaacaagttatattggtgtgggattttgagcaaaattgctttatttattttatttattttatgaagggagaggaccaaattttaaatttcagttgaggctttccatttgcagaaatggtagattttcattttaggaatcttccattagataatgtcagctcctaatacttctcattctcttgtaatttctttttttattaaattgagattctcagtgaggtcatagtgtaatggagaaaaaataggtctgcgagaaaattgtgatgtctttaccaacagaaggtgataggatcgcaggtgataaaaacaaatgaaataaaagaaacagaaaacctaaagaaatcaatcctatactttgtccactccattttttttctcctttatttcttccactttttcttttgaaaggtacccttttagttccaaaaatgtagagaagagtatattcattattttagtttttgttttctttcaattgctttaaaatatttttctatttgatcctaacattcaccctatcaaaaagatattttgaatgttttgacaaataagggtgatgatgttcagatttcagtgatgcacttagtaattagcagagcctgtatccaaacttgagtttgacacatttttaatacctatgctattccttacaagctatgttaggttatagatgatttttcccactgtccaaaactaattttttatgtccttcataatcttcagaaatgtgttttgccactttaaggaggaaaaattgtctgtaaaatccaaaacagcaattttgctgttgcaatggaacccaacgagtgatgccagcccactgaattgaacagaaagacagtgatgattctttgtgaagagaaaaaatatacatacacctctataatgtgaacagagcataataagtggcatttttgcaatttggctgcttgacatcctgtgtgaagttctgaatatcctttttttgagcataaagcaaggacatggctttttttccccttcatgcactcaagggactcactcaaacacctaataatgctgttcaacctttaatacattcataatggaattccccagttagcgtgttttcacttgcctgggtagaggcaccagctacaacctcttcaaatacttaaaagaaaatactgttcacattaattgtaagaatcttcaaaagaatgctagaatacctcaaatggaaaattcacaagtagtagcagacaagaagacatagagcataggagtgaatagtagctataaatcagatacaagccacattaatgaattgagataagaagtgtgaaataaaatcgatccccgctcatcagagaaggaggagagggttatttttaatcttgggatgaatttaaaatcaataaaaaagtataatagtctcataaacagaaatcgaacgacaatgcaaggagttggaaaaaaattaaaaacaaagggaaaaaagtacaccaatttacttcaacagttacaagaagccttgtttgatagtgttaactgtattcataatgaacatgtgtatagagccttttaaaacatcccatcaagcactgcacagctgaatgtgaccactcaaataatatttggtgaacataaagaagaatgcccataaataataatcttccaagtcaaacatcttagatctaaaagttaaggctacaggaagagtgagaactctttgtgtgaagacactcataattaacaatatataagcaactacataaggctgaaataggcagggattgtgaaattccacaatatgagaacacttattttcttcttttcctctcataaattttgttcagaataccaatttggggaatcaagcagaagtaatccctgctaatagtgctgacactatgtcaaaagttttgagcaataaaaaaaaatctccgactttctatataccagaaactttcattttaccctagaaaatcaaaggacccctttaactaaaaatgtgtttctagaaaagtgttccaaaatacgtcatatggggatctagctcctcagccaagcaattgagcctcttttccttttgtaagcagcatatcaaagtaaggccaaagttggatactaagaaaagaatggagttacttatatttaatatttaggatacaaaataagagcaaagtataattgcataatgcttgctacatttcaaatttgtctccttctggaaggaccttcatctctgctccctgaaagccaaaaacaacaggctactatttttgtttttcatgaagctagatattagccagttgctagacttcaactgtgatatattcatgagaagacacaagctggagaatttcagcctagtctaagcaggacagatggagttgctttttacctttatacagatcacgagtttttagccatttatttttcaaaagtctagccttcagcagggagcatccatatgcgtgtgtgcaattcacattgagttctgaaacaagacttctggtttatccataaatctggcaaaataaattctcgaggcatagcctggcaacaaagaacttgaataaattctttaaagctcttttgtagtgaaataatattagaagttggggcaaagacaaagccatgagaggtgttgatctctaacagttttatgaaaagatgtttaagtaacttttcagtggcatcaatttaaaaatctagtcaatgatgtaacgttgaggatggagtttgctgacttttatcttccatgagcagtcagactaaccaggtgttagtaatttgaatctaagcaataaagactgtgaagccacattgatatagttaccataaatgggaatcagtgagtcccaccagcgtcacagagaacaattcagtcagtagcttgggcagggccctgctagtcattaacaactccattaagctaagacagaaactggaagcattgcccagagaggtaatcagaagcactatgctcccaagactttccttaacaggtgctcattttcatcctggtaagatttagaactaagcatatacatatttaagagaatcatattagagtatggatatttgaaatctatcaatatttactattttatattcttaaaatatttcagataatttgcctttttgaatcacatttgtacttatgatgtataattaagtaatttacatacagttatattaaacttagatctattaatttcacatagtagaggctactagttattcccaaatatgttcattcttcctttctttcttcctttcccttccttccttcctttcttttctttctttctttttaaaatactgctccttcctgtacactgattttttttcctttcttgttagcagtaaaaatcttgattttttttgtaagtctaaaagactgtaaaaccttccattctctgctcagttatttgtgatgttaggactgagttctaactacttaaatgtatttatagtgctatataaaacttccagaaagcatctttgggggaacaggggcttgcccttttcttcttctctccattctctttcttgggactctactttaatgattccagtttaagcagccattatagaccatgagattaaggattagaccgtggccatggaataatgttgatctgggaggaaggtgagttaatgaggtcttcagagagctgcagtactagctgctggtttcatatatctagacttctttcataaaacgcaaactgccattcatacttgtcattattatatatttgggaggttctatatttcaagaagctaagccatataataaatagtttgtatttaaaaagtcagagtattttaaaaggatatatgcataatggaatactattcagccataaaaaggaaggaaatgatttctttgcagcaacatggaaggaactacaggccataatcttaagtgaaacaactaaaacacagaaagacaaatatcacatgttttcacttaaaaatgggagctaaataatgtgtacacatggacgtaaagtgtggaatgattgaaaatggagactcagaagggtgaagaatgggattggggttcaccatgggaaattaattaatgtatacaagtgtgtgttattctggtgacggatacactaaaagccctgacttcaccactacccaatgtgttcatgtagcaaaattacactgttgtcacataaatttatacaaataaaaataaatcactaaaattacaacttttcccttattagctttatgaggtttatttaagtactcatgagtggtgtctttcagtcaaaataactacaaaggaaattttctatctagatttatataactgatataaaatatctctatagatctatccgtacatcaatatctatcaattacttctaaaggttattaactatacagttttctaaaaggatccacacattaatcaagtccccttctcctcttaaagtcatagtcaaaagttgttagaagttgctataaatataagtaaataatatggttttgtaggctaaacccagatagtaaaggaactaaactaatattgtaatgtcctagcctttcattttaaacaaacaataaaaatgcatatatacacaaaactgttttcttatgcaaaatgctgataagcattttttctaaaataaatcaaggtcacgtgatcaaagtgaagcttttgacaaattagactagtttgataacctgggttttaaagaaactgtatcctttttccttgattttagaagagaacagcaaaagataattataaattttattttaaaatataatgtgtatttttctcactaaaagacgagttaatatgaaattcctaaacttttcatactgttttactattgagctaacattactttcacatataagtaaaataaatttaaaactatgttttcaatcaaattagattataattttaagaaacatttttatagtaatggaatatagttttgaacttatattaaacccaaattaattggatacttggattatttttaactaaagtagaatattaaaatattggttaccagcgtaattttgacatacattcctttgattcttatttttacatgttatagagtagcaataacttagggccgtgtttgaaaatgtcttaatgtttgcctttttaaggtatggtaaaaaaaaaaatgtgtatggccgtcagatatcatactatatgtattcattagcatagctgtagtgttagacaaatctaaaccccatttcactccatgatgtagaagttaaatactaaaaattatgttaatatgggtaatttaaaatatactagaatcagtactggcagataagaagaattgtgtatgaaaagaaagataatgcacttttgtttattaagggaaaatgagagcagttttatcctaaagtgaagtatcagttattttcagatgtgaaatagaatagtaaatgataaaacctaagcaaatacaggaagtcatagtttttggaaacgagaatttaattatcttagattataatatcaaaaaataaggaatctcaaaaaatgtagtagaatatgttaaaattttcccaagagtaggttagttttcatggttggtcagttaatactgaaagcataaagaagcttgtgaatcttttactgccaaatattaacagcgcaaaattagactatttctattgaaataataaattaatcttgaattacttagtctgattttaacaatatataataattattttccttccatgtaaccttctgacatgaatggctcaccagagttgtttcctgtgtgttgtgctgaatttattatgccctggatcaatcaattctgaaggagctaagataccattaaattgggttaatactttctgtttatttaaaatattgtattttcccttgattaacttgtattcaagccatgaccttttattgttctcaaatactgatattaatattctaatcaagtgaatagatccctctgataactcttgacattttcttctcaaaattaattcctaaatttagaaaaatacaatttagtgtgccttttatacctaatactatcttcgtgatatctcagatgatcacagaaaaatcacaaatgtttgtcttttactctataaaaaagagtaatgctgaaaataattatagttgttggatatgctcctcatttcttacatagctcaacactatgatgagagctacaagaggagttgttaaacaaaagccttctctaagatagttttgttcaggaaaaacatatattgataattctctggagtgtagagtctctgaaatacatacatcatacacacatacaggcatacattagagagaagagagagatgtacatatacatattctggagactacattctggagatttataaatatccttatacttatttttaacctcagaacataattactaaatacccttatgactaaatatatattataccttaatagatcttactattctttatccttatgtgttggtcctctaataaatttgccatagccatttaattctgtctttgccaggttaagatttgcttgcttgcttgcttgcttgcttgatttcaactgtcctgtcttcaatttcaaatgaggaaaataatatccacaagtgcacctaggtaaaatgtttagttcaataactggcatgtgatcagaattaaattataaatctgatcctaaaatgaaaactcaaaatgagaaagcattaggattatatttctgcttctctgacatgaacactttataattaattgaagagaaatgttgagtggctaacagccagaggaacaagcatggctgtcaatgcatcttgactttctaattcctcatacaggaactttaaaagttagcatatggctgagcatggtggctcatgcctataatcccagcactttgggaggctgaggcgggcgaatcacgaggtcaggagatcgagaccatcctggctaacacggtgaaactctgtctctattaaaaacacaaaaaattagatgggcgtggtggcgggtgcctgtagtcccaactactcgggaggctgaggcaggagaatggcatgaacccgggaggcagagcttgcagtgagctgagatcacgccactgcactccagcctgggtgacagagcaagactatgtctcaaaaataaataaataaataataaataactaataaataaataaataatgtctcaaaaataaataattttttaataaaaaaatttttaaaaaagttatcatatgatatgtcctcaagtttatgttgaaaatgtaaatcacaggtttttaaactttgccacgtaacagaatcagctgtataactttaaaaacacacatatgccatcccacccgatccgctgaatcagaatgtctgaagtagagtattttacaaatcttcatcaaaaatatcaatgactagtaaaagtcaaaatactgatcatattaactgaatatttcatatgtagggctttttgtcaatttactattttttacctgaaataaatgattttgtgaagatataaaattaggagagaccattttacataggtgtattccaaaaatatcacctttccttaagtcagatactgaagtaatgctccaaaacccaacaattacatgttactccagatgcattagctttaatggcattgggtggtggtttaatttttagcccaccctggccagggatatttccttagtgacagcagtatggtctgcagcaaatgtgaactttaggaaatgcactaacgtataagggaaaggcagctatcagcattcagtcttctctgaaggtaagtatagcaaattaagagagatgtagtagaaatgcagtagcagttaagggatcaattcaaagttatcagaaaagggtatcttgtaggacaagttcaaagctgaagattgaattttaaatgttattgtgtgttacatgcaagtctcttctcatattttaaatttcttaacaaaatccactaacaaagtattatccctatgatgtctcaaaaaaaaaaagaaagaaaagttaaaaaaaaaaaagaaatgaaactccaagaaatatgatcaaattcacacagttaacaactggaaaattctgaatgtaaagatagctttttcaagtatctaagttctttcttcaacagtccacatagttttaagaaaccaaaactacattaccttgtaacttcccaggttaggtttatagagtagatgattagaaagtaataagttcttaagaggttaagaagagaaatttaacttattcctttgatattgctagggaagaaataaagaaagcagtggggacaatttcttgtagttggaaccccttatatcattttttatttttcatttttaagagcaatacagagaagattcatcaatctatgttcaggtagtaattgctttttactactttaagctcatctgtaaaaatcaaagtgaaactgactaggttttacgatattttctgaaaagtcaaaattctggtctttgctatcccttttaggaatatatggtaaaagtttccctatttgctcattactgattcatctgcataatgaagagttaaaatcttattgagaaatgccttgcaatcagttgagaatctaattgtacctgtttggaaaggttagttacaaaagcacccacggtgatccaaacttatattacacatcctctgattatcacatttaaagtaatatgtcatttgttattcatatttagtgttacaactctttaataaccactcaatctatttccctttaaaaggacagctgcaataacagcaaaattgtaaaccttaagtgtagcgtaagaattcaaggtgaaacacattccaagtagtagcttaaaatgtcagtatcatacatggctccctgaataaaagaggcaagacgtgtcaacctgaacagacattcatctctttgcactaaagtgagagatacaaagacctgtaccactcccagtagagagatgtgctgagacattcaagagtcaaagacgctcagctgtctgaggcaaatactgtgagtcttcaggtctctgtaaattgttctacagctgtgaaggattcaaagtaaaatttcagaatgatcataaatgaataaaatgtggtggattatagtagttactgtctttggctgtccgtaatttattatgttgctacttcttgtaactgtacagtagttctcctttattcaagtgcttgctttccatggtttcagttgcctacactcaactgtgttccaaaattattaaatggataattctagaaataaacaagtcataagtttcaaattgtgtgccattctgagtagcatgataaaatctgttacacctctccattccttttttatcacaagaataaggatgagtacagtactataaggtattttaagagacagactacattcacataacttttattacagtgtattgttataactgttcaatcttattattagggttgttaatctcttactgcctttaatttataaattaaactttatcccagtgtactagtctgttttcatgctgctgataaagacatacctgagactgggcgattcacaaaagacagaagtttaatggacttacagttccacatggctggagaggcctcacaataatggtggaaggcaaggaggagcaagacatgtcttacatagatggcagcaggcaaagagagagaatttgtgcagagaactcctctttataaaaccatcaaattttgtgagacttattcactgtcactagaacagcaccagaaagacttgccctcatgattcaattacctcccactgggtccctccctcaatacatgggaattcaagatgagatttaggtgggaacacagtcaaccatatcacacagttatataagtataggaaaaatgtagtataaatagggttcagtattatccatggtcttaggcatccactgggggtcttgggatatattgtctgtggataagaggggactaatgtattttcatttctctgggggtgggggcaaacaaaactcatagaatggatagattatggtgcctcctacacctacccaaccaagtgaaaccagcattttacatcagagtaccttattttcactgaacacagatattggcatattgtatcctgtcacccctgcatagaattttctaaattagaagagatggatacatctattttgctctttgattgtgaactttaaagtgtatgtttggagagaaccactctaaagagaaaacatctagagtgggagatgacaatcttaaacttcacccaaatccagtgaccctgaaaaaaaaaatgaaggttaagaaactcccccacccgactgtaaactagttcagccattgtggaagtcagtgtggcgattcctcagggatctagaactagaaataccatttgacccagccatcccattactgggtatatagcaaaggactagaaatcatgctgctacaaagacacatgcacacgtatttttattgcggcactattcacaatagcaaagatttggaaccaatccaaatatccaacaatgatagactggattaagaaaatgtggcacatatacaccatggaatactatacagccataaaaaatgatgagttcatgtcctttgtagggacatggatgaaatcggaaatcatcattctcagtaaactatcgcaaggacaaaaaaccaaacactgcatgttctcactcataggtgggaattgaacaatgagaacacatggacacaggaaggggaacatcacactctggggattgttgtggggtagggggaggggggagggatagcattaggagatatacctaatgctaaatgacgagttaatgggtgcagcacaccagcatggcacatgtatacatatgtaactaacctgcacattgtgcacatgtaccctaaaagtataataataaaataataataataaaaagaaactcccccacccttttgtattccagagaatggcttactgcaaagaatcaccctttcccatacaacttagataagacccacagatggatcccttttttatctatgaaaagatcagacacagatcctccaaattcacattgttgcctcataaatgattggctaaactgttttttctccactgattaactggaacaaaatagattttaaccaatttcggttaagtttctctctttctgccacatctctaaactttgacccatcttcagcctgaatcagtgtagcaattctccggagattaggtaggccgcagagtaaaactttctctgctctatgatgcagccaatcatgccaccctttcatgccacatataaccttacctacttctccctagaaaagacataccctttttgcctaacccttgtgaggctggcagatattatggtcatagtttttttctctattttaatagtccctttcttcacctcacaataattcttttgaatagggtctctctttgctaaatccagattcctctttttgactttgaaaatgaaggccacagccaaggaaagtcagaggcaaggaaggacaagaagtaaaagaggatgtcttggtggggttgaatccattgctcaattctggaggccctactttatgcagccctacagttgtctaacccacaacctttgactttagcatggagttcatgctctgatagctttcaactaaagcagccattctctcctctccccagctcttttctttctctgttgatacagataatattttgtatttgagggtctgaaacttttcaaaattcaaatgtcatggattgaaactactgtccttgcacagagtgtgagaatcaggtggtgtggggggaagtgctaataatggtctatgatccccagaaagcaacctatgttctaatgtaatttctacattcatattaaaatttagagatgattttatgttaataactcatctgcaaaagtgcaaatatatgtggctatatataatgtatatgaagcagtatgataaagtaaggagatatgtctcatgtagcaatgcaaatttgagtttaaatccctgttgtgtaatttttttctaaatagcttctgcatctataaaagaaaatatatctcctttattaagagattgttgtgataactacatgagataatactgacacgttttacatagaactcgatccataataagtactgaataaacaatatttgctactaccatttacattctaagtttaagagtagcattcagaaataagagaggatataatttccttgagaagaatgcccttgataatctctggtccttccatagagataataaaagttagagaaaggacaaatggggagcttttcttttttattcatctcatatttaaactttgtaatcacctttggattctctcttattaaccacctctaacttatcttcccccatccatgcaatatttactggatctatttcaggtctgtgtccaaaactttagttttctactctttgagttcaatgtcacattacttgtctctcaaatggatttcacaatagtctcctatttggtccttttcaagtcagattttgctttcacacactccactgaatgtgctctcttcttaataaaaaatctacaagcattcctctattactttaaaatcatttcagaaatcttaagaataggactctgtttcagataagggtaaaattctggacttcaagtaaaacatgaaaactagattaaatttcaggttattgtttctcacaggggaaatatgatgggaggattgtgctttacatatccttggaaagatgtttgccttgggatgttttttacccaaaacggtgactatagttatgttacctgcgactcaatatgcattcttcttttcttcttcactagtattacttcagtttggtcaggggctggcaattttttcaatttaaaatttcatttcctagatttacatttccatgaaactaagtttccaagtggaaacttccagtttcctggagaggaagtcctttggagagagttttgttttctttatgtagacaccaccactctttccttcttgctgcttccaccttcctcataatgtctgaaattaaggtctggggttttgagatacaggaactattttgcaaccatgaaacaagtcacacattgaagatggcacagttgaaagagagaagctgatactaggacatttgtgatagcatcaagccactgcatcacccagagctgcccactccagagttcattcaactatacaaaacaaacctttatttgataaagctaccatctctgaaggttttcttttcatgcattttatctgaataccaattgtgataggatgcccaaatagttttcaccttttctccaacatttatactaagctcaactctgaacactgcgatgatagaaatttaaaacttgagagagcttatctcagcctctcaatacttcccttattttaaaagttttaatggaaaaatttcaaacatatatttaaaaatagtaaatactatgaaatgcagtcacttatccattgcccaaactcaagattatcagcttacgaccacccttgttgtatccataactttacccgttctgtattattgtacatagagagggtaatgtatgcctaaacacattatcacattaccaaggaacacttattaacccacgcctcactgcagtgcactctcctgcagtcccctggcactggaccatagtgcttttgttggcagcacttgtgggagtgttactgccagtggacttggaatatcttggcctttccagcacatcaagcaattgacctcaaggggccagagaacaaagccacatcctggtccaagccatccagggttagagcaggaagcccaggagtgctgagcttagctttagtcccctgaaagcataaagaaagaaagccaattgactaaacccaatttgtaccacaggaaaaaaaaaaaaaccctcaagggcaccaaacaatataaaagcacaaatccccatccaaaggaaagaaacttcaaagattaaaagaacattagcccccacagctgagaaagaaccagcacaagaattctggtgactataaaacccagagtgtctttttacttctaaatgactgcactaactccccagcaatggttctcatgcagattgaaatggctaaaatgacagacatagaatttggaatctcgatgacatgtaacctcaggaagatacaggagaaggttgaaaccaaatccaaagaaagcagcaaaacaatccaatatttgaaagatggtacagctattttaagacagaaccaaactgaacctctggaaataaaaagttcactacagcaatttcagaatatgattggaaacaataataaagcattaataatagaatggaccaagctgaggaaagaacctccagggcttgaagactgtaccttctaattaatgcaggccgaaaaaaataaagaaaaaataattaagaaaatgaacaaaacttttgataaatatgagattatgtaaagagaccaagtctatgactcattggcattcctgaaagagttggagggagagcaaaaaatttggaaaatatatttgagaatattgtctatgaaaatttctccaacttgctagagggggtgacatgacaatttaggaaactcagagaaccccagacagagaatatataagatgactatcgccaagatatatagtcatcagattcttctaggttaacatgaaagaaaaaaaatattaaaggaagctatacagaggggaaggcaacataaaaagggaacccaattaggctaacagtggacatttcagcagaaactttacaggccagaacaaactgaggtcctatatacagcatacttaaagaaaagaaattccatctaaaaatttcatatccagccaaactaagcttcataagtgaaggatgaataaaatctttttcaaataaacaaatgttaagggaaattgtaaccaccagacctgccttacaaaaggtccatcagggagtggcaaacatgtaaagaaaagaatacctgctaatacaagaatgcacataagtacatactgcactgacactacaaaggaactatacaattcactctacattaataaacagctaacaacactgtgatgacataaaaccctcacatatcaatattgaccttggatgtaaatgggctaaacacagaatggcaagttggataaagaagcaagacctaatggtatgctatcttcaacagaaccatctaacatgcaatgaaacccataggctctaagtaaaggaatgaagaaatatctatcaaggaaatgaaaaacagaagaggcaaagggtcctattcttattacagacagaacagtctttaaacctacaattattaaaaaaaagatgaagaagtacattacataatgataaaagattcaattcagcaagaagacttaactatctgtaatagtctgttcttgcactgctataaagaaatacctgaaactgggtaatttataaagaaaagaggtttaattggctcatggttccacaggctatacaggaagcacggctgggagggcccaggaaactttcaatcatgatggaaggggaagtaggcacttcctcacatggccagaggaggagagagagtgaaggggtaagtactacacacttttaaacaaccagatctcatgagaacttactcactatcactagaacagcaagggagaaatccgctcccatgatccaatcaccttccaccaggcccctcctccaatattggggattacaattcaacatgaaatttgggtggggacaagaatccaaaccatatcactattctaagtatgtaagcagccaacaatggagcatctagattaataaaacaagtacttagaaacctctgaagagacttagataaacatacaatgataataggagacttcaataccccaatgacagtattagacagatcactgaggtagaaaactagcaaagatatttgggttctagagtcaacacttgaccaaatgcacctaacagacatctacagaacactccacacaataacaatggaaaatgcatccttctcatctgaacacagaatgtactctaagatcaaccacatgctcagctataaagcaattctcaacaaattcaaaaaaagcaaaattataccaactgccctctcagacaatagtgcaacaaaaatagaaatcaataccaagaacatctcttaaaaccataaaactatatggaaattaaacaacttgctcctgaatgacctttgaataaacaataaaatttaggcagaaataaaaaaaattatttgaaactaaggaaaacaaagatacaatatgccagaatctctgggacacagctaaagcattgttaagaggaaggttcataggactacatgcatcaatcaataagttagaaagatctcaaattaactatctagcattacaccaagaggaagtaggaaaaaaagatcaaaccaacctgaaagctagcagaagtaaagaaataaccaaattagagctgaccagaatgacattgagatgtgaaaattcacacaaaagaaaaactacggaaagcagtttggtgatttctcaaagaacttagaactaacatttgacccagaaatcccattactgggtatacacacaaagcaacataaatctttctaccaaaaagacacatgcgcacatatgttcattgcagcagtattcactacagcaaagaaatggaatcagcccagatgcccaacaccagtgcactggataaagaaaagatgatacatatacagcatggaatactatgcagccattaaagaaaaacaaaacaacattctttgcaacaacattaaagcagttggaggtcattatattaagcaaataaccacagaaacagaaaatcaaataccacatgttttcacttataagtgggagctaaacattgagttcacaaggacacaaagatgggaacaataaaaacaagggcctacttgaagggggagggaggagggcaaaggtcaaataactatctattgggtactgcactcactaccttggtgacaaggttatttgttcaccaaaccacagtgacatgcaatttacccatgtaataaacctgtacatgtatcccatgaacctaaaagttgagaatagaaaaaaacaaaaacatattaacccccaaatgatttactgtcacttaggagaggacaggggtctaggatatgatgattcaccaaaggttccatagtcaggcccggtggttcacaggtgtaaccccagcactttgggaggctgaggtgagcagatcacttgaggtcaggagttcaagaccagcctggccaatgtggtgaaaccctgtctctactgaaaatacaaaaattagctgggtatggtggtgcacgcctgtaattccagccattcaggaagatgaggcagaagaatcacttgaacccaggcaagagaggttgctgagatcatgccactgcactccagcctgggcaacagaagtgagactccatctcacttggaaccaactcaaatgcccatcaatgatagactggataaagaaaatgtggcacatatacaccatggaatactatgcggccataaaaaagaatgagttcatgtcctttgcagggacatagatgaagctggaaaccatcattctcaggaaactaacacaggaacagaaaaccaaacaccacatgttctcactcataagtgggagctgaacgatgagaatacatggacacagggaggggaacatcacacaatggggcctgtcagggggtgggaggcaagggaagggatagcattaggagaaatacctaatgtagatgagttgatggtacagcaaactaccatggcgcatgtatacctatgtaacaaatttgcatgttctgcacatgtatcccagaaattaaagtataataataaaaaaaaaaaaggttccacaaggtacaagcaagggtgatcataatggaacactttcacgttggatatccaaaggtataggaataaaaaagatttgagaatattgggaaataaaaaaaagatgatattcagaacagactaaattatctctctaatttggcataaacagtctgcaaaacaagggtgttttgttaattcacaacttgtaaaataaacaccacattattccatctaaagtgataattgatttccacagtgttaaaccaacaactttgaaaagaatttcatagtccagtctgatgccagaatccttatgcttctttctactttttgatcagtgtatattttgtaaacatacacaatgacaaatgacagcaaagatcactattttacattctcccttctactcttctacttctccatttttaatttgttctttaatatgaagttcttaaactcattatttaaagatatccaatgctatgaaaatttgatgtgtataattctccatgattatacatataaaagtatataattatatatgatttgttttatttgatttttaaataagtaatattctatacatattagtctatggcttggtttttaatgtgttatgataattcccccaagggtaagaaaatacttgtattttccaatttttgcatgcatgcatgcatatccatctgtaattataaatgaatcagtgtaaataacacatgctagattgctcttcttaatataatatgttagctgttcttttttccttcttttctcctgtttttccttttcctcctccttctcctcccctttcctctcttcctcctctgtctttatcttctttgatcagaccactcccttcttctggctaacaagtgtggaatgagaatgcttaaattcaaacatttggtcaagcagatatgttgcctagagcaagataacatttcctcacttgtaaaatgaggataagcataggccctacatttgaggttttggtattagaatatatattcatatacaaaaatgtttaatataatgcttggcacataaagagactataatcagtgtaagcagttattaactaccctgcttatctttccagccattctatttatatttttcacttgtttcgcagtgtttcagttataacagccttttctctcttccttaaataggccaaactttctcttgccttagggcttttgcactggttgtttcacccttaggtattttactatgaacttacttacgcatctttttctgcttctttttgccctctaaagtactatatataagttctataaaagttggaatctggtttgttgtgttctacactgtgtctctacagcctaatatcatgcatgacacagagtttatggtttaacatgtacttgttggatgactgtaaaattccatttgatatttagtatcagagtaacccataaagataggtattatttcctcaattttataaataataaaagtacaacaatgaggcttaatgctttattgatagttaagctgttgaattgggcttgaatgcagtttccttttctgtgtgttgtattctttccactgtttcctatgtgttatgcatttttaaaatacacagaaaattagctttatgagattgtaaatctcttcgaatcatgcattttactgtctctatgtaaaaattataagctcacaataagtacataatatgcattttttattactaatgattttcttcccttcatgggtttatgctttttctaaatgtaaaatatttgtctaatacatatatgtaaaatacatagtatgtgtaaaatatccttttctaagcttgctataaaatcttacttgtttatttaggtgttgatagttaaaattaatttggcaataggtatgcaggggatgtctctgaaacccttggaagacattgatggtttctgaacttcaactggtgtagcagattgaaggcaaatcccaggccaaatatacatatatatgtgtgtgtgtgtgtgtgtgtgtgtgtgtgtgtgtgtgtgattatatatatttatatataatatataaaatattatataatatatacatgttttatattatatatatataaggcataagacaacacagagagaatatgtttaatacgacagcaatttagaagtaggaaacagtcattgcttgtgaaataagggaggctatggtagttgctgtgctgagcaataatgaccaagtgaacataagtgggatattgcagccagaaataggaacaaaaacagaatagatagaatatttaaaaaaaaaacttgaaagctactgcttagaatgggcttgactcacatagctgtactgaggtgaaactaaaccaagagatctttggaaattttctcccgagacatacaagaatttacctagcaatatacagtatgcaccctttaaatcatcaggctggcaaaatcatggtttgtgtaatacttgacattgaaagttaaccccttcttttatttataattagagacaaatgaagaactatgtagaatgtgaggcaacaagaggtgtttagattgttctttcaacacttaaagacctggaatgtctggtcctttttctccacttttactgtaataaaggcagtccaaattctcatcatttaacccctgaatgaaaacaggatcccaacaacttgttcccctgatgcctgaggccaatgcacagtgtccggaattttcctcttaaatgtgaactgaccgtggtggtccaatcctaaaatctcacttcaggctcctagtgaagaactgttagttcttagctaacatcacgtttctcttggacagctcacatattcatagttgtcttctaatcttaaaatacacataaattcactcagcaagcttgtaaaaatgtacatatttggacctcaaattcaaagattctaattccatatttcttggatgtgacttggcaatttacttctaaacacatgctccagcaagtgaaataaatgactatataggcatgaagaactacttagatgccctaaacaccctgctattttacaactatttgccaagaacatcttccctgccaacttggtctttttgtcttggaaaattgctacaaattcctcacaaccctgttcaggtattgttcaggtactgatcacttctccaagctttccattattcctccttccctccactagatggttaatagattccttctctatatcaattctgtgccttgcagatacttattttactgcctattttatattttggctttattgtcatcttcacaaataaagcgtaacctcttgaagggttgaaaattacttttggtattagtggttagcaaactacttggcacatgttaatgaagaattaataattgctgaatttagcatttttacactgaccctaagagtaaggaccaagttctggttctatcacttttgttcagctaattatatgtagagatacagatatacatatacatatatacatatataaatttgaacacagggttctcctaacacacatcttaataggtacagaggagaaagatcttggatgtttgaaaaggtagagttgccattttctctctgtactctctctgtacatgatttttggattgagaatatatctagaatgtcaccaacaataaataaactatgctgggaaaatcatttataatagacagatttataatgtcaattattaacatactgcagactttttcaaataggggagttcacttggaaatttaaaaaatgccagctggtcggttctgagatcacagaaatgaagattcctttgcaataaaaagaatcactttgtttttttgtttttttcctaaatctccacttctgcttatagtgactgtacccaaatcaaggagttataaatattaatctggtaacttcaaattgagaattcatagccactaaaatgggttgccttaagaaaaatcttttttccatcatccaaggtcatatgcctcttatcaaaggaactacacatatattacaaagttattttcagtttttctcatgaatttctatgtatacacaggtctctgtatgtagctaataacatacttagggcaaaatgaaagaaaggaaggcaatatttcccatgctcctaagttaaaaaccctatttgtctgtgtgtaatatggaaatatttacatattatctgtacagatttgatcatatgccaaaacatgtcccccttcaagttctatctgctttggacatccaaatacaattcaaataactttcaacagttttacatgtaatgaattctcagcaaattaacacaagaaaataaaaccaaacaccgcatgttctcactcataagtgggagttgaacaatgagaacacatggaaacagggaggggaacatcacacactggggcctgtcggggggtcgggggctagggaagggataccgttaggagaaatacctaatgtagatgacgggtcgatgggagcagcaaaccaccatagcacgtgtatacctgtgcaacaaaactgcacgttctgcacgtgtaccccagaacttaaagtataataatgaaaaaaagaccaaagacgttttgtgtgtttaaattattcttaaagctgtataaaattagcttgtgaaagttgatctaactaagatacaacaaataaaatgatcagtgatatggtagatctctcttcctatagagtagcgatattatttaacatgatcattgtttagttataacaattacttaaaaagaaaattttgactcccatttggtataatttttctggaattcggtattaaagtgtaactcatattgttagatatttttcaccttgcattgtccatcacagtatctactgtatcaaatgcacagttcatgaatcagatcagctcttttatatatctgatatatcatagtttattaaacttgaaatttttgcgtggaaaatatcacatctgagccacttggaactttggagtatagtgaaactccaacacactgattttttttctcaatccaaataaagcatattggaaatatgtatacttgcttaaaaatcgtttctatatagtcagtatttaggtggataattcaaaagtactctacctaatataatgtgaatactaaggactaaaaaatatgattaaatttggaatctcaattttagagtttttgagatgagtttttttttgagaaattaacattaaatcattttcatgttttataaaaatggaacaaagtattctaaaatgtaaagaatgcttgtcctaatacctagtaagtaatccttaacatagagcttgaatcatgtaataaattgccattgttctgccctaaattttcaatgttaaaggttaacacttttgggtctaatagaataacaaagcagaaggactcctaagacattcttcagttgactaaactgtgagttggtactgaattgcctacaaaaactggactgaaaaaacagtgtttgcatttcagtaaggtgaatgtaagaaagccaattattaactcattagtattccgcagctttactttcaaagggtaggagacaaaaaaatgaaagaagaatgtatatataattttctgtgtttattctattgactgtgtgaaggtaccaggacagaataacatttggaaaaaaacaaatatgtattcataaattcaggagacagattctttttatgggcaaaacatgatttttttttgatcaactgattcaaaaaaataataatatgcaaagcaatggttatttccatataaccttaggctttttcttaataacaacacaattctaatttttgcctttaggattcctttaataattacatggctaataaactattgcttttcctcatgcatatataaatactgacttgttccttatgagaacattccagggtattattagaagcatttgtcttgcactttactctacgcaagcactttaatgatctcacattgtttggaaatcccaatgagcttttgaggtaagtctcctagccttatcattttacagattttcatttaaataataataatacttttattcctgcatagagtattatgtaatatatttaatacatatataatttatacaaaaatatacatgctatatatatatatgcacatctcatatgcatgctttttaatgcctttacattttttccttagtgttttattttataatcagtgctttataaaaggatgcattccttttgaaaactatgcttccttcagctactaggaacacagtatggtatatggaaagaaaaaatgaaaacctctgacaacacttgcagctaatatttattagattctttttgcttcataaagtgcataacaaatttgcatgcattttactcatatgatctctcacatcaagcggtaatggtggatatgtttgttattgctcctatttaacagatgagagtactgaaatataaaaaggtaagtaagtttcccaagcaactaagcaagtataagtcaagatctgaaacataacaatgtgtctgtggaatctgatttttaaatactgttaatcactttaacagcactaatttggcaataacttatttcaaaagctgcttcctttctctaagcctcaatttcttcatattaaaatttcagtatgaatattgcaacttttaggatactcatagcacaaatattatgtttaaattagtgattatcttagtactgagagtaatggtgccaataataatagtttccatttactaagtctctactgtataccagaagcactgtgaacattacttcctctaacctgcataacacatccccaagacgaacatttcacattttatagttagaaaaattaagaatcagagaaattaattttcccaagatcatgtaactaggacatagagtatctggagttaacatcctactgtatgtgactcaaagatatttattttcttatcaccaaacattgtaagtaatttttactgtattttacacatcaaaaaccttagccagcacactatcatacatttactgaaacagagtagatatccttatctttcacttagaggcattgcagcatggttaagggcaatgctcttgaagtcaatatagtaccatggaattaaaaacaagaaaaaaactgggcaagcctcagtcatactctactacagatgctctttgacttatgatgagattatattcaataaacccatcataagttaaaataccctaagcctaagatggatttcatctacccaacctactaaatgtcatagcataacatagcctaccttaaatgtgctcagaccacttatattggtctacatttgggcaaaatcaaatgcttatttcataattaagtgttgaatatctgatgtgattcattgaatatggcactgaagtgaaaaacagaatggttataggggtgttcatcatttatgtacataactgaaagcacagtggacataaagagtgtttgaagcattgaactaaaattaatcgccggatgatggagatgctacagcaacagagtcaccaatttctccttcttctgatgaggttcaaaaatagctggtacaggttgagtaacccttacctgaaatgcttgggaaaagaagtgtttcagatttcagatttttttgaatattggaatatttgtattacataatgagatatcatggaaaggggacccatgtcaaaatgcaaaagtcatttacatttcacgtatacacacatagcctaaaggtaattttaaatgatattttaaataattttgtgatatttttacatgaggtcgtatgttgaattttcttcctgtgacatcatgttggtgctcaaaaattttcagattttagagaatttcagatttcaaattttcagattagggatgttccacctgtagaagaaactggttattgacacttattgatggtctagagtttgatatggtttctctgtgtccccaccgaaacctcatcttgaattgtagctcccataatttccacgtgttgtgggagggacccagtgggagataattgaatcatgggggtggtttcccccatactgttctcgtggtagtgaataagtctcttgagatctgatggttttataagggtttcccctttcacttggctctcattttctctcttgtctgccaccatgaaagatgtgctttttgtcttccaccatgattgtgaggcctccccagctatgtggatctgtgagtccattaaacctctttttctgaattcacagtgttctttggaaagatagcaagtattgattgtacagcttatttcttattattacatatctttctgtaacaagcaagagcactgtgtctctgcctgtcagttctcatgagtctctcctaatcgacgtgccatttctttaacatctgtatgccactgctgaatgcagcaaaggcctccacaggtttctttgctgtacactttcttggttcctccggtttaacttcttcctctgcctcaacttctttacttctttcttcctacagtttgatcacttgaaaactcagtgccaacaaacccatgaatatcctcttcatcaatacccaattttagctgtttctcaagtgctaataacttgttacctactattcatcaacagcagagtctttgttaaagcttttgaatgtgttcacatatgtcttcgaaactttcttccacatgccgatcatgcactgctgtgtgacttcttcccatgctgttgcgatgttctggatggcacttaggatgtaaaaacttttccaaaactcttggagaagtcagccagactcagtcacttcactaatctacacaaatccttggcataaatatactttgaagggagctattgctccttgttccattggttgaatgaatgtggttttgttcagtttcaaatacacagtcaaaaaaattgcttttatttctgtttgtttattcacttttcctgattgtctttatgcagagccctaaagaagttagtggtaaagccaaacccttgacatcagcagaactttgagcagcatatttggttcttcatttctcctgaaaagagtgatagccaaagaacatatctaccctgatgccctgggaaaagttaatagtttggctgacagtacttgaacataattggagcatcggtgacagggaggactgaagaagatttatgtgattaattctctctacttgggtacagagcttaaacacatttgtgtcacatataggtgctaaccaaagagtaacttcagcagatggataagtgaaaccatttgtaggagatcaagtgggtccccttagtactcccttgtgttgtgatcaaagttattggaaaactacaatggactaacacaggaagaactactaatggccaaggctcttcaggaacaaaatttcaggtcattgtttcagacaaaaggacctgatgatctggttaaaataaaagtaataatgaaataggtagtacaagaaggaagctataaacaagctatgaccatgtgaccaattgcaaacataagaattgcgataattatgaaaagttctttcttattttggtgtgaatgtatttcaaaaagattaaccaaagtttcccttttttccacgtctcctgccatctaacataaaaatgtgataatagtaattaactttatgtcaccgtatttaactcatatgatactaaagagggagaagtgtatcagaagtggaatgaacatcgaccactggtgaacaaatgacttttgtgagtttgtatccactttcagagtgatggttagcgtgctttcagttggtagaagtatagatgcgtcaccttggaaagaagcatgattttaccgttacctttatttggaatgtaaacgtgatttaaaatggaatacattgatgtcaatttgagaggtaaactttagtgaaaccatatttttaagaataatttttttcctgttaaaattgctgcagcacccattgtacctcgtgtgggtaccctgttctgctcttgcatgctgttgctgatctgctgactttccttgtcagtatgaagtagttagtagcatacaggttaaaggtggtaacagatatgggttacaattattgtccccatggactctaatttggcttcatggatatcagtttgccctcactctcctctgattcacactaacttttccttcccagctgccagcctaggtgacctgcagattcttcacgcctaccaccagaaacagagagaatagcacttcacagattgctacaacagatcccagttttatagagtttattttttacagaaaatcttgattcatattgattattgtgttgtttgtttccatattaagtctcaactgatgtcttcagtttatgtgatatatcatacggtcactttatggataatgcatttgggtgatcacattaaatttggaaaatagtctttgaactcctggaattttaactcttagtctcaaaccaaacacatatctagtctaactttctaaaatatgactgaaatagatttatatagctactatatttttagtttcaaattttctctatacatttttaatagcattgtttaatacaagtccctggatatgttttctatgacctcaaaatgttttgaaattttgggtcaaataaggtatgtgagtgcttatttttttttctttgggggagtgttttcaaatgaactttgaagcccagttggacactaaccaaacatttaagaaaacataccataacccttgattttataaaagaactaatacctgctaatccagctcaataatgaaaacccagagatttcatctttcaaattccaagttgacatttggtgttgttatttataatgtcaaaagccagcaatttatttcttaagagaaaattcaaaacaccccttctagggttcttgacctccggatatctttctgtccaccaagatgtctaataaaacataaagtttccatgatataaatttaatatggattactgaaatttgagtaagagttcttattaaatttaaaagtacagagtattctttcttcactagtgtagatgcaggtatggtttcaggaaacctatcatagcttgaatattttaaaactctattgatttttgaacatggtatagacatttctggcattgtgtgtgtgtgtgtgtgtgtgtgtgtgtgtgtgtgtgtgtgtattattgggggatgatgcgtatatgtctaccaattaactgtacatacaataatatcttgctatcctacaaaaatggcattacatttcattttaattttttaatgaagaaagggttatcaaaatttagttactacttctgaaaatttaatcttaattttaaactagaaatgtcaaatggcaaatgggttttttcctcatttcatgaactgcaaactcacataacatattgatgtttgttaaatcatttgcagtttcttagaggttttaaataaaaatatttactcatgcagaatagttattttttaaaattactaacacgtagaatagacagcaaattattaatgaaagtataatttgactttccattattttctttaattcaaaatattatattctgtctaattatactctttaaaaatgtcatttcatgatgcacgtgtctactttatctaacttcccttaaagcctaaaagacctaagtgaagattttaccatcaaaagttaaaaactaaagcgagccattttccaagaattagacagtatttttacacagccattaaatcataccacatgacaaggctgataaacttcatctgtcatatgaaattatctaatacccctaaaataaaatataattttataaatttacctggttatctgaataatcagatttttcattttatgaaatattcttaaatgtacaaaacattttaaaaatatgaatacataaaatatgtatattttatactttaatttgtgatagtatgggttttaaaatattttagtgttagatttctttttctttgatttggccaaatattccatttcatttatttttgtttatttatttatttatttatttatttatttatttatgagacacagtctcactctgtcacctgggctggagtgcagtggtgcaatctcggctcactgcaaactctgcctcctgggtttaagtgattctcatgcctcggcctcccaagtagctgagattacaggtgcacgcccccatgcctggctaaaataatattcagtctaattttatatgtctacacacaaacacaccagtattccctcacattagaatattgttatattattttctattatttcaaaaacatcttattgaacacaaaacaaaatttttgtcatcattgtagacatgacaatgcaagcaaaaacatacttgaaattaaaaagaatcacactatgtatttttatacatgcaaggtgaattttgattaaagattaattatgttaaaaaatcttaatcatattaatactccaaactatcctaaataggcaggtaagtctcatttaagtctgatgcagctgttatttgtgaaactcatgttaatgttaatggttcactttctcaaaaaacagtatttgaaatgcctactatgtacctggagaaattcttggattacagcaatgaatcaaaaaagatagtctttgccctcacagaaattgcatgtaatataatgatccaaatattctctattctgagataaaaggtgctgacagttgtttgcagaaaaatattagccacaggcttgcatgtttaccttccatctgtcttctccctagagcatggcttcgtattcacaggcttacaaaattctgtctttttatatagggaattcttcttgttttctaaccactttgttaacatgaaaacaattatgtgctttactcatgtaataagatttacagaggatatttcttttacatattgttaaaatgttagtgctatctctgaacaactatatcacagaatgaagaaggcacatctttgtgtagtcttaattttaactaatagtcaataattgaaaaacccagaaataaattaatctctgattccttctaaagaaaacatatatataattataataatgttcacacagcttcctatcagtgttttacttgccaacaataataaagactttatacaaaatagtgatttttaatcagataaatatataaagttagcaatttaggattatgtgaaaggataataattatctgttaattttaaattgctggtattttagtcaactgaaaatctatcatgaatattagctgatttacctctcctgaaaaaaaaaatgaaagcaaggagtagcacacagttagtttttttaaaaaagtatgaacaagtatgaataaaaattatattttgtgagatttagctggaattttgaaattggctgaaataaaattgaaataattgcttttctcctgggattcaaaatagacttcaaaaaaaaaaaaaaaacagttttaactgaaacaaatctattcattgtgaaacattatttcaaatccatcagggtccaaggtgttaaaagaatattcaaataatacaaataaaacatttacttagcaaaactttcatacttgctatgcaatacagaatggaaattctaatagaggtatcaatggttcatcagtaacagaaaaacaaagaaaacatttgttataatagtgttccataaaacttactcatcgaaaagaaattttagactgattgtttctaagatttggtaaagtctcaagtgtagcatgaaaattaatcacttgggggatggagccaagatggccgagtaggaatagctctggtttacagttcccagcgtgagtgacgcagaagacaggtgatttctgcatttccatctgaggtaccgggttcatctcactagggagtgccagacagtgggtgcaggacagtgggtgcagcgcaccgtgcaccagccaaagcagggagaggcattgcttcactcaggaaactcaaggggtcagggaattccctttcctagtcaaagaaaggggtgacagatggcacctggaaaatcgggtcactcccaccttaatactgcacttttccaacgggcttaaaaaacggcacaccaggagattatatcccgcacatggctcggagggtcctatgcccatggagtctcgctgattgctagcacagcagtctgagatcaaactgtaaggcggcagacaggctgggggaggggcgctggccattgccgagttagttgtttgattaggtaaacaaagcagccaggaaactggaactcggtggagcccaccacagctcaaggaggcctgcggcctctgtaggctccacctctgggggcagggcacagacaaacaaaaagacagcagtaacctctgcagacttaaacgtccttgtctgacacctttgaagagagtagtggttctcccagcacgcagctggagatctgagaatgggcagactgcctccttaagtgggtccctgacctgcgagcagcctaactgggaggcatcccccagtaggggcagactgacacctcacacggtcgggtactcctctgagacaaaacttccagaggacccatcaggcagcagcatttgcagttcatgaaaatctgctgttctacagccaccgctgttctgcagccactgctgctgatacccaggcaaacagggtctggaggggacctctagcaaactccaacagacctgcagctgagggtcctaactgttagaaggaaaactaacaaacagaaaggacatccacaccaaaaatccatccgtacatcaccatcatcaaagaccaaaagcagacaaaaccacaaagatggggaaaaaacagagcagaaaaactggaaactctaaaaagcagagcgcctctcctcctccaaaggaatgcagttcctcaccagcaacggaacaaagctggatggagaatgctttgacgagctgagagaagaaggcttcagatgatcaaactactctgagctgacggagaatgactttgacgagttgagagaagaaggcttcagatgatcaactacgctgagctacaggaggaaattcaaaccaatggcaaacaagttaaaaactttgaaaaaaaaaattagatgaatgtataactagaataacaaatgcagagaagtgcttaaaggagctgatggagctgaaagccaaggctcgagaactacgtgaagaatgcagaagcctcaggagccgatgagatcaactggaagaaagggtatcagtgatggaagatgaaatgaatgaaatgaagcaagaagggaagtttagagaaaaaagaataaaaagaaacgaacaaagcctccaagaaatatgggactatgtgaaaagaccaaatctacgtctgactggtgtacctgaaagtgacggggagaatggaaccaagttggaaaacactctgcaggatattatccaggagaacttccccaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaagattgggttacccacaaagggaagctcatcagagtaacagcagatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccccaaaagagctcctgaaggaagcactaaacatggaaaggaacaacaggtaccagccactgcaaaaacaggccaaattgtaaagacgatcaaggctaggaagaaactgcatgaactaacgagcaaaataaccagctaacatcataatgacatgatcaaattcacacataacaatattaactttaaatataaatgggctaaatgctccaattaaaagacacagactggcaaattggataaagagtcaagacccatcagtgtgctatattcaggaaacccatctcatgtgcagagacacacataggctcaaaataaagggatggaggaagatctaccaagcaaaaggaaaacaaaaaacggcaggagttgcaatcctagtctctgataaaacagactttaaaccaacaaacatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcatctctgcaccaagaggacctaatagacatctacagaactcttcaccccaaatcaacagaatatacatttttttcagcaccacaccacacctattccaaaattgaccacatagttggaagtaaagcactccccagcagatgtaaaagaacagaaattataacaaattgtctctcagaccacagtgcaatcaaactagaactcaagattaagaaactcactcaaaaccactcgactacatggaaactgaacaacctgctcctgaatgactactgggtacataatgaaatgaaggcagaaataaagatgttctttcaaaacaacgagaacaaagacgcaatataccagaatctctgggacacattcaaagcagtgtgtagagggaaatttatagcaccaaatgcccaaaagagaaagcaggaaagatccaaaattgacaccctaacatcacaattaaaagaactagaaaagcaagagcaaacacattcaaaagctagcagaaggcaagaaataactaaaatcagtgcagaactgaaggaaatagagacacaaaaaacccttcaaaaaattgatgaatccaagagctggttttttgaaaagatcaacaaaattgatagaccgctagcaagactaataaagaaaaaaagagagaagaatcaaatagacgcaataaaaatgataaaggggatatcaccaccgatcccacagaaatacaaactaccatcagagaatactacaaacacctctacgcaaataaactggaaaatctagaagaaatggataaattcctcaacacatacacccccccaagactaaaccaggaagaagttgaatctctgaatagaccaataacaggagctgaaattgtggcaataatcaatagcttaccaaccaaaaagagtccaggacaagacggattcacagccgaattctaccagaggtacaaggaggagctggtaccattccttctgaaattattccaatcaatagaaaaagagggaatcctccctaactcattttatgaggccagcatcatcctgataccaaagcctggcagagacgcaaccaaaaaagagaattttagaccaatatccttgatgaacattgatgcagaaatcctcaataaaatactggcaaaccaaatccagcagcacatcaaaaagcttatgcaccatgatcaagtgggcttcatccctgggatgcaaggctggttcaatatatgcaaatcaataaatgtaatccagcatataaacagatccaaagacaaaaatcacatgattatctcaatagatgcagaaaaggcctttgacaaaattcaacaatccttcatgctaaaaactctcaataaattaggtattgatgggacttatctcaaaataataagcgctatctatgacaaacccacagccaacatcatactgaatgggcaaaaactggaagcattccctttgaaaactggcacaagacagggatgccctctctcaccactcctattcaacatagtgttggaagttctggccagggcaatgaggcaggagaagaaaacaaagggtattcaattaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctagaaatctgacttacaagggacgtgaaggacctcttcaaggagaactacaaaccactgctcaatgaaataaaagaggatacaaacaaatggaagaacattccatgctcatggataggaagaatcaatattgtgaaaatggccatactgcccaaggtaatttatagattcaatgccatccccatcaagctatcaaggactttcttcacagaattggaaaaacctcctttaaagttcatatggaaccaaaaaagagcccgcatcaccaagtcaatcctaagccaaaacaacaaagctggaggcatcacgctacctgacttcaaactatgctgcaaggctacagtaaccaaaacagcatagtactggtaccaaaacagagatatagatcaatggaacagaacagagccctcagaaataaggccgcatatctacaactatctgatctttgacaaacctgacaaaaacaagtaatggggaaaggattccctatttaataaatggtgctggtacaactggctagccatatgtagaaagctgaaactggatcccttccttacaccttatacaaaaattaattcaagatggattaaagacttatatgttacacttaaagccataaaaaccctagaagaaaacctaggcaataccattcaggacatagtcatgggcaaggactttatgtctaaaacaccaaaagcaatggcaacaaaagccaaaattgacaaataggatctaattaaactaaagagcttctgcaaagcaaaagaaactaccatcagagtgaccaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatataaacagacacttctcaaaagaagacatttatgcagccaaaaaacacatgaaaaaatgctcatcatcactggccatcagagaaatgcaaatcaaaaccacaatgagataccatctcacaccagttagaatagcaatcattaaaaagtcaggaaacaacaggtgctggagaggatgtggagaaacaggaacacttttacactgttggtgggactgtcaactagttcaaccattgtggaagtcagtgtggcgattcctcagggatctagaactagatataccatttgacccagccatcccattactggatatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacacggatgaaacgaaaacatcattctcagcaaactatcgcaaggacaaaaaaacaaacaccgcatgttctcactcataggtgggaattgaacaatgagaacacatggacacaggaaggggaacatcacattctggggactgttgtggggtggggggaggggggagggatagtattaggagatatacctaatgctaaatgatgagttaatgggtgcagtacaccaacatggcacatgtatacatatgtaacaaacctgcacattgtgcacatgtaccctaaaacttaaagcataataataataaaacaaaatagaaaattaatcacttactgtttttaagtcatttataatatttactctgactgttgtcaataagatccctcatatctctaaataaacccttttaaagatactgaataaactccttagagaatactgatgggatgctatttgctattttctcacaaataatgctcactccttgcctgtcccgaagtattaagataaaaccaagcacattaatcaattttcaccaaaatatattcaataaagaagatcattttatcaagcaaagtaaatatatttgtaaggatttatctgaaatgtgaagctgctactattgaatcttccctctttattaatgattttttaaaagagaatgtaatataacaaaaatcacttattaattttgatggtaccacactatgaaattttctgacactaagtattactttccaatagaaatcatcacattcatattgacctttggtatgactgtaataatcctctactttgtgttaaatgaggcagtgataccactgagccaaattgaatgacttaatgcattttctgattttttctgagtaaaatatatttttaaataataaagttggccgggcgtggtggctcatgcctgtaatcccagcactttgggaggccgaggcgggtggatcacgaggtcaggagatcgagaccaccctggctaacacggtggaaccccatctctactaaagtacaaaaaattagccaggcatggtggtgggtgcatgtggtcctagctactcgggaggctgaggcaggagaatggcgtgaacctgggaggctgagcttgcagtgagccaagatcacgccgctgcattccagcctgagtgacagagtgagaatccatctcaaaaaaaaaaaaaaaaaaaaaaaggaataaaattatctgtgattgtgaacaaacatctacacacagttgtgaatttgaatttttaattatgcgctgctatgacattgagtgatgaaaaaagaattattctttgtaaattatatgttactagatgaggtcaccatcaactgatttgttggcaaatcaattaaaaagtcaaaaacatttttgactaatctacatacattcaatcaacatccatcttctctatttcaatcacatatgctctttctcatcttctccagctatcttcttgccatttcttaaacttatcagcatattcatcttcagagtctttgaatttattcctctgtctataatgtaaattccctggatgaatgcatggctcacatcttcagtcttaactttatgcagttttgctctaatgtaatttcctcaaagaaacaagtcgtctatctgaaacagcatcactgcctcctcagttgttaatcacaccttggtttcttgctctgtttcgtttttactccctgtctctatctccatgtggaaagtggttttgcctgttttcttctctgatgcatcgccagtaccagaacagattctcacacaatatagagtgtcaataatcataccttgaagaaataactaagcaaacaaatgattaatgaaatgactgattgaacaacaaaattatgtattgggcatgtgttcaagattgtttgtaacagggaaggagagaattgcaagcaggtggtctttacttacattctatttcagctgttttgttgtaaaaatgaagacaaatttgggagaataattttaatactaaactttgactaggaactattgtctttcttactcaaaaccaacttaagaagcaacactctcaaccacacccaggtctgacaactcaaagcactgctctgtaaaattgtaaattttcaaaagcaaacacacaaatgacagtaaaagcaatatcatagtttccaatgtgtcctgaggtacatgaaaagagcttagtgctaaccaggtcagcatttttggaatgagaaccaaggattactgtatgacaaaatggagaatctagaaagcaaaaacttggatcaataataaacaaaatcttgattcttgacatcaatggcaagttgctttggtggattttttaaaaaagcactcaatatattagtatatatctacattttgttgaataaacccatttgaatttaaccaaaagtagtgtactttaacagtgcgtagattataacaatttcataaaaattttatattgagtatacttaacagattcatttctattcatactgaaaagtaattatacattctttgcttaaactacactacctgatataaatataaaataaatgctcattttagtatatatgtcaaatttgtatgaagtagtcatagatgaagggatagcaagtactttcatgttctttaaatcacatgacatacttacatttagttgaattacataagtaattcaatttaggaatacttggcatttgaatatttgttttgaaaactgctgtaggaaatattttaagtccaaaatattttcaagatagtttttgaattactatttatatctagcaattgctaagaaactttatactgttgattactgcactctattcaaaagtgaaggtagtgatcagattttcagtgtcttaacagggaagaaactcacagtccaattgtctcagcaacacaaatccgaagtctaacagtcaatatttgatcataaggaatggaagaaatgaaataactgtttacggcaaaaggaaatttagagaagaaaggccttaaagacagggaatggtaaaatctaagacctcaagagagcccgtgtaaggaagagaggatggagaaatactgcttaggaaagttctgtacaaagaaaatcttcatgacctttatttcaaagccagtaattgaactttggtgcttcctcccctcttacatcgataaatttccacaagcaactcactccccaaataacttttaaaaaattatacaatctaaatgtaaacttcttcattgagtccatcatggcatccttggttgatgttgctttcaaattatggagacaactcagatttacctttcatttcccaaatttactgagagtgtacaatatattttaaactttaaattcatgaagctccttcagggtgggttttctaatctctcacgtagtgatatccttttgtctctgcatctgtccatttctgtacagtcacagtggtgtgttccaaccatgacttaaaatcattttctccttctctttacgtagcagtgcctgtacacttcggcagattctgagaattagtttgaatgagtggttccaaagtatgtttaatgtcaatctatagttgctgtaaagcagccaaggactctgatgtggctggcactcagtggcaggtctttaagtagtcccagagtaactgtccccacctctcttctttcagtaaggcttcaatgctataagcaacttagagtcaagagaaactagaaaatatctgttcagaaaggtattttagacattctcacttaattaaacatagataatgtgatctgtttctctaaatccattctcccctcaaaatgaaattacatactaaatacgctctacatgctagttcaagagctttctggtggtagtcaggaactaacatatctctttgtgtgtccactttgcccctttacaacgtaagcttagtattaccagcaattgtgatgaaaataatctcttgttcagcccaagatgatgtaatgaatctgtcattaaggtgctgttgaggacaaagatcaggaattgaaagcatctaacagagcccaggatgagaaagaagtttatggatctctgcctgttaaattcataattcttccaagcatgcacatatgtataaatgcacttgacatatatattcacaaagaatatttctgtcccacaaattataaaagtctttgagagatagagacatgtgtataaataagtgttctataaatgtagctcaatgacttacataaacaattagctataatttaaaaaatgagctatttagatgctttgctttagtagtgaatgtatttagatatagagattatttagcaatagacatcagttaagtgagccacaggcaatttgacttcaagtaaatttactaatttagctgattaaagatttgttaggcctttcttttcaaagaagcttcaaagcctttaaaaatgagtgctcatcattctggtaaaataggaaacccacatgttttattactaccaattaaaagatactggaaaggagaaattaagagagtatagagcaaggctaaaaataagtatttcttttctttctttttttcagacaggatctcactctgccacccatgcttcagtgcagtggaatgatctcagcttactacaacctcccctcctggcctcccaggttcaagtgattctcgtgcctcagcctcccaagtagctgggactgtgagtgtgtgccaccacacctggctaatttttgcatttttagtagaaacagggtcttgccatgttggccaggctggccttgaactcccgagctctagcaatccagctgcctcagcctcccaaaatgctgggactacaggcatgagccacccaacatggccaaaaataattgtgtcattgggaagttttgattgcctaaagaaaaatataaaaacatttgcatggattgtttcccttagatttttaagacaaaaatgattaaagcactacattataatatctggcagaggttcatttgatcaccatatttttagaaatttaatgcaaaagagaaatgcaaaacatttactctctagatcagtatttatacttcttgtgatgacttaaataactctggcagctttctgagtagttggcagtttctacaaaatatgccaagtaaggagcacaacattagtatactatatcatgtcattttcttctaaaacacaaatattgaacttttaccacctgctactgtacagcagtgctatggcaacatcttcgtagagttcctaagctcctttgaaaagtaggatctaatcagcacaaaaggaaataaactatcatcattgctgttgctataattacctagttggcaaaataagctctatctatacagaatcacacattaaaacaaatttgcttaggaaaactaaatgttttatttcagcccagcttacattttcaaatgaattggttaacaattagaaaagaaattgttgataaaccttgcattatgtttattgaatttttatttctggttaaaaaggttaactgttttcactgtggaatatttagaaaatatagatttctttctttaaaaatagttagccataaggaagccataattcatcactgtaacagagaatcttttttcatatatcttttactttatagtattttaatattttttctctactgtagacacatttgggatttatttccaacttacataaatgcatcataataactgtaactccatatgattttattatgaataaggatagattttaaaaacataatcaaaatgttcacatttttgtaattacttaatgtggcaaatattttattaatacttaaatttgtttaatcagaggccagcagtactgtagatatttctgagtgatttcacagaatgtgtgggaatatacatctgcgtcaattctttaaatgagtaaaaggagcatctgtaatgcagcaaaatcaatcatgaagaagtaactgatgcaggaattgcctatacaggtttccaaagtacatgtacgcgtgtagattgagttacaagaaaaaggtcactttctaataaggcaactgacaattattttgtaaaaaatatgaaagtgcaagcacatactttagaacaaatattaggtacaagcttaatggaagagtctatcatgtaattagcagacaaaatgagccacagaccacatttacatacttagtttaaaatagaaacagagtcccaagagataaccattttactgctgcccagttgaggagaaaacactttcaatatttctacattaacgttcagagagtcaaggtggccgatgcagaacaaaaacactaatgataaggaaaaaaagtttttccaaagaagaacttggtatgaattagatattaattgttaattacttcagaaggcccaagtgaaaattcagacttctttctctgctcttggccttatttcatgttcccgctttctaagcacattaggttttcctattaatcagtcacaatcaccatgtctaatcggctgtggatctagatccttaccagatcccagccaatagaagttagcaatgtaaggcttattttgtggaccacttctttggaggaatacgttgtgtttctgttagatgactatacacatgatagtcaacttccagcccatatctggatgcattcttgagatgactctgaatcaaataatttcttttaaaccaaaactaaatatttatattaattgaatgagacttttataaattattccaagtaaagcatgaatttccagagactggcataatttaaacccatactggaggggaattatccatggatttgggttgaaactttcattttagtacctctactcatagtagattgagaattaaaatctgaagaaaaccctcttagataagacatttgtaaaataaaaaactcacttaccattccgactttcttcatcaatagcaactatggtagctggtggtcctcccctagctagtttgcaatctaaagagagaaaataaccaaaagtaataattgactgcaggggcacacacaatgagaaaaaaattcattgagatgtatattaatatttaaaaaggaaaatcttgcaatctaattaatatgcatcactacaattaatattatttaaaaacattttataataaccacatagattccttaccacatcataatacagtcactttgtgcatcacaaaactactcaaatcttactgagaaaacaccagcagggaccactggagagcagaagtccttcaggacagagataatgggatggaaatttaacccaaagaaataacagaaagggatgattaacaaggataaattgtaattaaagcatcacaacagaaacaaacataattggactttaattgtgataaagggtctaattagagagagtgaatagaattttaataatgttctaaagagaataaaacaaagacagacaagcaatgctcatgaggttgtttggggtttttatttttgtcatcttaccctcatattgccagtctggagtcaaaagtatagagtcatcaatggaagcagatcagaaaaatggaagaaagaaaggaagagagaatatatgtatatatttagtgagagatttaaggatataaaaagcattatacaataacattatctaatgatttgtggaaatagaatatataaaatccctatcagatttcctacttctaatataatgttaacacattcactggataatacacatcattagcattttaaaagccgttacaaaaaagactagaaaataacataaagtaaattggtatttttcttacgaaaaggtaaatacgaattacttatgaacagtctgttatctgtatgctgaaaaaactttaagaatagtgcctgtcaatcagtagtgatgattaattcattatttcaaacactgctaatatccttccaggtatcacatgataatgaacataaaaaatagtatgagctataatatccatgacagttgaaatgtgaaaactttgcctgcaggatgtcaaatgtgcacctctgagacataaagtactctactaggaaatactttgtgaggcagagagggctatgtcatgcagttatacatacatggcacactcctgtacagcagtgcaaattaattttgcttgaagttttccaaatttgtgtgttatttgggaaataatttcaaggtttatttacttattaaaattctgccatttattatgtacatatacatgaataattaggccttcaggaagcactattctgtattgtaaggtatgtacgctctcatatgaagcaaagaagctgggagatctacacattttctctctttacacttgtcaatattgaaggagttccaagtcataacattttcagatctaaaatatctcacactcattacgcctcttcctctccttatgccctcctacagagcccagcactacactatttgtcatctctgctcttgatttagtttcctcgctgatctcccagaagtcttgttctcatcctgcattcatctattcctttcatgagaatgattttcatgtacccaaatcaaaagtgaaataatagcattcctctgaacaaaaaccttacatgtttcttttggagaaaatgaaaaaaaaatcagaagaacaaagtttcttcacatggccttaacatcctttattgagaattaagcaacctgtccttcaattacatgaatcctcttactgttgctggaatgtagcctgtatttttagcaaaattttgttatctaaattcattgttgcctttttttgcctagcaaatctctgcttctttttgtagaattagatatttcacatatttgcacctagtgcgaattaattttgattaaagccttccaaattttcatgttacttgaaaaatgatttcaacatttctttatttatttactgttttataaaattcctccaattattatgtacatagaaatgaataattaggctttggaaagcactgtattgtaaggtatgcactctctcatatgtacacacacacacatatacacacactcatgtcactgtgtgccaatgccataatacctactgaaaatagataaaaattatgtattttagtgtgaatgttggtagaggaataaatatttaatcaacaactttatgggcaagcagaatatagaataataaaagaaggggaaatttggatataaatatttttgaacctttttacagtttgttactattaagtttaaaagtaggctttatgaagctaagccaaataatatcttcatattccagcccttcctcactctccgcctttcccattctcaaagttaattctccattcataccaaaccaaatttatgttttttgcatcaactgttaaaatatactttccactcttcttcccctggttaattttattcctttttcaggaatctgcctacgcatcacctcttcttgaaaatccttctcgttgtcattctagattaagtccttattctctgtattcctgcagtacacactgtatcccattggactaattgccccattggcacaatactaatgtgtctttctctctcacaagagcttcttcagaccatgcctgcatcattttcaccttggtaacctcagaacatgatactggtcctgaaagaatgtttgttgactttttccacaatgtagtctgctaagctacaatcttccattaaaacctctccatgagagcagctcagaagtctctgttctcactaacccctcaatagcagaaacagcccagaagaagctgcttaactacattttctcctgctacagtacccttagataattcccactacgatttattattttagtagattcaaaattctccccaataaaacattctttatatactacatatacttctggataaatacaaaaataatttaaacttttttaagactcaaaacacaaaatgaaaagaggttaagcagacacataataaataatctattaataacattgttcataacaaagtgtttgtttttaaacgatgcattcacgacagcataattaattagttttgaagtgcacaaaagcatttttaataagaacaattatatttagaattgtcttggaaagaaagtaatttggatgtaatagccaactatatattatgtatgaaaatatccaaatgtaaatcaaagggaagactagaaagcaatttgggggatggggagattgtaccctatggtctgtggatcatctgtctgccacaggaaagtcaggtgagctgctgatacctgtaccctggaaatggacttccttaatctatttaatttcacccttgactgtcctggttaaatcacaaattcattgtttttcatgcctaaagtttctagcctgttaggcctatactcattttccatatccaatttgtggtaaagtacaggatatgaataccaataactgaatgctcagtgtggcttatttctgcaaacttgtcacaatgctaaaaataagccatatatttaaaaatattcatatgcaatagatgggatttaaaatccaaagaggagaattaaaaagacaaataatgactgatctcacagatactaagcctgtgatactctgttgtcattgtagcctgaattttaagagcatgttacagacaggtcagacaaaggcttttgaaaatctaggattttccgaatatgctcatttcgtagaaatgagagcaagcacccaggaattcaaattctattcccactttagcctattctcaaaatgttcttttaacgttgatcaatgtgttttcaataagacttcaaaactatttactttaaaaaatatattaacatagtaattgcccttatatgttaataacttgtgtattgaatttcctacccatatttatcttctgagcctgggtcccatttgcccagacaacttctgtacttgcaatttcaaagttgtcttaaatgtagccctccaaatcgcatcccagttgctatcatagccgaaaactggatattttcaatatatattatttcagtgaatggcataattctgcaccaagccacataagtcagaaaccaggaagtcacatttcattttacccatgtttctagctttccaaaatgtaccgatcgataagtcttgaatttaattcctaaagaaaaacttgtcatatccactcactgctttcaatctgcagtggtaccaggctaatcttgtctcttacctaatcaaataggttttcctaactgctttccttacaatcaatcttgcccttactctgagttaattttctgtctttaagcagagtgatctttataattaaaaccttgcttatttttaaaagaatttaccatttattttaggttataagctaaaatattttggccatctacaactcatcacaaatatgattctagaatgtaaactaacatattttatataacctacaaagtcctccacaatatgccttctccttccctctccagtctcatctatttccatgtccctcttttcccaaagcaaaatagtttttgatcccttgactaggtaaggtttcccaatatatactctcataactctgcctcataatatcaatttatgattacttgattcttcacagaaagaaaactcagtgataacattgaccttgtttctattcctcacggttgtgtccacagggcagattttcctggcacatttttgattccaagcaattatttactgaatgcaaaaacaaagggcctcaatcaaatttgtaacaataaaattaaaacaacactctgtacattaattcccttttttctttttaatttttcaaatgtctttctcaagtgcaagtacagcaggtccttgaatgacattgtttcattcaatgtcatttcattataacaatgaaaaaaaaaaacaactaattccaggcctgagccactatctgtgtggattttgcaagttctccccaaatctgtgaggactttccctgagtactccagtctcctcccacatctcaaagatgtacatgctaggttcattggcatggctacatggtaccagtgtgagtgagtgtgggtgtgtgtgtgagttgccctgagaaggaatggtatcctgtccaaggtgggttcctgccttatgccctgaggtactgggctagcaggctccctgatgggaggccctgaactggtaaataattatctcactttttttgattaatctttcttaaatgcatgtatagctcacatttacttcaatatttaatataagaaatttttggtctttatttagaagtgtggtgatgtttttgtaaccataactatgtcataggaacttgtttatattttgtttagcctaaaataaaattggtttcattttatgtcatttcattgaaagtctcaatttccaagaacctacggacaatattaactgaagacttactgtaatgaggaaaaaattgacagataatttgttgtctaaagataaggtcattggtgacaactcagcagatgtgaaaggctaccaataaagtaagaaaggtgtagataattctgcaagaatttgaggttatttggaacaagttatgaaagattagagagagctcacaataatagacaaagtaaagtgatgaaaaaaaaggagaaaatgttcacttgcttccaaatgtctataatttctattagaattccaagatgttttatgattttaccaaactgtatcttaaaggaataaaactaagaaatttcaaatactaaagtttaaattatatcaaagatcaacttaccttttttttgtcatcttagaatttttaagctatttccttacaagctgcctaaatcaccagtgaactctgtggcacctagtagagtatttgacttaacataatcatttaatttatttgctgaattaggaaatatcttcctctatggaaaattaacaaaatgaataatccatcaaatccttagctttaaccatttcaaatctttgggggagtgttttaagatgttaaagaaatgggtttctaatatattatagtggttgtgaacatgtgctttggagtcacaaaacctaacttcaaatcctaactttggtttttaatagttgtataatattggacaaattatttaacctcttgtatttcattaatggggataagagtaattacaactaactcatatatttttacaacaaggacaaaatgaggaaatctatggtaatttcttagaagagtgtctggcaaaatgtatagacagactaggcctacatttgcttttattagtatccttattttcattaggaatatattcgaataaaatgttttttctatttttttcctttcatgcaagggctgatagtaaatatagtaaataaaccctcagctctcccaaatattcagtgagggcagatcttagttatatatgggattgtgaaatatattgttattaagaataaaagtaattacatgaaatgtcactggtggtctgtagggacaaaaatttgcttgaattcctatcccagataccaagctagatatactctgatggattaaatttactagggaaaaatagactccttgaacttgaagcttaaaaaaagtaatggggttctcacagtcctctactggtcccagtatgcccctgatatgagttggtgagattccacagaaagatcaaggaagagttgcagattttgtgaaacctctattcctgccaacatttctctattatctgtttcgttattcagagtaatctagtctcttgctcatgtgtttgtatttacacagacacacacacacactgaatctattgctaagttcaaagcaatttggcacctcattcaaagaaggtactgtgttctctttaaatttcatgctacacaagcattctgttttcaatttgcatgtcacaagcagcaggagagggacttttctcatttttcctgttgatctttggtatattcattttcaggaaaatacacacaggagtgaaatcttaagacagatactacttattttacattttgactgcttcatccaaaagaaaaagtttgatcttgaatttataaaatcaatggaacaataatctaacttgtatgatctaaagttacagtcaacaaactaatggaaaaagacaatgatagaacaaaagcaaaataaactgagtaaatttaaggacagagcaagtaattcagttccaattcaagaacaggatatgctacttgtgttactctcttggcattactatttgcagatttcagatttcaccatgaagggagcaaatgatattttatgtaccttagtgtcattattaattgaattatataatttgatgaagactttaaaacaacattgtctagtaatatccaccaaattcattcatggtaattactcaacatcattgctttcatcaatacaatttactctagagaccatagctacctcaatctgtacttttaaaaaaaacaatttcttattattttattttattctaactggtctatcaacaacagcagacttgaacataaatggcatttggtcagagaccagaagcccatacttagtcttaagaagtttggccggatgcggtggctcacgcctgtaatcccagcactttgggaggccgagacaggcggatcacaaggtcaggagatcgagaccatcctggctaacatggtgaaaccccatctctactaaaaatacaaaaaattagctgggcgtggtggcgggcgcctgtagtcccagctattcgggaggctgaggcaggagaatggcatgaacccaggaggtggagcttgcagtgagctgagatggtgccactgcactccagcctggcagacagagcgagactccacctcaaaaaaaaaaaaaaaaaaaaaaaaagaagtttaaggttctaggggctttaggaaaaaggcagaatatgaaataaattgtcagtagaaggctgctccaaagatgaagtatataattttaagattgcttttgttgattgaaaatattattgtactttattttatagttttatgtaaatacattgtcaaaacatgttaatctttgtattcatacataattctcttacatataattcataccacatgagttagaaactgtttaggttttccttccattgtgggttacaactcttcttttcttgtctaagcttccagcaagcaaccatgattcaatttgaggaatttaagatgaacagaacaattcttggtccaaggtgtaatattaccactgacatcaaaagaggccatataatgttgtggttaagaacatagcctttgagacagactgcctaggttaaatactagtcacatttaacaccttgctcactcttaggacctttgaaagttaattaaattttctgtagctcagttgcattatttgtaaaatagatgttgttttagagtagtgtctggcatatggaaatgctttctatgttattgtgaggtaaatttttattctaaccaagtgagcaaatcacttaaaatatgtctgttttttaaaaagcaatgactgtcatttttttttttaatatttcagtagaagtttcttccatttttaacattcaaaggaaaaccacattttattagtagatcaaataaggaatggggcatatgttaactttttaaaaaataatttcaaattttcttttatatttaggaggtatacaatatgcaggttgttatctgggtatactgtaaggtttgggatatgattgattccatcatcaggtaatgagcacagcactcaatagttgttttttaaatacttgtccctcttccaccctctccccttttctagatgtccagtgtctattactgacatccttatgcccatggctatgcaatgtttagctgctacatataagtgagaacatgaattatttggtttttctgttcctgtgttaacttgcttaggataacagcctataactgcatccgtgtggctgcaaacaacatgatttcattctatttttatggctgcatagaattctatggtgcatgtgcagcacgtttcctttatccaattcactgttgacgggcacttacattgaatccatgtctttgttattgtgaatagtactgcaatgaacatacaagtgcatgtgactatttggtggaacaatttgtttcctttttttttttttttttttttgagacggcgtctctctctcgcccaggctggagtgcagtggtgcgatctcagctcactgcaagctccgcctcccaggttcacgccagtcttctgcctcagcctcccgagtagctgggactacaggcgcccgctaccatgcccagctaatttttttgtattttcagtagagacggggtttcaccgtgttagccaggatggtcgcgatctcctgaccttgtgatccgcccgcctcggcctcccaaaatgctgggattacaggcctgagccaacgcgaccggccgcaatttgttttcttttagatatataaccagtaataggattgtgagtctaatagaagagctggtatcaagtctgaaactactctaaaatatcaaggaggagagtctgctccctaactcattctacaataccagcatcaccctgataccaaaacctgtcgaagacacaaggaacaaagaaaactataggtcaatattcctgatgaacatagatgcaaaaatcttcaacaaaatacttccaaggcaaataaagctgcacataaaaaacttaatctaccattatcaagtaggcttcattcctaggatgcaagattggttcaatgtatgcaattcaataattgtgatttatcacatggacaaaattaaaaccaaaaaccataaggtttttgagaatctccaaatttccacattggctgaactaatttacattcccaccaagagtatacaagcattcccttctctgtgcagcattaccagcatcttttgttttttgacttcttaataatagcattttgactggtgtgaggtagtatctcattgtggttttgatttgcgtttctctgatgattagtgatgttgagcattttttcatgtttgttgtctgcttgtatgtctgtttttgagagaagtctgttcatgtcttttgccaatttttcaatgtggttatttggtttatgtttgttaaattatttaagtttcttatagattctggagattagacctttgcgggtgcatagtttgaaaatactttctaccattgtgtaggttgtatttttactctgttaatagtcttttctgtcgggcagaagctctttagtttatgtaggtcccacttgtcaatttttggttttgttgcaattgcttttgaggacttgccataaattctttgtaaatgcaaacatcaaggatagtgtttcctaggcttccttttaagattcttacagcttgaggtcttacacttaaacttttaatgcatgttgagttaatttttgtagatagtgaaagtaagggtccagtttaattctgtatgtggctagccagttaactcagcaccatttgttgaatagggggtactttccccattccttatttttgtcaattttgtcaaaaatcagatgattgtaggtatgtggctttctttttggattctcttttctgtttcattggtctatgtgtctattttgtaccaataacatgttttgttaccagtactatagccttagagtatagtttgaaaaaaagctatgttgtttttgcttaggattgtgctttggtttgaacttgtgtccccatccaaatctcatgtcaaattctaacctccaatgttggaggaggggctggtgggataaaactggatcatgggtgtaggatttgcccttgctgttcttgtgatagtgagtgaattcacacaagatctggttgttttgaagtatgtagtaccttccccttcattctcttcctcctactttggccatgtccccagccatgcttcctgtacagcctgtggaaccaagggccaattaaacctcttttctttataaattacccagtctcaggtagttctttataatgatgcaacaatgaactactacagattgctttgtctatttgggttctttttggttccatatgaatttcagaattttttctaattctgtgtaaaatggcattgaaagttcagtagcaatagcattgaatctcttgattgctttagagattatggcaattttaacaatattgattcttccagtcaatgagtatgaaatgctttttccatttgtttatgttatctatgatttctttcagcagtgtgcagttctccttacagaggtctttcagcttcttggttagacgtactatctaaaagccctacttaaaaggcacagagtgatgggttggataaagtaacacccattcatctggtatcttcaagagacgcttctcacatgtaatgatccccataggctcaaagtaaagggctggagaaagatctatcatgcaaacagaataccaaatggaacaagggtcactattgttatatcaaataaaacagcttttaaaccaacaacaataaaaaagaacaaagaagggcattacataatgataaagggttcaattcaaagacaagacttagttatgctaactatatacatatgcaatattagagcatccaaattcatgaaacaaggacttctaaacctacaaaaagactgacatagcacacaatgatagtgggggtcttcaacaccccactgacaacattagacaaatcattgagtcagaaaacttccgcagaaattctggaattaaatttgacacttgacaaattgagcataattgatgtttacaggacactccatatatcaaccacagaatatacattcctctcatctgcacacagaatatactctaagatcaaccacatggttagccataaagcaagttggaaaaaatccaaaagaaggtctttccataaaacaagtctcaaagaaatcaaagttataccaatcacataccaaccacagtggaattaaaatagaaacctataacaagaatatctctcaaaaacacacaaatatatagaaattaagcaactttgctcctgaatgagttttggattgtaaggcagaaattttaaaaaattcttttaaataaatgaagaaagacacgcaaaataccaacatctctgggatgtgggaagagatatgttaagaggaaagtgtatggtgctaaatgcctaccttaaaaagttagaaaaatctctgattaacgatctaacaccacatctagagtaactagaaaaacaagaacaaactaactcaaaagctacctgaagaaaataaataactaaaatcagggcaggactaaataaaattgaggcataaaaatccataaaagcatcagcaaaaccaaaagttggttgtttgaaaggacgaataagatctatagaccactgactatatgactatataaacaaagaacaaaacagagaagatccagataagcacaacataaatgacaaagatgacattacaactggtccaacagaaacacaaaaaaatcctcagagactattatcaacacctgtgttcacacaaactagaaaatatacaggaaatggatatattcctggaaacacacaatctcccaaaatttaatcaggaagaaattaaaaccctgaacagaccaacattgagttccatattgactcagtaataagaaacctaccaacgaacaaaagccccacaccagatgaactcacagccgaattctaccagatgtacaaagaagagctggtaccaaatctactaaaactattccaaaatatcaaggaggagagactcctccctaactcattctacaatgccagcattaccctgataccaaaacctgttaaagacacaaggaacaaagaaaactataggtcaatattcctgatgaacatagatgcaaaaatcttcaacaaaatactttcaaaccaaataaagctgcacataaaaaacttaatctaccattatcaagtaggcttcattcctaggatgcaagattggttcaatatatgcaattcaataaatgtgattcatcacataaacaaaattaaaaccaaaaactatacgataatcccagtagatgcagaaaaagctttcaataaaatccaacatctcttcatgataaaaatcctcaacaaactctgtatcaagggaacatatctcaaaataataggagccatatatgacacaatacagctaacattaaactaaatgtcgcaaaagctggaaccattccccttaagcactggaacaagacaaggataccattctccattctcaccacttctatttgacatagtactagaagtcctaactacagcattcaggcaagagaaagaaagaaaatgtacccaaacacgaaactaaagaagtcaaactatctcttctataaccaggaaacctcgatgacatcaccaaaaagctcctgaaactgataaatggcttcagtatagtttgaggatacaaattcaatctataaaaatatattaacatttttgatgtgcatttaacatactaaaatcatgacttaatatatttcagtatataaccaccgattgtttaaattacatagtgataatggaactatactttctttttaaaaattatctgaggaatgtttataaataaactaaaaataaacaactcttttttgatacatacagtagacagtatacagcttctaaaagctctttacatggtgaaataagatctgttattccaaaatctttccaaaagaacttttctgttattagcttgtttttcaacattatccaacttgtctctgtgttttgtaattgaaatataaaggagaaaggaaaaggataatatttgtgtccatgtggaaaacaaaattattcatcaaacactttatgaaaagcagcttttatttccatcttgtttctgaaagctaatttgttattttttctaattattcttaatgaggaggctcagaggaaattcttaatcatgattcttactaagacactcaacaaggtcaaaagataaaagctgcagaatcaatgtcactgtttaaaattacactcttccaacagagagattcttaataagtctttgtttgcagagtactttgactactaaataaaattctttgccacaagacagttatgtgtacttaagctgcattaaaaaaagcaaactgtatggattaatttttgaaacaaaaattataagcatttaattacttattaaagaacatatccatgtaaatatgtccttagctgtccagttgtgacagatgttagcatgaaatagatgtgccacatttacaaggtacgggatgttgaagcaattttcctacttaagtgaagtaatataggcttatatttctggaacttcagaagactgtgctaatatttacctttctgtttcatcatctaggatataactatttttcacttatgtgtgaagcaggaaagttgttagacatagcaggaaaaagtacttcgtatcactggctggcagagaaagtttatatatttgagtttatacaggtaactggaaatttagaagtatttttcattgccttattttcttattccttgtcatgaagagtgtttggactgaggttctactatgaaaggtgaatatccaagggtggaatgagtagggactgtggctgagagttatgaaagaagatgattctgaaaaaaataacagaaagcataaagcaaatatttcctactttttccatacatcacatcttgctttctcagaaatttctctgctacaaacccacctgataacaccttccttagagccatagagccaaagtcattacagaggaatgtttcatatagaacaggaagttccaaatgaacctatgttctttttgatacgggagtactgggaagggaagagcgtggtccctttaaatgacatggaagggggaaagggaagtgctgagtggagaagggcgtggtccctggctagggctccataggtgaagactggcgctcctgcttttgtgcccaaatgttgcattttccaagaccaccctggcctgccatgcccccatcctgggcctataaaaagccaagaccctagcaggcagatacaaatacaggtggatgtggtgaggaacacattggcagaagacataagcggctcctagactccaaaaggatgtcgagggagcacaccagcggaagagcacaccgacagacactggcacgcgtgcaggccacccactggtggaaggaggcggagtttggtccggggaagttggaggagagccgtggccccccaaaactccgaatggcccactccaagggaaaaccatctcccttctggctcccccattggctgagagctacttccactcaataaaactttgcagttgttctccaagcccacgtgtgatccgattcttccagtacaccaaggcaagaaaccccgggatacagaaatccctctgtccttgtgataaggaagggggtctaattaagctggttaacacaaatcgcctatagatggcaaactaaaacacatgccctgtaacacatgcctactgggccttcatccctagacactggggtcagagccccacatcctgcccatttgcatgctcccctagaggtttgagcagcggggcactgaagaagcgatccacacccccaacgcatgccctgcgaggaggacaagggaacctttcccatttcgttttcattgtttcacaataaagaagtgacaagggatggatgtctacctatgtcaactgtttttaaaaataatatttcatgtaatgaactggcctatgaaatttgatcatatgatttggatcattcttgtcacacccaattaaaagaaagttgactagccaggggaaaaaaaatcaggacatgtagcatcgctctagaaacgtaattttctgcaagtctggctgttgaaactgcctattctaacccgagacagttttatttataactgctgagacaacttgcaactccagggctaattttccccaccgctgttgctcaccaaacagagtttgccagctccccagaaacttactagtcccaatgcactttctctaagagcaatacataacatttctcatttttataaaatcaccaaccttctctttgttcttcagacataccgaagaacacctgacccgtgtgtatgctccaaattgtgattctttattctcaaagaaaacattgaatttagagatccatctccacatttctattttgacttcaacaatcccattctgcatcataaaccttgagagaataatatccaaaccaagtcagatcagtaatttgatctgacatttcttggggtgaaagaaaacttttgttggcaagtttagcaaaagggactttggccacatgctgaagtatgcatatgtacaaatgaattacttcaaggaaaatgagctaggataacagtttttatattggccataaggataaaaacacattattgattaactgcattttttggagcttggaagttttcttaagaattctctaaaactgaatataataaagtgctaagacaagtattttaccacccttgacatttagaaatgaagtttttgatagtttgttatccacatgtataacatatgatgtggaaagttttatgtcctgctgagcttagttctcataggctcaattttagacaatttctatacagacgcctgcaattttgaatatctgctgctatttatgaggccttcccaagggtggtactccatatttaatttaattgtgtttgcatatatcatacattttgccaacagtaagctctaagagcactttatagttgataacaacttccttcattgctttccaagctatatgatttcttactataaaaccagccttccaccttcagtattgttagttctaacggcatacacgcaatggttttctctactatgttcaaaaagagggtaaaactactaagagtggaaattaatctgttaaaaatttctgttacattaacagcattttattatatctctcctcaaattaatttacttgagtacagtgctagaattgttattctgttgttagactttatgccataaattttggtaatatgtctatcatcaggaggttgggattttcaaaatttttcaattatcataatcagagacaagacctaggaaatgagatcaatttagtccctctaatcacaaatgtctgtactctaaagttcatgaacttgacactaagggaaagccccagaatggattagaaaatgctaataaaagtggagaatgtgtgggaaaaaaagacacctggctaaaggaaggcatgtttccaattttagagcaaggacagagaaatttttacagtagatataagaattcacaaagcatagctgtctggagcaaataatgtctttctctactaaaatagcttcaatactactttgttgcagattgtactaattaacagttatgttaatgatggtaactcatcatcacaatttttattttatgcaaactctttaaataatagaaaagtatgcaatgtattttagaaagatttgtatccatggaacttataaccaaaacaaatgttaattaaaataaagtaatatttttcttctgtcaaattgtcaaaattttattaaaaataatagccactattggttcaagtaaggaattaaaattattttataattttggtgtagctataagttgtttctatataaagaaagaaaggagagaaagcaaggaaggagggaaggaaggaaggaagagaaagaagacaaaatggaaagccaatataccaagaacttttaaaaactgtcctttgaatgaaaaattttactttgggatctatagcaatatagagataattaaagaagtatatattgctgctaaaagtacttataatagtaaaacattatatatgtttattaaatcattatgatttaaacacactctgtaattgtgacagatactgtatattggaccacccactctaacacctcttcttgtatttttctttttgtgcactattgaggcagataaacttaaaactgcacttgccagactcatttgcggatagggtctaccttggaatctgcgaagcagaagacactctcatgacacaagaacataaaggaacaagtgagccaaagggaagtcagttaatcactgggcaggaagtgtatggttctttgggggcagctgtggtagagaaattagtgcaacaccaggttatgatagttgccatgatggggattgtacctatgaggtttccactagaaagttcagattcgtggttaggtatctatttggctctcatgatcttgccgctgtggcatccaagcttagttttctgatgcttctaagtcactagaccacattagtaaattcattacagatgaaagaggctacctggattctatgaaattggatgaatgaataagccattaaaatatatattcatgttgttaaataaattttgatgggatgagtaattctcatggaaagtcaaaaaattataaagcaggttttagaactgtctgtacattcttagttttgagtgtgaatatataaagtctttttaatattaaagactaaataaatgaaacattattattgttattagtgatttcttattgaattcctaaattgcttttaggaatttattataagaaaatagtgtcctttgcatttttataagaaataaatgcattgcatttattataagaaaacatgacaaacacaatttggaagcaaaaataaggaacttcatttgtttagaatacttatagtaaatatcacaaagattctaaatagaataataaccttatcacaatataacgtaagaaacactgtaatgtgaaatctgttttgttaaaacacatttagatttaaaatttcttaagccattggatatgccttgttatcagtgtcacacactgaaaacttctagaagttgtcatttcatctgatacatgaagagcaacagttattccttaacacctccttcaacaccgcatgattctcctcaattcatattttgaaatttgacatatggcactgatggtgatatgacagagagaatctcaatgtgtcaatgacttcatcatattcatttgggcaactgagctagagtcttctgctccatgaagtctgtaatgacattgtgggaaagctgtaggcaggagcttcatattcagatcaaaggcaaatacaaaccagggaagagctatcttccagtcaatatttgttggcatttgctatattataaaacttcaagcactctcccatttttctgctcaatttttcttccattcattgcacggtgagatatgttccaccatgaacaaaggaagttaataagagttttcaaagatacaataaaatagatgaagtttaatatgacatttaaccctattgcttctcaaacaaaatgctttatatacatagcaagctggcttgctatccatcttctgtcactattctctttgtttactattattttgttttaccttttctaaaatgtcaaatatatcagacacacaatagagtatctgatatatttgtagagcttaaaaatcaataatactacaataaaatgaatatttatgtcaccaccacctacaatcagaaataaaatcctgccactatcttataaatcttctgtgtgcactttgatagacttttgcaagttttagggctgtataaaatagatttacacagcacaaattctgcaacttggctatttctctgcattattatgtttttaggttaatccatactgatgtatatacctttagggaaataatgctgtaaagtattccattatataactggatcacactatttacctgttctttattggagagattactgttgcaataatttttatttgtattatgaacaaagaccagatgcatattctggcatatctctcttggtgcacaatttgaggaatattttaggacatacccttaggaacgaacaaaagtgctgtgtcatgggtatagtatatatttatatttacttagttaaaatcaaattattttccaaattggctatgccattttctcagttaccagcaatttcagaattcctctttctccccatcttctataagatttgatatgatattaaacttttgtcattttgattgttgagacttgatattttatgtttttaaatttacatttttttctgactacttggcaacttctcatgtgtttaatgaaaacatgcgccactgcactccagcctgggcgacagagcgagactctgtctcaaaaaaaaaaaaccaaaaaaaccaaaaaaaacccatatatatatatgttttatatatatatttatatatttacattttatatttatattttatatgtatatacttatatattttatacatatataaaatactcacatgttttttaatgtggcttatttaaggaaactttactgatcatagagacataaaaatatttttcttaagtttcctttaacagttttagatttttgtctttcatatatgtcatccatatatgtgaaattatctattgtaattatttattaagtgttgaagaaccattttaattttccacatgagaaataaattatttgaaaaactaaggaaagttaattatatccattttcacctctaaatatcacctatttatacttctattttccatggtatattatggatccatttctgtacctttatatatatatgtatatgtgccttatataaattattatataatatatattattgtatatatttatattatatatttaatatatagtatatattatatataaatatataatacttatataaatatatatacatatgtttgtttcacatatatatacaacattgcttggttcaatttgttaataatttcttaggaaaatttttatccctcctgactttctatggtttttggtgacaacattttcctgtgtctttgaaggctgaagaacattgtaattttgttgcctagatgtttcttggatttcttccataaaactttttgagcctggggtttattgtgtagggaaaacataattgctagtgctagaatttaggttttctatcatgtcagatgtcgctatgtatagttaatgtttttctagaaatgtgtctattttgtacttttttcaatttattaacatatatatttcatatcatctttatctaaaaatctcagtctcttctgcagctataatttcggcaataccagttttaatattatttatttggcttctttctttaatttctatttttcctgttcattttaattataaattaaataatccttggctttgttaagtctgcattattttgatactttatgttttttattatttatttttatcttctttgtccttattctcttttctttacacacacacacacacaatatttcagatagatgcttattttgttgattttcagcctttcttcttttcaaccatgagaagttaaggctataaattgccccctcaatgcttttagaatcacatttcaaaaatgttgaaaatttatattagtggtaatttagctacaattgtcttctaattatgatttcttttttacccataggttatttaaaagatagttttaataaatacaaatgtatttattttacatatttttattactgaattactaatttatgtagatgtcagagaatgtgggtatactaatagattcttttgtaaaatttatcgaaaccttctttaatgcctagtatatggcccatttttaaagtttcatttgttattaaaaataatgtatgttctacaacttaacagtagtagtagtatcaaacctatacctttggtataggtttttatatatgtccactggaaagtttaagtatattttgatatattcagtatcttattgagataggatattgtgtctgctaatctatcaattgttgacaataatgtgtttaaatcttctacagtgatgtttgttaaattatttttgtacgtctgcgattttttaatttatattttaaactatgtagctaggtacatgcatatttagaattgctacatcttcttagtaaattgaacctttataattactgtatagtggccttctttatagctagtgtatttttgccttaatgctttatgatctggtcaggcaccagattttatctcctaactcctatagactctttaaaactcttaaaatcttaaaatataggatccagaccacaagcaatttacagacgctccaaaacaaatgtggattttaaagctttcttacatcaatagactcatgctttcttatcttatctgattgttgaatgattctatttctttttccatgttatcaccacattttaaaaagagtttgttttgttttgttttgtttttgttatccgtgtttttagggagtagttttctgaaattccagtcagctaaaatcctgaaataggaaaccaactgttattcttacaacttccactatgcaacctctctctcgctagaaaaatagtatttgcaaatatcaaaatataatcccctttcctgttaggtgagctgcatgcaattaaactaaacataatttatattttaaaaattattttttgccattattttcttgagccagtgagttctcttatttttgcccctgtgccttagtgtatgtgtctgtgtgtgtgtgtgtgtgtgtcacatgtgcgtgcacacacatatacaatgtttgttgtatttttttctggttaactgagactaaacttgaaatttaaagctggccttccatgaaaattatttaatgatgcaatgcaaagacaaattgctttctacatcaattttctatgcaagtacctataaatgttagataactaaattatcccagagttttcttcaggaaatatcagccttttattcaagtatatgattttctataaagtattgctattataatcttttaatgctaggtgaatccacatcaagcattcaatatttgttggatgatacaattaaatttctctctgcttaggttgagtttacattgtctttaaaaatgtcttttaggcagggtgtagtggctcacacctgtaatcccaaaacttgatgaggctgaggtgggaggatcacttgaggccaggagttcatgaccaacctggcaaacatggcaaaaccccacctctactaaaaatacaaacattagccaggcatagtggcacacatctgtaatctcaggactagagtggacgaggcaggagaatctcctgtacctgggaggcagaggttgcagtgagctgagatcacaacactgcactacagcctgggctacaggctgagactctgtctcaaaaaaaaaaaaaaaaaaaaaaaattaatatcacaaacatggtaaacataaaaattatcacagtgtaaaggaaaaagtaatatatactcacaaatataaacagacagtgggagtggggacaaatttgcattcatattgaatcaagacatttatatcgcctctatacaaaaacaagatgaactaaactaaattaaagggatgttaatctagaaattaaatgtatcatgtcagctagttttaatatatggatgctttgggcattgtaagattaaactttctgaatcataacagaatgaagctcattaaaataaaataaacttacccaaatggaagatgacctaaaagaataatttttgggcaaaatattataaaaatagctacacagatattagaaaatataacaagcaaaatttgatttttactttggtgtacaatgtcccaacattctgaataatacatacccttttctcttgaaaaatatgtatatactgaatgactttaaaacaaatctagaaattaaatgtatcatattttccatactgtttttgtttcaatcagattttttaaaagaactttcatctctaaatttaggaatctctttttacaattttttcatttacagctacctcaaaaaatagtatgtattcctaaaataatatagtataaatttattttgaacatcaaaaagaatctgagctcacctatagcccacaaatggaaatgagaaactcatgtgttttcatatttataaacacatattacatcttatacaacacattatgaaaaagaaaataaataaaagcatgctaatataatttgaatgaacaagaaatgctggaaatatttgaattctacctttcaaccacattaattagagcttccactaaatcatttccagactcatataactgtaataatttcacacctataattatctctccatgttccctgctatgtttattttacttaaattagacatatttcagtatgttctgaagattttgccttatattcaacattacatatttgtttaaactcctcccttcatgaatgtactctcctctgattctataggaccacccctcatctatttttatgcactagctccattatgaaacctttcaaaatcataaaaagtagaaaattttattcatagttcacagttgaagaaaaggcagctcataaccttgaagcctatatcctactgtgatactctttgtaaatgatagtatgagaattaagcctttatttaaaactttttcatgtcaatgtcagttctgtctccaaaacttaaatggcattattaatgaatgtgttacaggcattacaatgcagtgattaagaatacagccgctaataccagcttccttgagtttgaaacctagctcatggctccctcctcctttgttttgggaaaattacttacactttatgtctcagcttccttattggtaaaaaatgtataatatgcaagtctaccttatagaattggtggaagcattaaataatgcagttgtgaaacatacaaaagagtatctagtggatggtaagtgtaaaagtagtattaactattagtatctactatatggggttgtgggttgaagtccactaataatttgtgtcaacattactctggtaagagttcatggcaatgacttgttgattctaggaaatttctgttcatcaatgtattgtaaaaaataaagaacttcactgttttttatttttccatgaaatgcctacagatcaatttactgaagacaatagtctgcttatttgtgcaaacagttcacttatgaaacaagtttatttcttcactatacctaccaattctaaattattatgtcatggattttttccattcctaatcagttccttctcttgaaagatctgcattacacaacttgagaccagactccaaagctccataaatatcccattctgacctcttttaaacacttctaagattctgtcagggtggtgtgctttttgattacaatgtattccaataaattcaggtgtactttacttacagattatctggtgatatattgaggagagcaatgaactgtaagcaccactgtgttctagctgagatcccctctctgatgtgtcttaagatccttgacttgcaaaatgaatgctctactggggaagccttgagagactctgcaactgtgatggtggggtctaggtattgatattgtgtctcaactttggtcactgtcaagttcccaaatgttagttttattttgtctaatgggaaatagaatctattttaggactttttctgtgatctgtttagattggaaaatgttaatgtttgatttaaatctgctttattgctaaattactcaattgtgtccttctgtcctcatttttgtgagtctctaagaggaggtttatacaaaaatggccagacatggatcctgataagttgattcctagagccagctctggaattaataacttcagaaggttcctcctcggactggtatccctcacataaattttccctggagtcaactcttcaaaaccttaggcaaatgtttcttattcttatcctgttcagtctttgagagtcaggttctgtataaaatctcccattaaaaaagtttatgttatccaagaacctcagattatcgaggctgggattaaaaaaaaaatcattaacttggaggcctgaaaacactatgcaaaagcaacactttctactgcttgttgctagattctcatggctttgaatcacactaagtgtatgccttctgtaggctgaacccttgcctcatatatgtatctacattataaatctaatttccatgactgtctttcaaaaaggcataatttctttacaaataatttacagttaagaggctacttggtgaaatttttatattaacagaagttgttaatttgagaggagtcttaaaatggaaaggaggtaaaattcctattacaatgtgaacttaatggccttttccctactttttattttcccctgtctttgtttactcaatacccttttgccttactccattttctcacctggccccttacctcctggattacacaacctgagtttcacaaatctcaattgcctcttaaagttaagtcctctttagacatcaacaagcttcttatagtttatttttagccttcattctcagtctgaactaagaatcaatgtaaaagtctggacaaagtacagaggaatttagaatcattctaacaacatatatcgtaggtttcccagatctacgtaagtgattcttatgttagtaagaaaattaatgtaaaaaaattggattaaaaaatgaagacttaggataatctaaggtgaatgaaagaccctgaatattagagaaaaccagaagtatttaggaaagctatacacagtggagaaaatattttggaggctaccccaagactttcctgaaaataggttggacttccatctcattataaaaagagaaagaatgaatcaatttgaaactttaggaacaggacctccaacacctttagaaaatattcaggagtagatcttgagacagacaggacctaaaccctctcatcatttttgcaaagagccctaaaccaaaattagggaatgtaaaatggaaaaagtacatcggaaaatgacttcattgacaaacagaactccaattcctaactgaacattttgaaaaagtcatggaataaaaacagaataagcctctgaataagttaacagccttacagatgaaacaactggctatttctcctcaatttatcaagtatcagaggaggaagcttcctgaatacaaacattgatagataactgtaagcagaaaggacattggaaaaagattcataaaggacattggaaaatagctattctgcactaactgtgaaactaaaagaaaatttttaaaaaggaaggatgtgataagggaagttgatgctgatctgtggggtcattaattccctgatgtcccatttctctaaacattaacagacagtatcaaggtttctgattgattcaggcacagtaatatagtttacagaccctgccacacatgcattcagtcactcccctagagtcaataaagtatttaggagatgagtatttgcaaaaatctacagattattgtgtatcactctatagcttttgccctcagatctttaacatcgtttgctcatttgagacagcacttcccctcatttaataggtagggatttcctatgtaaacagaattgctaatttaagtgctctcttgatgggctttctcttgagatctctaaagaatcacctattcagcagggcacggtggctcacgcctgtaatcccaacactgtgggaggccgaggcgggcagatcacgagctcaggagtttgagaccagcctgaccaacacggtgaaaccccctctctactaaaaatacaaaaaaaaaaaattggccgggtgtggtggcaggcacctgtaatcccagctactcaggaggctgaggcaggagaatagcttgaacccaggaggcagaggttgcattgaactgagatcatgccactgcactccagcctgggtgacagagcgagactctgtctcaaaaaaaaaaaaaaaaaagaaaagaaaagaaaaaagaaaaaggaaaaaaaagaatcacccattcataatcatatcacacctaatttggactatggagtacaaggagcctggtatcgacatcaaactcaaattgaagatctactgatattggctgaattattggggaagaacacctcacatttctcactgacccatttaagcctccatctacacttgccctctacaaccaaagggaaaggacaaaagccagcagttgtgtctaacagaaaaataattacgaatactatgcactagtccttggaacactcctattcttctgatcaagagatcccagtgggctggggtacccatttatttcagaccttgcaactataaataaaatatttagccctgttttcctgtggtgccaaaattctatattattttaatttccatgctacctgagattatgtattttagcattctaaatccatgttctgctgtttgtattgtcccttttagatcataatagaaaatactcattagtctttctctagaaaaatcaatgatgtacctggacagttttactgcagaagtgtactgaggcacccaggtaccttatacaagtcttctgctagacactgaaggaccttgaatctctctataattctactcttatccaacatgcagacaatttttgctatgttgtcaagatgagataatttttcaggttgattccaactactacttatagctcagaaagtatataatgtgttcaaagaaaaattagaattttgtaagaagaaaatgcactatttagaacatgatttataatccatcactctggagagattacaaaacactttttttttttctaaaactgttaagaaaatatacttattttaagagactttttttttttcggctgtagggggtgaattttttttttttttcagtgagagcaggttaattaggaaagtaaaggaataaagaatggccactccatagagatttcataggttattacatgcaatgggttcccaatattactgaaattactgtacctctaaattttaacttagttgttagtaactcaatctctttgttgtattataagcataattagctgtaggggtgtgtctctgtgtgccctgggagtggcagggttggggttgggggtgggaggagtaggaggctgtgtgatttaaaattaattatttggccttcctaattatcttagatctttttaccaatttgtgcatgatcaatttggacaagccattggtgttttgactttactttatcagaatctttaaagactattcatctttaaagttatccataaatttttcatagactcagtggcaaaaggctactcaccttgtctaagggcaacagccagactagtgggtaattacagtgggtaatcttctgatgtttctgcattatattctctactcttcacctaattacctctgaatgtcaccaaaactgtacagtaaattttaatcacacaaggaaggtattttggacaatgataagtctttgggtagattctaaagaccagtgttaggtttgcaaaacaaaagtctattgggtgtggccaacaaattataccaaaaaattgttatctttgtaaatttagacactatactttcagaatggtgcctaatattactcatggatgatttgggcacatttccccctcaaaccctagaaaaagagaactctagataatttcattcaagaaagagaaaaacagggcctcattttgagatatacaacattactcatgtctaattctgaatagttttctcctgtctttaaatcatactatctgtgcttcagatattatcaggaacactgaacaatttcagtgaggccatagaaatcatcacctggagatttcataatactgaggaggtggtacttcttcaaaacatagcagtacgagaaataatattggcctgtcaggatgaaacatgaggcattttacaggaggaaagtttactcatattcctatagttctttctgtttttattttattaagaaaatatgggaaattttttaaaaattacaagacaaggtgataaatctagtattcccacatctgaccattaaaactttttggtttggtcatgggttccattgtattgctttaatttaggcatttttggctcttggcttagaatgtaaaatacttctgttagtatctgtctgtgattcagcattcaaatatcaggttttcataatcaaaaatatttctatgtagccactctgatatgacaataaatgatcatgcagccaaaacaaaaacaaacaaacaaacaaacataaaaacctaatgtatatgatagttgaaatgatcccaccagaaatctgatatgcaatcaggaccctgaagacagtggtattgattttgattgattatttgtgcagatgattattatttatcctccagcttaggttgaaaaatgactacaagagagttctgagaaataagaaaccacctatgttaacaaaactttttattgtttgcttcaaaaatattttctatgaaaggataaaatcataagccaactaattttattattttcttcaggaaatttccacagatcaatttattagagacaacactctgctcatctgaataaataatttatcaaacaacagtttacttattgaggctgcttgtttccacatgcatctcgctctgcccaccagtcttaaattactatatcataaactctgtataatctcagttaattccataccttaaatgactcagtttaaatcactttaccacaatccccacacacgttaagtacctcagttttgacttccctcttctgaaacattgctatatcattgtcaaggtgatgtttactcttacctattgtagtaacttctataacatttaaattttattactacattatcattcttggactaaacagttaaattgtagttattgttctttcttctattactattaatactactattttggtatttctccatcatttactgttgtgggaaaatgtgagaaatatgactgtatatattttattttattcacccaaactagaatatttgtctcttttatacctctccaaagaccccacttctatttttaaaaattagttgatatactattttgtatacatgtttgtttctatctgcttatttagtttacatgtttccttttattctttaccatctaagtactcaattcaaataagatacagagataaggtcagtttctgatagccaaagaatagcaataggtttggcacaagaattgcgcaggttcctcatgaatttgactctaagaaattgtgaaatctcggggaagacacacgaaggcctctgcatcccagttttcccttatctcacttttctcttctcttttcttttatcatatgtatgctatgtgagaattacaataattaaaatatgtaacatatgagaattaaaatatataataaggatagagcttactacaacacctagcacatcctaagtgctcaataataatccttattactttgtaatgctcctgtgagtctgaaaaataatgtatttaaggctcctagtagatactcttttaacaggaactactaatcttgttattgatattaatatagcttggctatattaatccaggtggatcaacatcctctgtataaatgaaaccacctatttacaaggtattccacaataattcaatgttgcatcttcagcaagaacaagccataggtctgaaaatgtaagtgcaaggcattgagtatgcatttgtgtatgtggtctgattattgctctgaagataaacaactactgagaccatatattctgaatcctcttacaggaatacagtatatgattgaattttttttctatctacagcttgcaatgactaaaaaaatgttggtttgttcccacaataaattccctccaagaccacaaatgagaaataccactttacatgtgcataccttaatgatgacctcttcttgaaaacaaaacaagcatgctttagacagaattagcttctcactgtagagatgactggcttaaatgagaattctgtctttgctctaataagtttatttgacatcttggtttgtcttatagtaaaaaaaaaaaaaaaaaaaaaaaagaaaagaaaaggtggtttgctccctttccccatggtgttaaattaattccatgagcagttttgttactctacacaataatacagtgtgtccccttatttatgtcataatgtgtcataatgtctattgggaaaagagatcaatttatgtaactcaatttgttgtctttaaaggagtttaacattgtatttgagctggacattggttgccttgagctttgagaatttaggctgattcatcatgtgaacctgttgtagaaatgaccttctctaggcttctgctttagtttttacatgaatggtcctaatgtccgcctatagaagattttgtgcacatgatgaccttagggttaatctacatcgggaaacacttaaattaccataataatgttctctcgaaattcttaagtatgattaatgttggttatgtatcggcctagatagagatttctaaaagtgagtgttcctgagtgctttggatgatactttgtaagcatatagacatgaaactatttaaaatcattgcataatgttgcaatatatcaaattattttcctcttgacgtatatttagattgttttttgtcactcattaaaagaatgctacaaggagttttttttatgtacaacactttgtgaccatataaaggcagttgcctagatttggaatttgtatataaaaaatatagatacacacttttgttaaaagcttaaaatttgccctttcaaaagaatgtacatatttaatttttcaataatcatgtataaaggtgtcagctgtattttcataagtttaaatgaaaataactgcttgcgttatagatttttcttttttatgttataaaataaaacttgctctaatttatgggtagaaagaatatgccttacaaatttaattaaaagttttaaatgttaggatataatgaaaatcaccccattcttttttatttccgaaacaagaaagggatgttaagtttttcaaaattgattcacatgagctaacattaaaaccattggatgggttgtgtttgtgtccttgccagttagtaactttattataaaatctctaaatctattaccttctgtaaaatgattttgaataagcatctgtgtaaaaattgttttctttttcactggattagaaactctgttaatgtgaacacagtaaatgaacttaaagaaatagtcaagagtaagaaaatatgagaaaataacttttaaaaataagttggcaagtcaagttctatggaaaaattaaaagacgcttaaacatcttaagtaaaatttcaacatgcctgttacgacacatccccaggaagtttattttcataatatttgatgtgattttaaggtcatcatttaagagaaaataaaaaaggtcatgaaagggattttccacatgagggcttccaattgaaaatatttacatataaaatgttaattgtagaaatacaatccaataatgaacaaagttcaaaagtgagtaaaccctgaagcaagacaaggcaagatatgtaatatctatcaataaaactaaaacattttcaaacatttggtgggaaagactatcttagttaatcagggacttctggcttaaggaaagaaagcaacttgtcagatttaatcaaattcatgggaatcaatagaattgttttcttttgttggttttcccagatatatgtaccaatcagcagtggtgataacttagatgaaaggaattggtggaaggagaaaggtctcttcaaaataggatattatctcacttcctaggtttcataatctctaataaagcactcctaatttaaattgaaaaacatcactgtttatttcatgcaataaattaaatcaaaatatataactggtttgatatttgtttccaagtatttgtcagtctttagtcaacaattcattaaaatgaaaaaaaccttaattctgatttacaaaatgaaaactatcaatggtaattattattattattattatttctatttttagtagcgacagggtttcaccatgtcagccaggatggtttcgatctcctgacctcattatctgcccaccttggcctcccaaagtgctgggattacaggcatgagccaccgcacccagctttttttttttttttttttttttttcctgagattgtatctccctctattgcccaggctggaatgcagtggtgtgatcttggttcactgcaacctctgcctcccaagttcaagggattctcctgcctcaacctcccaagtagctgtgaatacaggcgcctaccaccacacccagctaatttttgtgtttttagtagaaatgaggtttcaccatgtttgccaggctggtctcaaactcttgacctcaagtgattcacctgccttggactcccaaagtgctgggattacaggcatgagccactgtgcctggcctatcaatggtaataccttattgtagtatgtaaggattgtataattctattggatcttgaaaggttggtaagaaatcactgaaatgagtaagaatggaattcagtaactcaatattgatatcaagaaattagaagagaaaacaatacattgtgcataatgaagccaaagataagttaattattccttttatgaaaggtctctcatggcatacaaagtcatgtgatacacagtagcacacctcatctcttacatatgaaattaactaggaaagtgtgtttttcaaaatgggcatgaagacattagtttcacaacatacttatatataatacctagatatacatacatgtaacatatacaagtatacatagcacatgcttcatatatatgtacatatatgaaatctcactctcagtctctctctcttgatatacagacagaaagacagagaggtagagtttcatgtatagagagctatatattataactctttatatatagcacggaatgattgaaaccaaatcatttcaggtccaaaaacatacaagtaagggccccttttgtcagtttagttaggtcaatattatacccacctctctatttgaacttgtctacatgaactgtctctatgaatttcagtaaagtggtaacatgaactctaatgtttgttggacttaaccttttaggagcaatacggaacactattaaatgtttatttactcatgtataggagataaaagatagtgaattcttagcaggcttcaaactaacttttgagcttgaaggtacttatcaaaacttataaatgataaaggaaataaaaaaagtgctatcaaggtggatttttaaaacaatttacattttgcttatcattttgatcttcctcttatgatctatacatttgaaaaataaatacgtctatattattgcccaggttttgaaataagcccagttactaataatgccacaagctaagactgagtctactgttaccataaagccagattagcaatccaagggcctggggaacttccgcttttttagcgcttttcctctggtgggtttgttcttgcatttgaacaaagctatgggtttacatgagtaattgcctaagtatctggacttgccgggtatcactgacaacaggcccaaattataattaactcaaagtaccgtgttaactttttcagccaaaaatacatagaccataagatattaggctttctggaagagtctaagttattggctctggcagcaaaagagtaacatattaactgaagagtaaagacaaagcttcagacaaaggttctctataaataattgtgtcaagatgtcattacatcagtggaatgtagctcaattaacaatatcttttaaaggacatcaccttgccctaccaagagaaggtagctgttaaattgtggctccagcttgaggtttgataatgtggcagctataggatccatttcctgttctagttgtgtatattgtggtaataagaaaagcaacagagccccaccataaccaaatacttttaaaaatacaaccttaccctaagaaattaagtaaaaacaaatcttattcctctggtcagtgttgaagaaaaaaacaaacattcgacttcgactggttgcctcacagggggagaaaaataatagtgcataaaagcaaagcaaaacaaacaaaaaaccttagtgagcctagctgacttgttctcaagaacacagaggaacatggaggagaggcaaggctgttgcctagttctaaattaattaattataaagaattacccccaattaaacactaactcactgcactttttttgtagattccttgtttttcccccccacatcatactgaatccaccaaaattatcatcaaaattttaaagcttgataaattattttgtctatccacttcaaatgattatacatcagacaagatccctaacgacatatcagaatgaattacatatctggatatgaaagaactaggatgtctaatttaaggcaaaggtggagtttgcaatattttagtgagaggattgagaagtatggctaaataggaattaaagtcagcataatccttacattaacggaattttattaaaattgtaccatgttatgagtagcagaaagtatttggaaagctgtttccatgtttacctttagtgtagtagataaaggctatctcaaataaaatgttcagtctaaaatgacggcacattttttcttacaatgattaattttagaaaaatctataatccaatttactgcttgaatttacatggttgcatataaatgatgtgactcctggtgtgaattaggtggcaaattagaaaagggctttttatttttattgttttttagtgagaaagcaggtatcaatataactcagagaaatattccctacatcttagagtgagattaataaatatgtctttgttatcaataaaatgggaatataattctatctctttgtattgttataaagattaagttgaaaaaattatgggaagtccatagtataaaactgagtaccctcaaaaaattactctacaaattattgtttatttctatattattttatcatgtatcaatacatattacattttcaaaaatataaaaatacctcattcttggaaaaaaatgaacatttaagagagacaatatgtcactttctcttcagcaatgtcaagagaaaggaaattttaaacagaaaactgcagatgtctattcctgtaacacaagtggatgcattgatctagcaaaatgagatgaacccaaaccattataagcaataaactcacttcattcacttggattctaatcacatctttagaattgaaatttggcttccaacttccatgttcctacaaggagaaaatgtaccacctaatattcaaacattccaacacctttcctttgtcaattatatttcttttattataaatcaacaaatttgcatgttgtcacatagttgtcttgcatgggtttggttactgtgatcccttctcctgactccaatcacatccagctatggagacaaatataaatttcttgatctgtgaatcaacctctggtccttgatttccccagacaagtatttctacccactgaggcctgaccttaacagccagccagtctctttagacagcaattatagccagtctgtttctaactattgcactgtatttataggttgaaactttttaagtagaaactagatatcaacagggctgcctagggtatttctgaatgatgaagacaatgaggatgatgatgatgtcaacaatgggagagaaaattgtctggaaagagcatgctgttactttctggaattatgaaaatattttattccttgtttggggtggtatttacctagctgtttgcaattgtgaaaactcatgaaattaaaaacttaatttctcgtgttttcttttatgcagattatatctcaatatgttcaggcagtagaaataactatgagatttcttcttcttaaataaaatggaaggccaggcgcggtggctcatgcctgtaatcccagcactttgggaggccaaggcaggtggatcacttgaggttgggagtttgagaccagcctgaccaacctggagaaaccccatctctactaaaagtacaaaattagccaggtgtggtgatgcatgcctgtaatcccagctacttgggaggctgaggcagtagaatcgtttgaaactgggaagcggagtttgcagcgagctgagatcgtgccatttcactccagcctgggcaacaagagtgaaatttcatctcaataaataaatacatacatacatacataaaatggattgtgaagatttgaatatggactattcaatttgtggtataattttttgtcatatttgaagaattttcttcacagagaagctttaggtttacaaaaaaaatgggaggaaggtatagatattttccatatactcctgtccccacccatgcataacttgtattatcagcatcccccaccaacgtggtacacttgttacagttgatgaaacttcatttacacatcattatcactcaaatactagtttatattagggtttattctttgtgttttacactctgtggctttgactaaatgtataatgagatgtttctatcattatagtatcatacagacttattttcactgaccaaaaaatcctctgttctctgccgattcatttttccctgaccacaaccccctgacaatcactggtgttttcactttctctatagttctgcctttcacagaatgtcaaataggtgaaatcatagcgtatacagccttgtcatattgcctttttccatttggtattttgaatttacagtttgttcatgtcttttcaaggcttgatagtacacttacttttagcactgaataatagtccattgtctgaaggtaccacagtttatttatccattcacttactgtagaccctcttggttgttccctcccaagttttgaaaattgtgaataaagatgctgtaaacatctatgtgcagatggatgttttcagcttctttgggtaaataccaaggagaatgaccgctggattttatagtaaaagcatctttagttttgtaagaaactttcagattgtcttccaaaggcactgtgtcattttgcagtccccagcaatggatgggacttcttcttgctccacatgttcaacagcatttggtgtcatcagggtttagaattttggtcattctaataggtgtgtagtgttatctcattattatttaaatttatatccccttgataacatctgatgtgggacatcttttcatgtgcttatttgctctctgtatatcttctttggttaggtgactgttacggtttttggcccatttttaaaatgagtggtttgttttcttattgttaacttttaacagatctttgtatattttgcatagcagtccttaatcagatgtgtcttttgtgagtattttctcccagtttgtagcttgtcttctcattcatttgacactgtctttctcagggaagaagtttttaatttcaatgaaggtcagattatcaatctttaaatgaatcctacttttgatgttgtatccaaaaagtcattgccatactcaaggtcacctaagtataattgtttttaatagaaatcatatttttgaaaaagaaatatagttaaattatatcatttcacattttttatcaatgcttttagctcttccaaaccattatgaaatagttgtatttttattgtgttataaaatcaaatcataattaagcttttcaaatgcaaagctaaaaaatgaaatagcataaccttttgaatcgaattgaatagttcaagatctctatgctctatgttcaagcattatgttaaaactgctgtcttactatctacagaattttctaattagcctaaagagatttttataatttacctataaatatattttgagagggagtgataataaaatcaaaataggtcaagatatccaagtaactttattgagatgtcaagtggcatccagcagaaggtgaagaagtcacagagttacatcatagaaggccttcctgctgtgctatttccttcaacagaaaaagaagctttcatcctctaaggcttccagcatctgctgaaactactttgagtaattcaatcttgtaaaaattatttctgctacgtatacttatctaacacataagtatacttataaaaaaataaaaccttgggcccacttgagaaactaaattatatttagtaaggagatcaattttgcacaccttggcttattgtgctctatttaaaaacatattttcaaaacgtagctcttttttttccctgtcatacacttggcttcagtcattttgctgtaattaaacatgataagtacttccccatgttagtaaggcctgtgaatttccttctgcttgaaatggctcatcttccagatgcctacatggcacaaggcctcctttagttcctgtctctactcatgcactgcatcactttctccaagaaatctacttcaccactgtctaaaatagcccaccacgcattccctcacatcttatcccctccctttttgtacataatacatatcactacctgatatattacatcttcatttgtttattcaaaaaatggactttgtagacttttaaaaaactgtaaaatatagtcttcaacaaatagtatgctttgtttctattttattgtggtataatttacattcagtgaattgcactgatcttaaatattactgttcaacagttttgatgaatggctacaccagtgaaacctgctatactgagaggacaaagagcacatatacttctcttccccaaccactatctaccccaccctttccataaaggaatacaggtagcctgatttatttcactattgtttacctgttacagaacttcatataaatgaaataatacagtatatcaagtttatgctacatgtatattatctaatggtacctttttctattttaaatatatagaatagcaaatatgagaatatttttaaactcatcatcatcattctaaattgtaaactcaatcatcaataaaaattaagatcttagtaaacctcacaaaccattttgtaaaaaatttttgattgccattttgtagtctgtaatatatgatttatttttgaaatgtgggaaacagattcaaaacctagtttcaaggaataatctataaaaattgctctaatataattttaaattatttattttggaacaatcataatgttttcagagaccatagaattttagcacaatatcctgatatttaaaaaataaaagaaaaaaagcaaaacccaagaaattaaaaaactacatatgctaatacagagtcaatatatacttggatagtttgttattactattgaactttttataaaattaaagtatatatatgaaaacagagaatttactaaaaactatactgtgaagaaaatatgtaaagcaatattcttgcacaataggccattcaattatcggtgggttttaatctcattttttatttgatcatgcttattgcttaatggtcatagaaatgttcctttatcaattttcatgggaaagttttgcagcagagaagttccctagaatcaacatgtcttagatgtttgtaaaataagtgatttctttttccaaaatgttaaaatcattagtacacaaaagtcattactacgttaatttattttaaagtgttccatttcagtaagcaggtattaaggaagttggtgttgggataagataattgtgccaaagtaaattcttaatggagttcataagagaggaaatacagtaactgttctactccaaggttggctttgggggatttttcaaaccaacttaaaagtcttggatgttatatctgactggaaattatttctactccctgagaatgaacaacatgctggcaacagtgaaataaggaagcttgaaaaagggaatgagttattctatgaaacagtctgtcctatacatcaagattcttttagtttctcactcaagactttaagatacacaaaaatcttgccgcaagatttctcgtaggtggtgtgacctcagtatacgttgaagtcagagattacattgggttctaacaactcagggtttttagataagatctaaagttaaaagctataaatcagacctctagaggagggctacattggtccaaattttcatgaggaatagactctctttgccaatacaattaggggtgtgtgtgtgtgtgtgtctgtgtgtgtgtgtgtttgtgtgaatgcgtttatctcactgtctcgggagtatgtaattgtgtgataggtggaaattcataaggagaatggatcaactacaagtggtcatgggtagtgccatgtggaaccatactggagcctaaggcaaaaggaaagtgtctggctatatacgtgacttcctgtgctttttaatggttatttttctcagaacacaaaaatagttttaaaaaataatgaaaacctggaaagtagagtattgaaacatacaatctagtttttaggtttaaatatctcatttatacctaaacctgaatatattataatattttcaaaatgtactcttttgcttactcatttttaattgagagaattgctatgtttgacaatttctcttgacaaatgtcttgattaacttttacttaatttcaacttactgatcctttcttttagattttgataaactatttcttgtgggattttcacattggatttctattttttaaatattgcattggaatatatttattctattattaagttgtgttggcattccttaaattctgcacccgaagaaagtgcttcacttgtgtccattttttttcctttcttttttgagatggagtctctctctgttgccaggctggagtgcagtggcgtgatctcctctcactgcaacctcggcctccaggattcaagcaattctcctgcctcagcctcctgagtagctgggatgcaggcatgtgccaccacgcctggctatttttttttttcttttttttttgtatttttagtagagacggagtttcaccctgttgctcaggctggtcttgagctcctggcctcacgattcacctgcctccgcctcccaaagtgctgggattacaggtgtgagccactgtgcccggcctcacttgcatcattctagttgcagccctgatgatgaattcttaggtttgaccttggattgtgtgtatccaaagtgaggcaaaagccaccagaaatgagatcaaagaactgagagcccaatgccctaaaacagactttccatgtagacagcaaatgcacaacgattataagaggaactgatgtagagtggagggcctcgagccagaaatttgaacgaggagaaactactggcaagacaggagatgcaagcaacaacaaagttttggggtacctggggcttaaaagagcagagatcttggcaaatgagaagataccagtcccaccctcttgctctgaggtgctgaagtacgagacaatagacaaaatttgaaaaaaaaaaaaaaaaaaaaaaaaagctgcaaagaaatggtttcctggaggaaagcatgaatgtcttaaatataatgggctttctgttcagtatttcagtatctggtaaatctcatcattagaagcaatgcagaaaattaatatattaccttcacaataccctcattagaacacaattataacaaccgaaaaggcaatgtactaacccatgaggactcacttaactcattacaatggtttagtgagctatattgagcttaaaacatatgctggaatggaaataaaaaaatgaaaaccctgaaaaataagctcttcagaggtttagaaatgaaatgggagtgatgaatagctaggagcaaggacatgggagtatacatggtgccaagagagaaggtatcattttactaaacacatacttcacctttttcacatttcatctaattttagcagcttaaaaaaagcttttgtttttagcttagacagaaactcttaggctttggacccatgttccaattctatacatcaaaaattgtgaaaatttctagagggaatgatggcaggacttctcagaaggttggaaaatggagggtgtgagttgaagaacagtggttaatgacaaaaattgtagatgaggtccacctgatcacaaatcatttctaaaaccatatttggggatttggataatttatttgcactcctaaacctctgtttcttcatcaataactgggcataatgatactactcaggtttcttatgagaattagatgacgaaataccgtgtttgtcatgtaggaaggtataataaattttacacctgcctacatgacatatatggtataattaatttataattaataacttgacttttataactaatttactgacaattacttattgagtacctgctatgtgttagggtaaagcaattcaagaacctaactgaactcctgatatttgtggcttttacattctagcaggtgtgccataatgagtgatattatttataacatcaaacgctaggagaatcacaaagagctgactccaccttgagtttgccttctagaaacagaaaaatagcatgaatcctaattttcacaaagtagatgaagatattcaatttgatactttaagaactttccaaatgaactaatttgaaaggaaaacgaaaagagaggattgaaagaattgtcattccctgttcaaatatttaatcttgtcaagttctctttaaatttgagtggaggcaaattcctgaagatcaagcacctggcctatgaaaatgtattaaatatgttttgatgataatttcagtgatcatagaaggcatttccaaatggaatccattacactgcttcaagtattattacaatgagttctagttctttcactaggttaatagattaataagttttattatcttgcttgtagaaagcattgaaaattcccaaggaagaaaaaataagttcaaacaagtaaccagaaaaataaaagagaaaaaggataattcacttctctattgtaatttatgtgtttcttgtatgtgggattagacccagcaaagctaaaagaggcaactaaaagctcagccccagtgctaattttgtatccttgaggaaatcacataccctttcaagttttaattattcatctgcaaatccaagattataaaatgacctcatattctagttgacaatgtttttatatcaatattttatttctttactttttcctcatactgtgccttgcttctcctttatatgtaaagtttacatatcaatttatacatgcgtatatataatttttctatcaatttcaggagtggataaaggatgtctttgacccaaattcttgccaaatctccttccaagagaagtattgcctattatactccaaatgtacaataccatagcattagtttagtaaaaaacaatatgtcttgtttctcctttatttttcttgatgttttcataattttaataaaaaacacttaaccaaagtgctgaggctgtgtttacaataaggtatttttaaattttatctctcctctaccaacacatacacataaatttaggaggaaaataagattaggtagcatcaatttggtgctaatgaaaatgaaaccagcattgatattttctaaatctaataatgcatgcattttgaatagttttctttgactcatttcccctgaaggtgaattcagattctttaggcattttcccaaaaataatttttaactctctgccttgtagtgaaattttccaaattgaaaagccatgtagaatacactgcgaacaattttacagccttcattaatatataagtcaatgtctaggtcacagcttctattaggtagccttatctttatcgatagttttccccaacttcagattctggtaattgcatgacttaccctaccctctctgtgtttaaatcctagattaaaggaggaaaacagcgtcctgtgaacactagcctcaggtgctgacagcatcatcctttgtagcagtccctgcaccttatccttacttagtaaataatcctttatttaaaaaaaatttgtttgagttcattgtagattctggatattagccctttgtcagatgagtaggttgtgaaaattttctcccattgtgtaggttgcctgttcactctgatggtagtttcttttgctttgcagaagctctttagtttaattagatctcatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttgtttttctcaggtttgtcaaagatcagatagttgtagatatgtggcgttatttctgagggctctgttctgttccattgatctatatctctgttttggtaccggtaccatgctgttttggttactgtagccttgtattatagtttgaagtcaggtagtgtgatgcctccagctttgttcttttggcttaggacatgaacagacacttctcaaaagaagacatttatgcagccaaaaaacacgtgaaaaaatgctcatcatcactggccatcagagaaatgcaaatcaaaaccacaatgagataccatctcacaccatttagaatggcaatcattaaaaagtcaggaaactacaggtgctggagaggatgtggagaaataggaacacttttacactgttggtgggactgtaaactagttcaaccattgtggaagtcagtgtggcgattcctcaggggtctagaactagaaataccatttgactcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaactgtggcacatatacaccatggaatactatgcagccataaaaaatgatgagttcatgtcctttgtagggacatggatgatattggaaaacatcattctcagtaaactatcgcaagaacaaaaaaccaagcaccacatattctcactcataggtgggaattgaacaatgagatcacatgcacacaggaaagggaatatcacactctggggactgttgtggggtggggggaggggggagggatagcattgggagatatacctaatgctagatgacgagttagtgggtgcagtgcaccagcatggcacgtgtatacatatgtaactaacctgcacaatgtacacatgtaccctaaaacttaaagtataataaaaaaaaaaactgaaattggcctgttttattatttctcgtcagttctttgatttaataaaccagataaaatctcattataactaattcctaatattagccaagttattttattaaaaataactaagacagaaaaaaattggcttcaatatttggttataattttagaatatgagattacaaagaaattgtattgtactcatgatgttggtagcagggtttaacaatatatcttgggaaataaaatatttccatctatatcagaatgatatctagatgcttgtgtttctcttaatcttttaaagcttctttttaaatgtcttgttctactgggcttactctacagtgcaggtagatatattgaaaattcctaatttttcaatatatgaaagaaaaaagcaaagaaaagaaatatcagaacaaaacaggtatttagtaataaacaagtcaactgctttcttaaaactagagttgtaaattagttctcagacacttccacataagagtcacatgacacttactaattttaacagaaggctagccctgaagcagtgacacatgtttttgtgccatatttaattccacacaacattgattttaatgggaattgctagggagtaactacagttttgcccatggtcatcaaagtcactacaacatgtcttcaggaactatatagtcaattcatcgccctggccaatggccaatttgtaagttagatacatatcttttaccttgttattaaacaaacaaacaaacaaacaaacaagctctattcttctaagtgagttggttacatttaaattatcatttatctatgtatgtacgtatgtatccatctatctatctatctacctacctatctatctatatcttttgctgatgtagaactgctgcttttccagttgtatccaagtaaagttccatatcaatgcaatgatcccttttgtacagttattaagtataagttttctataaaaattagcattggatatgtagactactcatgtagttagcgatttaagttaagaccagacttggagaaataaatattaagtcagaatgaaaatcactgatcagctgacatcctcctttaaaagtgagaatatttcccacagaatactaatcatttaaagacaacttgctgtaaatgaaagacaaagatgaataaagccaaacactggtatgctgcagggcaagatctttgtatatattctatccggtatttgtttttgaaaattatctttattcatgtcatgaaattatcaaagaaaagagtgataaaggatctctgggttatgacagcacttctcctgcgatttttttaaatgtaaggaattcagtcagactcagtcagtctaaaaagatgcaaattcttgggaattgtatccagatcagataaaacgttggacactggttaacacagtatggtccacgtcactgactctcacagttacagtgtagtaatacatcagattatttgccaaaaatgtccagtgatgtttgttccattagtactcaaagtaaaagagtgcatctattctctcaagtaatattgaatgtacagtgtgtttcagacatttgtgaaaaaaatacattggtagttccgctcttgaggagtacgcaatctgttaaagaccaccaagttatttttttttactggaagtctttatgcaaagatagagaaaaatgtctacattgatggctgaacacctaggggattgaggtgtagtgaagataaaagaagagcacagaatgtatacctgaaagacctgaagaaaattttaatttcttttttttttttgagacagtctcactctgtccccaggctggagtgcagtgacgcgatctcggctcactgcaacctctgcctactgggttcaagtgattctcctgcctcagccccctgagtagcagggactataggcgtgcaccaccacgcccagctaatttttttttttttttgtaatttttagtagagacggggtttcaccatattggccaggatagtctcgatctcctgaccttacaatacacccgcctcggcctcccaaagtgctgggattacaggcgtgagccaccgctcccggctgaaaattttaatttcttgacccatattcttcagttccctctaaactatgctttcaagaataatgtaaatgcaagttaaaaatgtagtgtccaactgttctcacattaagaaatcagggttacatttggtgagaatacaaaaaaggaaaaaaaaataagtcaagattaattgatcatattaatttcatggtatcactccacgaaaatccagaataattaaattaaaaacaaaagttcaaggcaaagcattgctacaaaaatttcttataataattaatttactggttatgccccttacaggagtcaggaaacaggttagattccttacccagtgtgcccactaatagtccctttataaaaccatctcctggaggcactagtcctccctcagaagaacagtaggtgaaggagttctctggtttctggccttgaggccagttcctgtttaagcctaaataaatgaataaataaataaataaataaataaataaataaataaataaatattcctcttccaagaggcatctggcagttccccttatccctgatgagtccttcttaagaccatgtcgaattaagttaaatgaatcgaaagtaaattaggattaaattgtataacattgattcatacattgccttggatgatttatatacatttggaaagtttaatactttatcacaatggttaagttttaatgcaaaataaaattatctatgtagtgttttaaaatgttgattagcctactccttagcctttttgaagtactttttaaatttctggtgtaaattctggcatgtagttctttaaaaaaatcctgcaggaagtttttgtgcctttcaaagtttgagggcccctaatcttgggcatacaaatcagtctttcttctgattaatgtggcattgtccatcatttttataaatatgagtctcaaacccttgattgataaagaaaatgctcattataacattgtgacatttggaaaaatttaatattttgtatttttaatataaattaattctttcagaactattaaccttataggaaaacactagagagaatgattttagcagatttttgtaagaactcatctcctaaggtttaagaaatacctacatggtttaaaatagtaattataaacatagtaattttaaaataagatactattttgtttaggtcttccaagtcagttagctggtgtcagttttatggtcagaatgacaaaaatatataataaaaatgtgcagctcatttagctgttgaaggctaatgaacaattaaagcattccataagaacttaatctcacccattttttagtcctatttaaatctgctcctcctttccacaaagttcgaatggcataaattatttaagtcatatacaaagggaacccaatcaggctggcagaagacttctcagtagaaatcttgcaagccagaagggattaggggcttattttcaacactctaaaagaacttaaactaataatttcatattcctccaaacttagctttgtaaggaagggataaataaagtattttctagacaagcaactgacaagggaatttgtaatcactagaccagctttacaaggcaacctcagcggagtcctaaacatggaaaaaaaggacaatttctgccaccacgagaacacaattaaatacatagtctgcagaccctataaagcaaccatataatagaaactacaaagcaaccagctagcaatttcacaatgggatcaaaacctcacatataaatattaaccttgaatttacatggtccaaacaccccacttagaaggcacagacttgcaagttgtataaaacacaaagactcatccatctgctgtcttcaagagacagaactcccatgtaacaacacccatagttcaaggtaaagggttggagaaagatgtatcatgcaaatgaaaaacaaaaaagaacaacagtcacttgtgttagataagacagaatttaaaccaataataataaaaaaggataaagaatgtcattaaataatgacaaagggttcaactcaacaagtagacttaactatcttaaatatgcacacactcaatattggagcacccaattcataaaacaaatacttcaaaacctataaaaagacttaggcacaaaacaataatgggagacctcaacacatcaatgacagcattagagagatcatcaatgcaaaataacaaaataatcctggacttaaatttgacacttcaccagttggacctagtagacgttacagagcactctacccatcaaccacagaatatacattcctctcatctgcacacagaacatactctaagggtgaccacatgctcagccataaagcaagtctcaataaacacaaaaaattaaaatcatatcaaccatactcttgaaccacagtagattaaaaccagaaaccaatactaagaacatctcccaaaaccacacaatgacatgcaaattaaacaacttgctcctgaaggactttcagataaacaacgatattaaggaaatttataaaattatttaaaatgaagacacacaacatttcaaaatctctgagatgcagcctatacaatgttaagaggaacatttacagcactaagtgtctacatcaagaagttagaaagatctcaaattaatgatctaacattacacctatgggaaccggaggaaaaggaacaatctaaacctaaagctaatgagaggaaagaaataactaaaatcagagcagaactgaatgaagtagagacccaataatccatacaaaagatcaacaagaccaaaagttgggactttgaaagcataaacaagagagataaacctccagctagatgaacaaaacaaaaaagagaagatccaaataagcccattcagaaacaaggatgacattacagccaaacacatggaaaccgaaaagatcctgagaatattatgaacactggatgcacacgaactaaaaaatctagaggaaattgatacattcatgaaaacatacaacctccccaaattgaatcacaaagaaattgcaactctgaacaaatgaatcagtcataaaaaaccctatgaatcaactaatgtccctgaccaggtggacataattcacagccaaattatagcagaaatacaaagaagtcctactaccaattctactgacactattacaaaaaattaaggaggaactcctctgtaactcattctatgaagccagcatcaccctgataccaaaacctggcagataaacaatgaaaaaaagaaaaactacaggctaatatccatgatgaacataaacacaaaaatctccaaccaaacactagcaaacctgatccaacagcacatcaaatagctataccatgatcaagtagcctttatttctgggatgcaagagtagttcaacatgtgcaaatcaataatgtgattcaccacataaacaaaattaaaaacaaaaaccatgtaattatgatcatctccatagatgcagagaaagcttttgataaaatctaacatctcttcatgataaaaatacttaaaaaatgagtcaccaaaggaacatacctaaaaataataagagtcatctatgacaaacctatagccaacatcatactgaatgggcaaaagcgggatcaatcccttgagaactggaacaaagcaaggatgctcactttcactacttctattcaatgcagtactggaaatcttagagcaatcaaagaagagaaagtaataaaagacatccagatatgaaaagcagtcaaactatttctctttgctgactatatgtttctacactaaggaaacctcaaagactctgctgaaaggctcctgaaatggataaatgacttcagtaaagtttcagaataaaaattcaacatacaaaaatcagtagcatttctataatgttcaagtggagagtcaaatcaagaacacaatcacatttacaatacccacaataaaaattaaatgtctatgaatacatccaacaaagaggtgaaagatctctgtaataactacacaatattgctgaaagaaataatagatgacacacacaattataaattcattccacactcatggaaggtaagaatgagtattactcatggtcatactgcccaaagcaatttacagattcaatgctattcctgtaaaactaccaatgccatttttaacagaaatagaaaaataggattctaaaatatagaacaaaaaatagcctgaatagctaaaggaaggtaaacaaaaagaaaaaagccagaggcatcatattatccgacttcagctatacaataagtctacaatatccaaaataggacggtattaatacaaaaacagacacatagacgtatggaacagaaaagagaacccagaaggaaagctgcacacctataatcatacgatctgtgacaaagttgacaaaagtgaacgctgggtaatgttcaatatatggtactcaaaaactggctagccatatgcagaagaatgaaactggactcctacctttcaccatataataaattcactcaattcactcaagatggattaaagatttaaatgtaatacttcaaactataaaaaccctagaaaaaaacccaagcaacatcatttttgacattaggctaggaaaacaatttatggctaaatcctcaaaatcaattgcaacaaaagcaaaaattgacaattgggacctatttaaattaaagagtttgcacagcaatataaaaaaattttaaaaagatcaacagagtaaatagataacctgcagaatgggagaaaatatttgtgaattctgcatctgacagaggtctaatacccagaatctataaaaaacttaaacaaatttacaagaaaaaaataaccctattaaaaagtgggcaaaggacatgaagaggtacttctcaaaagaagacatacaaacagccaacaaacaaatgacaaaatattccataaagattgttaagttccattggatcgcatgataatttcattgaatctgtgactggtaaaatttacagcttcagtaacaccagatgtaaaatgaagaatctatatgttggtcaggttataatcaagacattatttttcttgtcataattacacatactcttttatcatgtattttcttgaggaaatacatatatgcaaacaaaacggtaggtgctcttattttctttttaaacaatacaatatgaaatataaatgtacactagatgccacccaatttaagaaatagaacattactggcaaggtgtggtgtctcactcccgtaatcacaacactttgggaggctaaggctggaggattgcttgaggccaagagttcaactagcatgggcaatgtagggaggccctgtctctacgaagaaaattaaaaaatatagctgggaatggtggtgcacacctctcggcaggaggatcacatgagcccagaagttcaaggttacagtaagctatgattttgccactgcactctaggcaatagagcaagaacctgtttccaaaaaaataaaaataatgaaaatatttgatctaaagaaaggaatataccatgttttcctttatttagcatattaataaaaacaataaagatacacatatttcagttactggtatcttagaatatcttgcatatatacaatctgagctttttgatcaggaaaaaaatttaaaagaatctcttgcataccttttcttacactatcctgaattttgcgttattacttgccatagttgatagacagactataatgtatgcacccctaaacagtatatagtttttccttttttaactttatgaaaataaaattatacccttgaatttatacccaaaaattctcatatgaaatattttatccatgcaattaacaaatttaatccaatggctataaaatatagactattataccaaacaattgaggaattagaatgattctataatgtcttttatttacttgtgctacttggataattgttattttcctccattttattttactaagtggagggctggtttatgttaccttttcatggagaggacaaaattaaaggtatctcaaggcaagactaggtgtgggcctgtagacaacactaaaatgaatataaggagagagatatgctagtaagggataccacaatgggcaaatgcttttatttttgacctatggatgggaagggatacacagacctgtagggttaatggtatccaaacacatagaaattctaacatacaagcattcagtagataagattatcaactcccaatttctactaaaaaaaagttcatatgctaatcaaccatatcagttgcttcaattataaacctcatttacaagtcttaatagaaaaggaattgatttttttctgctttcaaagagaaaatgagtgaaaatagacaccctctaaagcatattcaacacctacccaacaaactttcaaaggtagatctatttagctaccaccatttacttgaagttaaaatggtacacaaaaatctattgcctaaatggtagtcttcattttatcatttaaaattaagattcgactaaaagatcaatagaaaaatatttgatctaaagaaagaaatataccatgttttcttttatttagtatattaataaaaacaataaagatacacatgcttcagaatggaaagaaaggtgtttacttttaacggcagaacatatcaatcacctcattattacataatatattatttaaggtcaagtgtagatgctcaagcttgtaatcccaaagctttgggaagctgaggagaatgacttgagctcaggaatttgagaccactctgggcaacataacaagaccccatctctataaaaaggaaaacaatgaaaataaaattagtcatgtgtggtagtgcccacctgtagtcctagacccttgagagactgaggcagaaggatcacttggatgcagggttttgagtctgcaaggctgcagtgagctataatcatgccactgtactcaggcctaggtgacagagcaagaccctgactttttaaaggaactgtatttgcttctattaaacaggtcacaaacactctcaatagttttttttctcaaagttgagatatatggaacaagtttttaaaatttcaccatattgataaaattatcccctaaatctatccagggtaatatattatccacaataacatattttcatatcttctttcttttactccttactggttttctactgcttcaataatttgtttttctctttattctatcttgattcatgtctagttcttgtttcctatgatatcctccttgtaattttaacccagttcatccctctaatcttccattcagtatctctctgctgtgtaggaagcataactgtgctgagttcttggctggaccactgaaatcaagtaatgactgaatataaatcagaatcatggctgtaaataaaaagaatgtgaccaaatgtccattagcaatgatagtctagtcatataaaaatgtggctattttcaattaataaaacaaaacaaggaagaaaaagtaaagacaatgtcaggaacgatgataagaataagcatgtaacaagcaaatggtaggtttgcttcaaccaaatggtaggtttgctttcattacatgaaaattttaccaaattgtacatataaagtcttctaagaacaatatacaaataacattttagtatataaattggctcaagaaagtcatttttcagggactctagatttataggctctttaagtctctttaaaactgtaaatgacccacagaagttggctgccctaaaggtttagattaaataaaccatccagtgcacaattcaaatataagctgaacaaccttaattggaatatctatcctgtgcggttttccagtttctgatttggtactccccaagtagcaatttcctatgaattaccgtttcccaactaagaggtacagaaattcccagtttctttaggaggctgaatattttaaaacttcggctttattaaggttttcaacaaagttctaattaaactacacttcattaatggcttacccccctaccttagaataaggagagctttcttacaattattaaagctaaccttcagaactgttgttaataacaagactaagaacaatttttaattttttttaacttcatagctgtaggctaaccaatagttaacaaataattcattcatttcattggcatcatcagtcctcctagcaatatgtgttttttttttttttaatttaagacttggtgggggaggcggtgaggactgtgcaattactagtcactgttttcccactcattggtactattagcttaacagataaaaccacagataacagccgcaatcaacttcagcaggttcccagaggcaagctcttgctttttgctgattagcttcattcaattatgtcttcttaattgttcatgtgctacagctcattaaatgaaaaataatattcctttcctgtgggtagggcacttgagatttgaaaaatagccacttcatctctgcctcagaggcacaagtaagttgatctgatggtgtctgaaaaagctcaacagatttgtgcagatagccctgcccgagaagggacaataaaattaataaaattgattgttaaatcaagtcaaaaataaaattactcccagtattttcctttaagattaattttcaggaaaattagacccagttttgtagcatttgattatgttcacctctgtaatataattttctttgtaaaaagatcagttattgctgttccattacagatgggatttagggaaagtggagtaaatttttaaatttttctgaaaatagattttgacagattaaaaagtgtgtcacacaatttatttatgaaatattctagaaatggagaaggtaagtttcattcattaaaatagattcattgagtacctactatgttccaggccttttgctacacaatgaggatacaaaaggtcttaacttcaagaggtttattagtctggtggagtagaaataataattcaataataatccattagctaatatatactggctatttactaaggacctataaagtacttggtcgatatgtgtcaccttacttaatctttttaacgatcttataacatagaccatatcatattttttattatagatgaactaaggcttagaaaaattatattgcttcctgatatcacataactagcaaatgctaaagtttagtttgggacaagatatgtatgaccttgtagcattcctatttacaggtactcctcaatttacagttcctatatgcatacatttcagtcaccatgtttagttaagttagaccagttacccagctcaagcgattctcccacctcatccttctaaagtgctgggattacaggcatgagccaccacacctggacggatgtgccatagtttgtaaaagagttgagaatggctgctagctagtagaaaaaaatggtgatattagaaacatgggtatattttcaaatgaattccaaaagtttgagaaagtaatagaatttttgtctgttttgttctctgttatttcgcaaacacagatactcagtacatatttttgcttttttttaaggagatgaaaaagtctgacatgattttataaaaaataaaatttcaaatttcagctaccacagtgtattaactgtaagtaattacataagtacaaattttgctccttgctctttggtccaaaatcattatgtaaataacaggtgtgcttcatgatcagtgaccattggcatcatctttttaaatgtctgtcagtgattgatcactacacatctattattcatcacatgcagacagaaaagtgtgcagttatgttgtctctgtttcccattgataaacacaagtgccatttcttaaaaataaataattgaaagaattggccagaaaagataaaagtacaacataaagtaaaacgttgagtccagtgaaaatggagctacagcaaaatccctgtgggaatattgacactgctgccatctgaggaacttaagctttgcagccagaacaacttagtgcagaggagcttattgacataaatgaagaaagtggatgtgatgaaaaggatgaagatgtatcaggctaagtgacgccagcaaaaacccaaacacacaataaaaaaaaaaaagacttacattaaaggaacttacagagatacttaacaatattgaaagcatcaaagcataaagtgatgaaagctgatccaaatttaagattatgacaatttgccaaggcataaaacattgcccccttcattgtaagccatgtaagaagaaatcaatcactattcaaactattagtaaacattttttaacaaacaagtaaactttaagtctttaacatcaatgtaattaagagggaattggccagcatatgtgaaagtatagcaaacaaatgaaaataatgatgcaaaaaataataatgtaagatatgagttgaatataaacagagttatagaaagaaagaactgactttaattcttttattcccagtgtaaattccaggatgttaaatgaatatgttttataatttatttattttcctacacatttgtaagtgacagtaaaagagtttctaatattttgaaaagaaattaaaggttatggaataatatttattcttgattattaagataaacttgcatgatttcagctgagattatcatgtttatcatccttcactaccatgtaaagcgagaagtgtgggtattaacttattatctgtttgtttaaagtgaatgacacacagcttagtgttacatcaacagaaaaatatttaagaggaaatgacactaaatcaattttaagataatgcttctattatgtatgtttctgtatcgtctttctaaacataattatggaaaaggcatcccaactggtgacataattattgccaataatataatagtaatgacaatatatttgttggtcaattaaaagtaactacattagctttggtaaaactacatttttcacttacatgattaaagacacttatcagtgctcttgtgatcctactttaagatatacatcttcatattaatttgtaaatgaaatgtgggagtttttcataaccaacaggtttaaagctgtgtgaagatatgtgagggaaatatatagttatgtctgtaagaatcagtgatgtgccatactttgtgttttgttgttattgttttcttgagacaggatctcactctgttgcccagcctggagtgcagtggcatgatcacagctccatgcagcctctacttcccactcaagcgattttcccacttcagcctcccaagcagctgtgactacagttgcatgtgaccacacccagctaatttctattttttgtaaagacacggtctgactatgtggccggggctagtcttgaactcttgggctcaagcgattctcccacctcatccttcttaagtgctggtattataggcataagccaccacacctggactgatgtgccataatttgtaaaagagttgagaatggctgctagctagtggaaaaaaatggtgatattaaaaacatgggtatattttcaaatgaattccaaaagtttgagaaagtaatagaatttgtgtctgtcttgttctctgttatttcccaaacacagatactcagtacatatttttgcttttttttaaggagatgaaaaagtctgacatgattttataaaaaataattttgatgttagtaatcattactcaacatatttttgaagagtctaaaggaaatttccactgtttcaaaagatcccaccttccatttctctctatctcatctcctagcaatctacccttcatttattgtactctagttgtgcttatctttttggtctttatcaaacacaacaaatattctgagaccttaatatttctgttccctctccctggaacactattcctcaagaaataaaattaggtaattatttcaatcaagctggtatttaaacatcttctgctcaaggaggcctagctgataatctgtatttaatgttccagttttcctatactctctctgaacccccattggccattctattttgttttatccatagtgcctatcacctgttggcatattatatgaactctttgtttattaacttatttgttaattttattgtttatcatttatgtctatcaatggcatgtagactctaagagagcaggcatatttgtgtgtgttattcattgatatttcaagattaccaaacagtgtctgtcatatagcaaccattctttttttatttttttctgagacagagtcttgctcccgggttcacaccattctcccacctcagcctcccgagtagctgggactacaggtgcccaccacacccggctaatttttctatttttagtagagacgggctttcactatgttaaccagggtgatctcgatctcctgaccttgtgatctgcctgcctcagtctcccaaagtgctgggattacaggcatgagccactgtgcccggcccgttcattacgtaagaataaagaaatatccccttgacatgaaattctgtgtattggaataatatatataccatggcaatgagcatttgtcattatcttagtcagcagtatatattttcctagacaatgaaaagactcccaactggccttttgtatgacaaaaagaactgctaatcactttcccagtttggcttttatttatctccagattaaagtgttattaaggattaatttaatgttattttattccatttagtgaacttttaaacaataaaacacttttatctatgttgttttgcacccatatgacaataaagtgttatcatgcccatactataagtagaaaaacacaggtagaaagaacataactgatttgctcaaagtcatataactcagaagtgaccgaatacatttgcctgactccaaaacttggtctgattttatcatcccttgctggctgtcagatctgatatatcagtccaaaaattacctcttgcttaaaccgatgttttggatgacttttgtaattttctgcgttccatcatttattagcgccaatatataaatggttatttagaatacagaggtttacacatattcgggaccaacattccaaaaatggcttaaatatttctggcagcctaatattatctacggagaattattttcctcaagaacattagtgagatgtgctataataatggttgagcaaagtagcacaacactagatgctgtgtaactctgggaacaccttatttcctgctctgatagaaatctgttaaagaccctcatctgttacaggcagagagaagagcagagtaaaagtgctttgcctacctaaagggattgttgtaagaatctgatgagttaaactgtgtgaaagcattttgcaccctctaaatccatacatttacatgtgacttccctgtatgacacaagctaacaaacaaactagaaacaagcaaacaaaaaaaaaccgagacacaaaaataaaatatctttctgttacctcatttgggaaggggtctaaaaacccagaaataatagtatttacatgtacatgtagttggtaaacattcaatggagtaaaaagtaaattaaaaataataccattagcagaggggaatgtatttttacttatgcatatatacccacatattggatttgtctctatttcatctgtaggacctagccactagccaaatgcccgaagcccctagaaccccagtgcctagtgtggtatgcagaaaataatgccctgttatatgtccattacctaattccaagagccttggaatatgttaccttacctggtaaaaaggactttgtagatgtgtttaaagttaagaacctccatatggaaaaactgtcccaaattatctggatagacccaatctcatcacattagttttaaaaatattaaaccttccttggctgtggtcagggagagaaatgtgattgtagaagaatggcaggcaaatgtaacattgctagttttgaaaacaaaaggagtccagaagtcaagggacgtgggtggccactataagctagaaagatcgagaaaactgattctcccctagagcctccagaaagtagcattaccttgccaatttaacctgattttaatcgtcagacctgtgtcaagcatgtgacttagagaagtataagatattacatttgtgttgttttaaggcactaattttgtgataaattgctaagacagcagtagataactaatacagctagaaaacaattttaaaatacattttaaaaagaacttcaacatgccaatatctaatgaataaaaccaaaaataggatgaaaaattaaaatgaaacttagaatttttctatattacatatttgggaaatttgaattatttcataatattctgatctcaaaaatatgaaaaaagtagcttgtctagttatcattcacctgaaagcaactgttttaaacctgtcattacaatctgataaaaagtaatatgtctcattcagtcccaactacgctcaacatgacccaatcttgtcagaacccaatgtgaagcttcaagtgtacaggaatttacaatgacaatgctccatggaattttcaatgacaatcaatgttccaaaaaagctatgacctacacttgaggctatcccaaggagaagcaaatatcatagcagcatcttacatttgtgaacacagtggtaaatatagagcatacaaaaccatgcatgggtattttcttctgtttttaacaatggataatgaatgtcaaaagtgatattcaaactagcaatatgcaagttaaaattaaatccataaagcacagcaaaataagcatttgttccattgtagagctcacgtttccttgagcacttattttctttcttttccctcctctctgctcctgtcccctcccctccctccttcccttccttcctcctttcctttcttccttcgacttccttcctgacttccatttttcttttttcagctttattgaggtatagctgacaagtaaaaatgaacatatttaaggtgtgcaacttgatttttgtatatgcatacattgtgaaatgatcatcataatcaagctaattaacatatccatcacatccataatgtaaaacatatctaatgttgtacattagatatactgttaccatgctgtacaataggtatatgccacattttccttattcatttatctgtccatggacacttaagttgtatccataccatagctattgtatataaagctgaaatgaaaactaaagcaaatatcgattcaaaattattttatttcctttgaataaagactcagaagtgggattgctgaagcatttggtagttccatttttaattgttaaaggaatcttcatattgttttccataatggccacaccaatttacattcccatcaatatgtcttcctttttctccacttccttcacaaaatttatattttgaagtttgataatagccattcaaacaggaatgtggtgatacatttttgtggttttgatttgtatttcctgataattaatgtcattaatctttcatctttcatctacctattgacctgtcgtctttcatctagctgtttgccatttgtacatctttggattaatgtccatttttgtaaatttatttttctattgagttttgtgaactccttatatattttgaatattaccttttatcagatatacagttgcaaatattttctgtagtttgtcttttcagtctgttgattgtttcttttactgtgcagaagctttttagtttgatgcaattccacttctatacttttgtttttgttgcctgtgcttttgctctcatatccaaaaaaatcattgccagaaccaatgacaagaatctttttcctgatggctttttgctattagttttacagtttcaagtcttatgtttatgtctttaatccattttaagttaatttttatttttgtatgtggtaagagcttatcttcatttttctacatgtggatatccagttttctcagcaccatttattgaagaaaataccttttccccagtgtgtattcttggtgcccttattgtaggctggtttactctaagtgcatggatttatttctgggctctctgttttcttgcattaatctatatgtctgtttttatgcaaattccacactgttttgattagatttgtaaattattttgaaatcagaaagtgtgatgcctctagcttgcttttcttgctcataattggtttagctatttgctatttggagtttattgtggttccatataaattttagaattttttttcctatttctgtaaagaatgccattggaattttgacagggattgcatgaacctgttgattccttttggctagcatggctactaaaacaatattaattatttcaattcataaacatttattttccatggatgaatgttttttcatttatctatgctttaacatttttccttgattcctcctccaagatggccaactagatgcagccaggagaaacatctcccacagagggaccacgacatcaggaagacgggtgtacccctagtaaatcttcagagggaaggcattgagagcagatagagagaagatacagaaggtgggataaagggagatgaagctgggaatgctgcatgtggctaccacacaccaggactcattcctggctcccagcaactcctgtggaaggggtgagttgaacagaaatgagcaactcactctcaccatgagcctctggaatcatagcaggaggagtcttgtcagccaccatggacacttgagttggcagagaaagctacttagtgaagtggtagggacagaactccagctgcagcagagcccatggggtttggtgcaggagcatctatagtggagaacagccagggatgcccatccccctaggcttgatttgctcctatagtagacattagccctaaggaaaggggtgaacgtagactctgtagagcagtcttgcccatgagatgagccaggccccctgagcaccctttggtgtgctgtcttctctttgggccccagcctgcctgtacctgctagcagtgtacccccccaggcacctcaagggggcctgcctcattgctcctgcactggtggactgcagctgactgggagagtgctccagaagagcaaaccctgtgtatacatataagactgcccatgtcctccccacactacagcctcctccatactgctttgctggcaggcactcgctgccagcgatccccatacatctctttgcctgtacatgtgtttgcagacagacctagcctttccttctctgacagtgcatgtgtacacatgtaccatgccatgccatgccactattgctggcttgagtgtgccccatcccttctccccctgttgcactgccatttttgttggagcattggagggcatatagtttgacagctctgccaccaccagtgctccactcctgtgccaaaactgctggcatgaaactaagcacagaaaacagtgtatctactcccatccctgagaggtcactgctgtaagcaagaatgctcacagagggtgcacacagtcctgcgaccactagcgccccatccctgtgctaacaccagcaccagtacaaatgtgcacaccattgccagcagggccctccaccttcccaaaccataccgccacagccactactacaaacacccacatggaggctgtcatcttccatgtggatggaggatgccgctggtacatgcaaatgtggacacatcccactacgactgtcctacaaaatgctttggctgggagtagccattagagtgttgtgaccagcagtctgagatcacattgacccctccagtgcagcaggttcctaaacttgatccacaggtaatagctggtgtatgataccagtctcccagagttagagcacacaatgcagagtgctgagctgagccttggccacctgaagtcttccactaacaaagccaggtgactgaacacagcttataccataatcaaaccctcaaggtcataaaatagaataaaagaaaaaaaatccaaaggacagcaacttcaaagattgaaggaacaccagcccacaaagatgagaaagaaccagtgcaggaactctgacaactcaaaaagccagagtgccttctttcctccaaatgagcacactagccctccagcaagaattcctaatgaggcagaggtagctgaaatgacagaaatagcattcagattatggataggaataaaaatcattgagttttgggagaatgttgaaaccacatctaaggaagctaagaatcacaatattaagatacagaaggtaacagacaaaatagccagtacagaaaaacaaacaaacaaacaaacaaaaaacataaatgacaggatagagctgaaaaacactctacaagaatttcataatgcaattgtattaagagaagaataccaagctaaggaaagaatctcagagctcaaagactgtttttcttaaataagatggtcagacaagaataaagaaaaaagaataaaaaggaatgaagcaaacctccaggaaatataggaatatataaagagaccaatattatgactcattggtgtccccgaaagagatgagaagaaagaaagcaacttggaaaacataagtcaggatatcatccatgagaacttccccaacctaaccaccaatattcaaattcagaaaatgaagagaactcccacaaagtacttcacaagaagatcatccccaagatacataattatcaggttctgtaaggtcaaaatgaaagaaaaaaatgttaaaagtagctagagagaaaggacagatcacctacaaaaggaagcccatcagactaacagcagacctctcagtacaaatcctacaagtcagaagagatttgggacctatattcaataacctaaagagaagaaattccagccaaagaaatttatatttggctaaacaaagcttcctaagtgaagggaaatatgatccttttcagaaaagcaaatgctgagggattttattaccaccagacctgccttacaagagcttctggaagcattaatatggatgggaaagaccataaccagcaaccacacaaactcacttaaggacacagaccagtaacactataaagcaaccaaacaagtcagcataataagtcgacagcaacaggataacaagatcaaatacacattaatactaaccttgaatgtaaatgaactaattttcccaattaaaaggcacagaatgtaagctggataaagaaccaaaacacaattgtatgctgtctgcaagagacccatctgacatgcagtgatgcccacagaatcaaataaaggaatggaaaaaaatctgccatgcaaagagaacacagaaaaaaagcaattattgcaatcctaatttcagacaaaaaagattttaaaccaataaaaataagaaatggcaaagaagggcattatataatagaaaagggttcaattcaacaagacctaactagcctatatatacatgcacctaacacagaaacattcagatttataaaccaagttcttagggaccttcaaggagacttaggctactacacaataatacggggaaattttgacacccccactgacagtattagacagaccatttaagcagaaaattaacaaaaataatcagaacatgaacttaacactggaccaaattgagctgtgaaacagctacataactgttcatcaaaaaacaacataatgtacattcttctcatgtacacacaacacatattctaacaatgaccacacaatcaaacataaagcaatcctcagcaaatgcaaaagaaacgagatcataccaaccactctcttggacaacagcacaataaacatagaattgaagaacaagaaaatcagtcaaaaccatacaatcacatggaatttaacaacctgttcctgaatgacttttgggtaaataatgaaattaaggcagaaatcaagaagtattttgaaattagtgagaacaaagatataatataccagaatctctgggacacaattaaggcagtgttgagagggaaattcatagcactaaacacccccatcaaaaagttagaaagacctcaaattaacaacctaatatcatagttaaaaagctacagaagcaagagaaaaacaacaacaacaacaaaataacaacaaaaacaaacaaacaaaaaaacccaaagctagcagaagataaaaaatacaccaaatcagagctgaacagagactgagacataatacaaccattcaaaagatcaacgaagccaggagttgactttttgaaaacattaatacaatagatagaccactggttaaactaagaaagaagaaaacagagaagatccaaataaacagaatcataaatgagaaagggaatattaccactgaccccacaaaactacaaataaccatcagagactactatgaaatcctctatgaacacaaactagaaaatctagaataaatggataaattcctacacacatacagtcttccaagctgaaccaggaagaaattaaatccctgaagataactataacaaatgctgaaattgaatcagtaataaacagcctgcaaaccaaaaacagccctagaccagatgaattcacttctgaattctaccagatgtacaaagaagagttggtgcattcctactgaaacggttcccccacaattgagaagggacttctcctcaactcattctatgaggccagtatcatcctgataacaaaacctggcagagacacaacaaaaaagagaactttaggccaatatacttgatgaactttgatgcaaatatccttaacaaaatactacccagctgaatccagcactatatcacgaatccaccacaatcaatattctttatccctgggatgcaaggtttgttcaatatacaaaaaccaataaatatgatttataaaataaagagaactaaagacaaaagccacatgaacatctcaatagatgcagaaagacttttgaaaaaattctgcttcccttcatgttaaaaactctttacaaattaggtattgaaggaatatacctcaaaataataagagccatatattgcaaacccacagccaacatcagactgaatgggcaaaagctggaagcactgtccttgaaaaccagcaccaaaaaaatgatttctccacttgctatttctattcaacacagtattggaaattctgaccagagcaatcaggcaagagaaagaaataaaaggcatccaaataggaggagaggaagtcaaactaatcctgtttgcagatgaaatgattctatatctagaaaagcccagtttcagctcgaaagctctgtaagctgacaaacaacttcagcaaagtatcaaggtataaaaatcaatgtacaaaaatgactaccattgctatacatcaacaacagccaagctgagagccaaatcaggaatacaatcccattcacaattgccacaaaaagaataaaatacctaggaatacagctaaccagaaaggtgaaagatctctacaatgagaactataaaacactgctaaaagaaatcagagataacagaaataaatttaaaaaaaaattctatgctcatggataggaagattcaatatggttaaaatgaccatattgcccaaagcaatttgtacataaaatgttattcctatctaattagcaactacattattcctatccaattagcaattacattcttcacagaactagaaaaaaaatcaattttaaaattcatatggaaccaaaaacatagcccaaataatcaagggaatcttaagcacaaagaacaaagccggaggcatcatgctacctgacttcaaactatcctacagggctacagtaaccaaaacaacatggtattggtacaagaacatatgcatagaccaaaaaaacaaaacagagagtcaagaaataagtctgtacagctacaaccatctgctctttgagaaaactgacaaaaaataagtaatggggaaacaactccctattcaataaattgtgctgggataactggctagccatatgcagagattgaaactggaccctttccttacatcatatacaaaaatcaattcaaaatgtattaaatacttaaatgtaaaacccaaaactataaaagcactggaagacaacataggcaatactattctgaacataagatctgacaaagatttcatggaaaatatgccaaaagcaatcacagcaaaagcaaaaattgacaaactaattgaaaaactggtacactagtctccagtgaaagcaactgcacctgaagttaatggaaagaaagaaggggaaaaggaagaagaagaggaggtaaaagatgagggtgataagttagaccaagctgaagagggaggatctgagaaggaagcctctagtgaaaaagaggaaggtgagcagaaagaaggagaaacagaggctgaaggtgaagtagaggaagccaaagctaaagaggaaaagaaagttgaggaaaagagtgaggaagtggccactaaggaggagttggtggcagacaccaaggtggaaaagccagaaaaagccaagtctactgtgccaaaatcaccaaaggaagaggcaaagtcaaaagcagaagtggggaaaggtgaacagaaagaggaagaaaaggaaatcgaggaagctcccaaggaatagaaggtagagaaaaaggaagagaaaccaatggatgtgccagagaagaagaaagctgagtccctggtaaaggaggaagccatggaggaggcagtcaccattaccaaattggtaaaggtgcacttggagaaagagaccaaagaagagggaagccacagcaacaggagaaagaggagaaagtgggaggaaatggggaatgagaaggaagggagtgataaagattccaaggaatccaggaagaaagacatagctgtcaatggagaggtagaaggaaaagagaagggagagcaggagaccaaggcaaaaggcagtgggagggaagaggagtaagacattgtcaccaatgacctagacttaagcccagcagatgaaaagaagggggatgataaaaatgaagataaagtggtggtgaccaaaatagtagaaaaaatcaccagtgagagggagatggtgctaccaaatacatcactaaaactgtaaccatcactcaaatggtcgaagagcatgaagagacctttgaggagaaaccagtgtctactaaaaaggtagaaaatgtcacttcacatgccgtaataaaggaagtcacccagagtgactaagatttgagtccactgcaaaagtttaagccatacgacaatttcaaaatgcatgtgattgacagcttcaaaacagaacagattctcccataggggctccagacattgtattttactttgtgcaatatgaggagactgcatgcaagctcagtgtgctcccccctcagtctttgggggattcaaatgcatgatactgtatgtacctgggaaatttaccaatttcctgcactgttggaagggggtcactcagaaggggagatgtcttgagatgtattatgtaaagtaccaactgagccaaaaacaataaatgaaacacagaactctcttagccttaagaaagctatatatgaataattatgtttaccacactggtgcatttaaaatggacttttcttcatgggagaacctcgttgacacggacagtttgcaatcttatgttgatcgatgtgaaatgtcatagcagtacttgctcaataaaggtcatattggaaacatagtcaaaaaataaataaatgaaagagcttctgcacagcaaaggaaactatcaacaaagttaccagacaaccaatagaatgggagaaattatttgcagattatgtagctgacaaaggtcgattatctagcatctataaggaatttaaacaaatttacaggaaaaaaacaaacagccccactaaaaagggtgaaaagtatatgaacagacacttttcaaacacaaaaacaaaaaaatacttgcagccaaaaaaaagtattttaaaaaagctcaacatcactgatcattagagacacgcaaataaaaaccacaatagaaaacatctcacaccagtcagaaagctttttattaaaaagtcagaaagtagcatatgttggcctggttgtggagaagagggctcacttttacactgttggtgggagtataatttagttcgtccattgtaagaagcagtgtggtaactcctcaaagaaccaaaaacagaactgccatttgacccagcaatcccattactgggtatatagccaaaggaatatgattgatgtattataaagacacatgcccacatatgttcatttcagtaaatgtggtacatatgcaccacggaattctatgcagtcataaaaagaatgagaccatgtcctttgcggtaacatggatggagcaagagaccattattctatgcaaactaatacagggacagaaaaacagaaaacagaaatactgcatgttctcacttataagtgggagctaaatgatgaaaacacatggacacaaagacagcaacaaccagacagtgaggccaaccagaaggtggagggtaagagggagaggatctgaaaaaagtagttattagctactttgcttagtacacaggtgattaaacattctgaatatcaaacccccatgacataattttacctatataacaaacctgcacatatacccctaaacctaaaagttttctaaaaaagaaaaatgttgtattttgcaaaaagtaaacattttcctttattaatactttataattttcagtgtatgtattttcctgtttgattaaatatatttcaaagtatttattcttattattatataaataggatttttaaaatttcctttcagataatctatttttagcctctacaaatgccacttacttttatttagagcaactttactaaattcatgtattaattgtagcatttttggttgtcattgagacttttagacttttctgcctatacacctatatgtcaactgtaaacagagataatattactgtttcttgtctagtttgaatgtctttcatttctttttattgtatcattgttcttgactagaagtggcaagagcaggaaatcttgtacaggattttagaggagaggcttttgggttttccccattgattattatgttatcagtgggcttttcttatatggctattattgtgatgaggtaggttttctctacacctattgtattgagagttttttaaattagaaataggtattaaatttgacaaatatttttccagaacttattgagatgatcatatggtttttgtgtttcattctgtttatgtagtgtatcacattgaatgacttatgcatgttcaaccatccttgcaccccagggataagtcctagttggtcattgtgtacaattttttcaatgtgttgttgcattcagtttgcttgtattttattgagcatttctgagtctacattcatcaaggttactggcctgtagtttacttttcttgtggatgtctttggttatcaggtcgatgctggctacatgaaatgagtttgtaagtgttccatcatctagattttcaaatagtttaagaaatattattaattctttgaatgtttgctggaattctcccacaaagccatgcagtgctggactattctatttcttcttcaatcttggtaggatgtatctttctaggaatttatgtattacttcgcatttatctaatttgttggtgtatatttattcataacagtcccttaagggctctttttatttctgagacatctgttgtaatgtttcctctttcatatacagttttatttatttcagtcttctctctctctttggttactctaggaaaggatgtgtcagttttatttgtctttttcaaaacacaactcagttttgttgacttttgaaatagcttttttgtcctttttaaaatttattttttgccttaattagcattatttccttctttctgataatatttgggttagtatgtatttttttctgtctttggctagttatttttttaggttgtttatttgagatgtttctttttttttttcttcctcagaaacatttaataggtattaacaaacagaagccatgtctctcgaggctgtgagacaagatggtggatccccatgccattaacccccagaacccagggcttatatactataggtaaggagaattgaagtaatttggtcagaatttatggtaagtgtgtgctcttaacagtagtagagtaaaaatcttagaggcattcccagaaccgaggttaatgaaaagccaacatgttggattagcatttaagacagaattggtttagcctgtacactccacctatctgacccagattttacaatttcacattctctcttcttccaagatggtccctgagcctagagagaggttgtttgatattgcacagctttagcagtagtgcattggcaatggaaaacagattgggcccagttgctataatgttccttctcagaaatacttttgctatatctcacaactgttggtatgttttcttttcatttttgtcaggaggtaatttttaattttttaaatttaatcttggacccaatgattgttcaagagtgtattgtttagcttccatgtatttgtgaatcatatggtttcttgtttctttaccattaactgatttacactttcactctattgtgacctgaaaagatacttgatacagtttctatcatcttaaagttgagttgttttgttatctaataggtgatctattgtgaagagtgttccatatgtgcttgaaaagaatgtacaatcttctgttgttgggtaaaaagttctgtagatgtctgttaggttaatttggtctctcctattgttcaagtaagctgttttccattgatttctctgtggatgttctgtccattattaaaagtggaatattaaaatcttctagtattattgtgctgctataaatttctccagttctgtcagtgtttgctttaaatatttagatctgatattgagtgcatatacatttacaatagttatatcttcctattgaattaacctttttatctttatgtaatgaccttctttgcccctggagacagtttttgacataaagtctattttgtctaatgtaagtatagccattctgctttcttttcattaccatttgcataaaatatatatttttccatcctatcatgtttaactatgtgtgtccttaaatagttggtgccaagtttttattctttcagccagttaatatcgtgtgattgggcagtttaatccttttacatttaaagtaactattgatagggaaggatttactattgaaattttactgactgctgtttttcttgttcctttttttctttcttgatgtcttattttgtgtttctttttttgttattgttgtttgacaggctttaattcctttctccttttcttttataactagttttttaactactgtaggtagtagattttcttttttaagtactatggctattttctgtgtgaatgacatgagtcttacataaaatataattataataatctaaaactgataacttctcttccacacaaaaacttcacatttttaccttgttcccattatagattattgatatcagaatttacatatcttaacatgtgtatctattaatgtaattttagttatacctatatttaatacttttttaaattttagattagaattaaaagtgatttacctaccacaaccacaataatatagtattttttatttgcctctataaatttaccattaccgatgagttttatacttttgtatgctcttatattgttatttagcatcctttgatttcaacttaaagtactccctttagcattttttatatgacaagtctagtggcaataaactccctcagctttcgatttttttaattttgtcttaagttttaaaggataattttctgggtatactgttttgattggcagttgtgtatttgtttgtttgtttccgcattttaaatgtatcatccaactcccttctggcctccaaagtttctgctgaaaatccaccaatgatcataggagggttccctaacacataacaagttgtttttcttttgctgctttcagtggtctctgggtgtccagagtatgccagctctcatcattgccctgaaacaggtgagatactgatcctttttagtagtaaccataaatgttggggcactaactggattttccaatttcttctctcctcagggaaaagctgggtgtataatctgctcatgctgaactgagctggggaaaagaactatggcaaatgtttgcaagctcattcaaaccacagactttttcaaactgttgctttgatctctgtagcctccatgggcctaatggatgctgatctccattagttctcatagacacgtcagttgaaagctagttcctcaggtagcagctggaaaagttaaggggatagatatgtagataaattccttccagactgaagctagaggcttgcttttatcattagagtgagcaagtgggagaatttgtggaaatatccacatgcctgtttaaaatggctgctttgttttctatagcccacatgtaaatagtgaatggcaacaccaatagctctcatagacagtgagttagaagccagacctcaggtaggagctagaaaacttagaatgcttgatttgtagtctaacttctttcatagagaatctgggaactgggctttgttgttgtagctagttggtgaatgaggaggtgaagtggaggagatatgggaagaacccatttgtttgggcattttttctcaatgtaccttagtttgtctgtagtagctggccacagtagtgatgattctatttcctgagaggtgagaattgctgccaaagaatgtctgccatggatgagaatacaaagaaaggaaactaagaactctcaaagcagctactagaaacccttcatagaggacaagaattatcttcagttttgagatatatgagaatgattacaactcctttgagcaggcttcacatactgcccaaagatgcttctctagtttgtgtccttcttgctatcagaaagagagaaggaaactaaataaaacaaaataaaaattttagaattttgtgctgtcttggacatggaagcaatgggtcaggatcaagattgtggaaagatgccagttcggatgcaggctagaaaaattagtattgtcctcaactggaatcagcaaccaaaagactaagtgtatgtgtctctgtaggctgaagggttttcagatatcataaaagataagaagtcaagctacacttgtttggaagcatgtggcagagaacacagattaattgtttaaaggatggcccaaacttaaggccaagtcacatcaaacccatcagaaaccaaaagtgtggcagaattcctaacagaaggatgagagaggaagagccttatatagatctgtcttctgtttcacattctgactattctaaagcttttaatgaagaattccctagagtcataaaacaaaggctaaatggtgagtggctgcaaatacacataaaaatatagtgaattttttgaaaagatatactaatttcaggtggctagaaagatttattaacataagtaataaaggtcttttagttgtcaaagtaacttatacttaatatttattgcaattttaaaaaattaaaatgctaaaaattatttgtgaaaatgagttgttttatatgtttacatttaataacaatactttttacataaagaaaatacaataattaaatatatctgaactagtcaaaagataattataagatttaaaattgagtttatgtgcaataaatgtggtaaacaataatgtgatataaaatcttctaaatttaataatattcttggtagaggattctggggcaaaaatatgattttctccatatccctgcccactacccaatatatgataacatgtggcattattaaatatggaaaaatattaaagaatggcagtagactagagagaagagaaggaaaggcatacaggaaatccaggtccctgccctcagagacctctcaattcctggcatatgtttatgttttgaacattatgcaaatttgtctgcatgacaaatttattcttgtttcaggttaagagtagaaatcaacccatagtccttacgattagaattgccttagcataacgattcaatcagtaagaaaatataatagactagagggtaatggagattttaaaatttatattatcttaatatatttattagaaaaaatattagattgctcaataaatcaatggtaactttaaggcttttactgtctactacaaagaatttttatagatatatgaagaatgatggtaaggaagagatatgatgccatgaggcctactgtgagcaagacactgctaatcaggctattaggttggtccaaaagtaattacagtttttgtctttgaaagtaatgtcaaaaactgtgattacttttgcaccaacctaatacttccgcactttggaaaggctttgcctacatcattttggttattgtgagaagacttgcacacataaggaatttttcaaaataatattttaacttgaaatacttttctttgacaaatacagtaaaagtgatagagccaaaaagaggactaggcatagccctgaggggatttccgagcaaaaaaatcccaggggatttgtatgcaaacacttcgctcaataaaaggagaggccaggtgtggtggctcacaactgtaatcccagcactgtgggaggccgaggtggctggattgcttgagcccaggagtttaggacgagcatgggcaacatgacaaaaacttatctctaccaaaaaaaaaaaagaaaaaatagcggacatggtggggtacacctatagtccagccacttagagaggctgatgtgggagaaacgcttcaactcgggagtttgagacccgcctgggcagtttagtgaaacctcatcactacagataataataataataattatctgggtgtggtgacacacgcctatagtttcagctactctggaggctgaggtgggcggatagattgaacccaggatatctaggctgcagtgatctgtgatcatgccactgcactccagcctgggtgacagagaccctctcttaacaaaataaaaaatacaaaaaggagaaagtcatcaaacaaaatgatgtgacttagtctggtaatattcgtcaagaagtcaagatttatgctctcttacaattctgactttcacattgaattaaattaagggtgtcttggcttgtttagtgtagtttagtaaaatacagtcatttgttttccacagctattatattattctccattaaaaaaagaagaagaagaagaaatgagaaaaaaaaatcagtccctagctagaaattttaagagtcaataacatttgggaaatgaaaatatattctgaagtagtataatcatacccaaatttttagactctgtactcaatctataagatgtatgtgagcaaaatattattagaagcaacatgaatgataatcacgcactacaagcgcacgaataatgtttccctgaaaggtacaataaaaaattattcaatgtgaaacaaaacgttgactgcaacaattattaaaatttgactattgaattgtcagtatactcaattatgaagacatttggaaaatataaatgagcactactgtttttgctcattttttaaaaatgaaaatttttggtaatgtctgacctgaaggcagatattcattataatagtcaaatatcataaatacatttcaaatgttatgtattctacataaattactcaggagaggaacatgtaggctcataaacttgcacacaagtaaaggaatgtttcttaggaaaaaattctgtgttaaagatattccacaccaatgtctcaggaaaaggcatttgtagtatactgctccattacctatgcttcataaaaaatgcagctatctaatttaatttagctctgaacagatttcttagcagcataatttatgttttgagaatatctcttaagaatcatagcttgcaatctatggtgcttcaatgaagaataatctgtaaacaaaatctccatctatcaacaaaggccattaaagaccataaaataacccatccttgactgattaatgctgctactgaaagggatttcaggctattaacatccagaaaatatactgccactgtggttgcatttattataaatcacatagttatatgtactggtgtaaagcaatgttttcttaaccacctccctctcccaaattaatttaataacaaagatactttgaagaacactaaatatctatagaaagtaaatgattctatttttttccctagaggaaatgtatgtgaaggcagggctatttataatacattagatagctaaatattggtttaacactttatatgcagttcaattatgttcatatatttatgtcattaaaatagtttctctaatgtaaaataaaacattaaattcatttgtatttcttgatacttttattaacaatactgatggtttttcatgggtaaaatagccatcaaaaattgttagttgttacctttaggttcatcctattctgtcaatttgattgtcactaactcttcctcttaggggatgtgaatatagctgttgagctcatactcttggaaggtaaagaggctttgtttactggtgcagatctcgattttttcaaatatagtatttcacctcagaaatactatctattagctcttatgccttacaaaactactggcttggatttgtccaatggttttaacccttgatcttacctttaacatgcttggaatctcacaaatattttcttatattgtttagtacaaggcactgtctaaatagtttagccacattatctcattccatttacaccaatcccatgagataggtacgttttaaccattttataacataagcaaaactcaatttcaagaggttaactaatatttccaagatcacatagctagtttatggcagaggaggattcaaacacaggactgtgttgattcaaaaatctatagagttaaatgtgtacttgtccttccgtaatatctgaggctagacaaaacaatccctggcttttctctcctgctttctatgaatattctgtcttagactacttagtcattatatatttttgtcttttcagtagagttctgttttgctgtgctagttcttttgggtttctataataataaaaataataataaaaggagaatagaagaataagagtagatcagggagaagatattctgaagataagttggtttaaagagaatgagttaatggatcagcttttgtctctgaagtcaacaaatgacaaagaaatgaaaaaggtgtaccctggaacaatgcatctatctgctggtagtacttgagaaatacatacaaaattcatatttttattttcttttgtttcattttattgcttattttggtcagtgttatttgcttcttatactagtaacattcctccagcacagaacaacatatctttgcaaatatttcattaaatatataaatgtcttaaataccacaaatgaaagacatgagtaacacaatatagtccacaaaactcaaaaggaaataaacacagtttagcatttttttcttacaattgaaaagattttaataactgttgagtatttataattatctatgctaactcccattttcttgccaagttatgtgtctttaaacactatggagtccccttgcaaaatttaacagagaagcaaagatatgtatcagtaatattgatgtttttatttttttaaaaaaaacctccctgataatttaagtgaattggattagaataattaaaacagaaatgaaggacacagaagcacatattctcaatatcgtcacctctgattactttagaattctgttagcatgtgctgtaaaaatcctttttaaaataaatattcccactataagcttaagtttattcatatctagggagaattgttttgttcggataattagatcaacagctgactctttaagctgagataatggcccactagccaataggaatcacacatgttaaggagaacagaattcaaagagtctggtcccttttgcacagtgacagaacatatgaggcagctacatatctagagagacaagaagataaatataagagagcaaccaaatcaagatgtaattactctgcatttaatcaaggcaccttagggttagtccagaccttttatccaaaacagctctgtaaacagcctactaaaccagcatcatcagctttctgtatttctcatctgtctaagtcagtcttccttgtttcaccatattcctacttgttttgtcttcaacactttctgagagaatgaagaaaaatgacaaaaaacaaattgtatgattgtatgaatgattaatatctcctctttcatgttgttcctcttctattgttcaaagagtatagagtgaataaatacaaaaacaaacacaacactgaagttaataaataataaggtccatctcatttgttaaatttcgtttcttaaggtatatgtgtctttgaaccttctggttatttctacaaaatagttctagtggctttggcagagtggtagcataacacatcactttttaaacagagttgaataattgtataaccctaaaagtaaaagaggcaaacaataaaatgaaatgaacaaatgaaataaaatcagaaattctcagcttaacaaaaccacctttcttgtgagcacattttgtgcatagtgaaataagggacatatctctaaagctctgtacacatatatttattaaaataaattgaattaacaattggcactacacagagtggcatgaaaaggttcagtatcttaacctcagctattcactaagataaaaggatcaccaacataaaatcttttttctttgcattgttaaacttaaataagtgttttttctctaaataaaatgattaatttttaattatgtagataaattttggatctaggtggactggaggcataaatgacacttacttagagatataaccagcaaagtcaagatggcaactttacagaaaaacataatctaaaagtttgaaaaacaaactgcagaatatattgtgtgtggctctttttatattctaaactatgttataaaaattttgcctcgacttacttatataagaaaaataaaactggttgcagaaatataatttagtattatgtcttgtgtgacctaacaattgggtaacaattatactaaaatgggacataatttattaatttacacagtataaaacctattggaatagactttgtaagttccaagtaagtttcttatcgtacctggtcagatttactttgcaatgtccatcttaatatttatgtttttaatatttttaaaataaattttaaggcaatagcatgaatagatgaatacataagataataaatgaaactctagctctttataacttaaaagagggtaggataaagaggcatggcataattttacattttaacttcagtagatgacaatatttgggaaaactaaggaaatatggaaggttagacaaaaataccgattcagggctagaaacaatatttatattttacaatgcccattttagggaaacacggcattgctatgtttttaaagcacgctttagagagtgaaagagttcactttagaaagtacaatttagaaggacttcactttctaaagtatgccttagaaacacagcaatgctatgtttttctaaaatgaagagaaagaaactttatcactctcaaacagcaaggcttaaaatttgtagagaatgtgaatgaggaaaagaaagacaattgttcaggaagttcaataaatcatatttgctgagtcattgagttattaaattcagcaaatatgattcactttgtggcataagtaacagggaaacatgttccatcacaatttcaagatgaaatataaaaagcttcagtctctcttttgtctctctctcacacacacatacacacacacacacacacactcacacacatacacatatgcacaaggtaattgaggctagggaggtgaaagaaatgtagagtagggtctctgacaaatgtggtgaagggtctctgtgtacataatgattttttgaacaatctgaagacaattaagcaaattcagaataattttaacatttcagcagattaactggtattaaaaggggaaaagattggcagaagctttattctaatcatgcaccagaacaacaacaacaacaaaaacacacacaaaaaatcaaagtggcaaatggtttcattgattattgtgaactatccggcacccacgagaaaacaataatccaaatttgttagctcctcaaccttggatgagttttcatgagtattttataaattagtgctataatggcaggagacaacgaactcccagaccacttccaaatttaaaattatatagttttccattgaatagtttattattttcttaataaagataactgtttcttaataaaactaatgctatataaagacaaagtggataaaaaatcattagcaagagaattagtaaacaatgcatagcaacatacatgcatatgagcatatatatacacccatatatgcatatacactagacctatatgcacataattgtaattatatattagtataacaataaaaatcctaaaatatctcaaatgtggaaataaaaatgctgagccaacactagcctagagggctgagaggccagaagagattttgagtttcaccatctgttggatcattcaagcatttcacaacttcctgccagtatcaaatctccgctattttatttgttccaagaaattttaaaacaaatgagagaggtaaaagcagttgaaaatgctgaaagttttgttcactttaaggggttattgttgaggcaatattgctcattaaaggaattttaatggcttaaaaattaaagcttttcaaagtcaagtactttatccctttggaagttttagcaatttaaacttgaataattttcatgaccaaagtaactgcaaaactataattttatattacaattgtatttgtaccatctgacctaattattaaatgtttaaacataataaacactaatgaagtgctctgtcactacaaataagcttctggtcagggtgctattgtcattctactttcttcttgtagttttgttacttttctcgtgcttgtccacagaaattcccaccaagagtcaaagttccacttgcatactcctgtgtgtggaacaagggtttgggatcaaagagtctgccttttcattctgggctctgctacttattacctcttccttgaatctatatttttaatctagagtttctaatagttgtgatgaggatcagatgagatataaggcagaattgcatttgtcaaatggctaatatatgatatgtataagatatgctaagtactcagtaaatggtaattgtttttgctatttctgatttgggcttggattttaatttattttttattgaatgttggataggtatttacccattcacacaatgttgtctaaatgttcatcatactttctaaagttaagggataaagtacgctgaaaggtagctattacctaaaataataactatacctcaggcgagataatacatattatgaattgagaataaacacgcattaaataagtggtaaagcgatacaaattgagtttatacagtagaaaatagaagggggttatttctattggcagccataaggctagagtatgttgggcataattcttctttaccagatacaatgttttgtatagaagtatactcagtagattttttaattctgtgtttctggaactaaacagaaatgtgtggaaattgtagaattgggcaagaaatggaattagaagattcaagagttaatccaacggatgtgcatagattgaagaaataagtccaagaaaataataaatggattagaattttgcaatctctagtactcatagttttttaaaagcaatattaatcaatgaaatacatatatgtgcatccattctatgccaagaacatcacagttaccttggtacttgagacacggagacaaataagacactgtctatctctataaaaacatcatagactttcattctagtgagagagaaaaacacacataaactaggaatgacaaaataagacacatacaaataacaacgtgtgaagcatttcatatttacaaaataaacataaaatactgttcattttctgaaaaactttctccatttatcttgaaatatgtagtatttctgtcaaattttataatctattattaggtatagaaacataaatacagagataagtttttcaataataaaaatattcccagtggaaaatggcgatggatacttagtcttaatgtcagtggcatcacagggattggtacagacactggtgaactaaaaatatcacacggtttaaaggcagtggactatacttggaaattgttgctgtagacaacagcaggctcagcattaccaaattatctcatttttttgagtagaaataaattttgatattttaatgtgcaaagcctttaaaaatgtgttcaattcaaaaaagtggctaagaaaaaaattaaaaataaagtttaaaaaaccctcaaaactatatctgtgggtggaatcaacattcaggtttctgctgtttgatcctgaactcaaggacttataaaagggaggcatgaagaagagctctgcaaaaactatagaaaattggaagatacagaaagaacactgaagaaaaagctactgtccttagattttctatggaaaattaggtcaggtataaagaacatattcctaatcagatgaggaacttttaaatcagtgaaatcatagaactgcttctttggaggccttaatttttcatctgtttggggttatttaaatgaagccattgcaagtgtgtcctattttttcaaagtatattttgtggactccccaactgtaatcacaggatgtgcttgttaaaatgcagattcccagacacctttccagatacagaatcaaatatttttggttgggtacagaattctgatttttttaaaaaattaactctagttaactttgatacaaagtacatgttgagaattataccactggactcacagccaccaaagacacttgtttagttggcgactttgagacccagtcagacttatgagtacctcggaactggaacccaagagacgtatttataacaagtttaactaggtgacattaatgtgtcttcagctacatggaggctatattttattgcattatatattcttccttcttgttactaatttctttggatgcccgcttttacaataaaattaataatttagaagcttataacttctttgtaaaatggcatttctagcccaaatacttgtttaaattcagcataaaaaagaaaacctagttcataagtgatatgtcattaaggatcactgttgtttatcatgaatttcattgtatctttaaaaacatgacgtttttatttttattttttaatttttatttatttatttttttaagtagagactggatttcaccatgttggccagcctgtctcgaactcctgacctcagatgatccaccagccttggcctcccaaatgctgggattacaggcatgagccactgcacctggcctaaaaatatgactatttggtaaacatcaccagggtcctaagaatattgtgtagattatttccagtgggatggtagccattgagcaaccaactgatcaaattttaagatcttgtaagatcttgtaagatgtaaaatgtagcactttcgtaattacctaacttatttgtgaatctgcttttgaataatagtaaaattgtgttttcaaagccatcttactcagaagtaaattatgttaatatacaataaagagaacatacacttttactatatgtatatggaaaattactatatcataaggtcttctatacagctaaaatttttgtgacctgggtacctggacttcaattgagtgagaaaatgaaactaagaaagttacagcattgatgaatagcatagtatatactatattaacagtcattactatatattaaaaagtagcttaaaagaaaagaaaaggccaggcacggtggctcatgcctgtaattcgaggtgggaggatcacaaggtcaggagttcaagaccaacctggccaagatggtgaaaccccaactctaaaaatacaaaaaaaaaaaaaaaaaaaaattagtcaggcatagtggcgggcacctataatctcagctacttgggaggctgaggcagagaatttcttgaacccgggaggcagagatcgcactgagctgagatcgccactgcagtccatcctgggagacagagtgagactccatttcaaaaaaaaaaaaaaagaagaagagtaagagtaagaataggagaaagaggaggatatagaatggaataagagtcacagaatgagagtattcagcccaactgtaactttgttttcaagatatattagaagcctggggaattcttctataaattctacttcccatttagcatgttctaaagttcttctgtcatgtcagtataatatgagaagaggtaatgtattttgatacctcctgttttctatagacaaagtatgtagattaagtacatgagtatttgaggttcaaatgcacctattaaaatgacagtataagtatctatttaactggagcaataaacatacatatctttcctaaagtgatacttaggttattacaaatgccctattaggtttagttatcttcctcatttaaaacactttccacatacagatagtagtagactactaaccttatgctggaacatacattatgatgtaaaaccggggaaatatttcaggtaaactcattctcagcagtggtacatgattatgaagctgtgttttatcaacatgattgctgtgagcaccaaataagaacatgcaagtagcttggttagcataatgtatagcacagagtaagaatataacaaatgtgagttactaggattgtaaagattatcattattattgtttgaatagtaatctctgtatgtaaatagacatacatattctactaacagatttgtgttatctacttgagtgtgtgtatatatgcgtgtgtggctatgtgggcaccagtggagcaataatgagtttgctacatgttatatatttctagaatcactaattatgttgaaatattattacaaaagtatgtgccttaacaaactaataaatactttggtgtctaaataagctcaccatagagcaaaatatatgaagacacacagagatagctatatatagagacaacggcagcatgttattccatatggaaaaaaaaatttgtatctgcagataaaatggcactccaggaggatatcaaagcatcaaatggatgttttcattaaaagaaaatttgtacatgaatttttaaaatttcagttcatgatgttactcattagctctatttttaacaaaatgttcccttttgcatagagaaaggaaagtcaaacactgatcttcaatattaatagttaagaacctgaaaacatcttacattttattttataggtttaatctaacttaaaaaaaatgttaaataaaagacaatgaaattgaagacccctcctggagaaactagtgaggatactaatatagactctacctcctcaaaaacctaacttcaaagagattttaaagaagtcatcaattctctcacatggcagactgggataacatctgttaatagagacttaaaaaaagtaagtaatttaaggaagaagggttgataattcattgattgggataagagaggaaatggcaagagaaacaggtatggtttcataatgacattgagataagtctcaaaggctgaaggaagaatttaatataattattacatctagtgatactgatgagaaacacatcctttctccctcagttttctttttgtgcgtaatcttgtaacagattgttcatgttttcagtaaatactgggagtgaggaatggtggaatgcagagatgttaagcagagggatttggtcccaccaaaggtactctaaattaaataagatgtgctcactttgcaaaagtgacttcaagataagtgcctagcttccaccattactgctatactccacttctaacaaaattatcatctttaattttctagactgccgcactagaaccatcatagtgtggaccaaatttacactatttttctacttcctatttctattcttctaaagttcttaatctgtgttctaaatctgggactgggcttctaagagtaggttcactgattgtgttatccaagacaggggttggcaaattatagctcaccggacaaatccaacccacacctgatttttgtaaggctgaaagggtaagaatggttttgacatttttaaacagttggggaaaaaatcaaaaaaacagatatttcttaacatgggaaaattatataaaatttaaatgtccacaatcttgttccccttttaaagatatattgttgattattttaacactacaacaaccagagttaaatcgttgcagcagagatgacgcggcccacaaaagccctaaagatttactttgttctttacagaaaaagtttgctgacccccaactcaataacttattttatataaacataaatttttcaggaaaataatactgtgaacccataatatgattgtagcataatgggaaaattaggcaaagattgataaaataccaatcttattattatacagtcacatatcatataggaaaaatctgatacaatggatttaatatatcagatgggaatttgagataaaaaagattctaatatttctagtcttataaatgaaactgagcctaaatgaagctttcaggggaaatgatcatgtaagacaaattacaggggttggtttctaaaaccgattctttttactctttactgaaggtcaaggatactgaatgtgccagtgcaccttcagaaagcagcctgcatcagcacatttaaaccactgaatggtctcaccacctagtttcttgcgaaagctgagcaatacattttgtgatagataccactgagaaagttaggcagaaattgttattagtagtatatgacaatcataatagtctaacttttactgtaaaactctattatttatatgttttctgtacatcctgtaggattgtctgtattttgcaatagaattgcaatgtgtaagagaaaaagaggcagtctatgtttccattgtcattctaagggacatattatccatacaacacctcctttttcccctttactgaaaagctgtgtataaaacactctaccatgctttcctgaaacataaaagaagatttattactattttaataaagaagtaagaacaaaaatatccaatctcctaatattcaatggagaagaatatatattcttttttaggaggacacaaaaatagcaagcttaagtatattctgttccctaaggtactgtgtaggtggagaaaattatttttcatttaaaattatatacttgtagttcattttaagtaagcccagtggacataaagctgattcattcacaaatgcaaaattttgttgtaattatttgcttaaccaaagcaatattcatcaaaaatggattaatgctaggattattttatttcaagtaaatgaacatatattgattagtgaccttccaaaccccatgctagcaacagtaattactattattaataaaatacatcctctagtgcatattaaatggttcaatttattaaatatgctgatctctgcatacctcctcaagattattttttaagaaaagtttactttgcctgagaaagaaaagatgaaatatgcaaacactaagtttactaaaaccaccaaatacaagctgccttggagtcccgttgttctgaattgtcttaccctcttaaaatcagatgttttaagcagataactcaatttttcatacaatataaaatgtccaaaatccgtgtaattctctgcctctgaatacatagtctctatctatttttctcattgttttaatctaaaaggaacattatgttttctctttttaaaagtaccctccttcagcattgtttttacttctaaactccttagattttctcctcaaatcccatttttctccgcacaatctcatcctcctttagctagaatcactcactggtgattaaacagagtcacgcagaaaataatgaatgcaaaaatgtgggcaggaagaaagataagggaagaaatattcttcaggaaagaaaatgaaacggtatttgtcagcgatgttgtaaaggggaagaaacattagagaaagggtgattggttgatagtgtcaaacgctgtaaagaaaggaaagaagaggtattttttaaattagcaaagtggagaatcatttttaaactttgagttagagttattactgaggaatgagaatttaagtttcctttgtggttttctgtgcttactaaatcaccagctcttcttataaggtgagtgatatatagtaagaatgagagtctgtggggaaggctggtgaacatactttgatgaaaaaatggactgtaaaggagtaccatccctgtcataggaagagatattttagtgtctgaatctgtgagggggtgtgtggaggtcaatgttgatgctctatgtatctaccggaggaaatttatgtgtgtgtgtgtgtttatctattgtaaggggaagccgtgagatatcagacttccctggcttttcctatctctgataagaaacactgtagttctagggaagctgagcgctggaaaggaccttgactttgataaatacaataattggtgacaagatttaaattttgttttccatgagttctggtgatagggcattctggcttgttttatgtcatttgtcctaatcctcttaacctcttaacctattctacaaaccactttaaatatttcttctcattattccaaacccttgctgtcaaacatcattgtaacctgtgtgtatatatatatataatatatataatatataatatatataattatatataatatatataatatatattatataattatatatatactatataatatatattatatataatatatattatataatatatattttctatatattatatataatatatattatataattatatatatattatatataattatattatatatatatttttcccactacagtgggaaaaaccattaatccagtggctatttcctgtacactatctctcgtgtctgtgagctcctttctgtttctattgccatcagtgtctttcacaacctcctctttctttatgatgtgtttcaaagcagattctttattttcattctcccaagacctgctgcaccttgcctactaatgtcagatacgttttcttcaaatgtcacacttcaggttagttatttgattgaatgcctatgtgattcccactacttccatataaagtccaatccaatcaacttaattattcacagttttgttcaattgattttactttccctgcctgactttccatttgtctattcaaggtagactagtttccaccattgcgctgacttcttgccctgaaatcactacttacagccttactcatcaaagcaaacgacatcaattaatgaagtaaaactcttgtcctaggctgtctattggtcttctctgatcctttggcggcagaagctctgcatacatccatcttgcctagacagtgttatgcaaattaacacaaccaaaaacaaaagtcaaattgtggttccttttatatattttataagtactattattaataatgaaaagacttttttttaaaatttgactaacttttttacataatactatctacttcataacatgaaaggattaagtggatttttataaataatgtgcatagaaccatgctgagaaaaatatgaatgttctaacattggtactgattgttattgttatttttactgctaattcttaattagtagagacaaatgttgactgaactatttctttggcgagaaataaataatgccatattttgggctcttcaagccgagtctcttctggcttggaacactaaactatataaattgacccttattatttaaaatgtaaaccacattaaaaattcattttcttaatcaagatgaagctaagatatttggtttccaaaccattaaaatttttatgagcaattctctgtaaaagcatttacctctggtatagtcgactactagttatgtactaataactattactaggatccattagctactcgctttgatctgtgttgtcatgaacaggaagatttggaaactgttgatggtttatacattgactatacaaaatactatattttaaaatgaaatcatatgaaattaatttatcaagattaactgtagtgattacaaggaaagaacagagagtacatgtttgatacattaaaaaatcttttcaaaaaccaaagaaaatcatgggtttagattataaagtcataaggtgataaggcaacttttgctcatgcggaaatatgttaattagttttataatattgtttctccatcgaagtacttatacacgtgtttggctacttaaaatagggtaaagaaataaataaataaattataatgctctaaatgaaatttggcatataccatctctcaaatttgcagtttatagtgcaggaacaaaaaagaaaagggaagtgtgatgaaaatatttagaaccacttgtctagagtttaaaagaattagtagcaaaaatattacaaaatataaaactactgattgccttgaatttgttacctgatcccaagttatgaacattaaaagtgtcataaagaaacaaagtcagacacttgttaaaaatagcaagacagatcttagtaagatactgcagtagggaagagagacttcagtggaaactgggttcagctctgatgaaacaaaaggcagaaggctgtttaaatgctggaatatgctaaagtaggggttcccaatccctgggccatggaccagtatgggtctgtggcccgttaggaactgggctgcatagcaggaggcgaatggtgagtgagcaagtctaagtaacactttgtatttacagtggctccccatcactggcattattgcctgagctctacctcctgtcagataagccacagtattagattctcatagtagtgcaaaccttattgtgaactgtgcatatgaggggtctaggttgcgtgctcctaatgagaatctaatgcctggtgatctgtcaatgttcccatcacccaggtgggattgtctagttgcaggaaaacaagctcaggactcccattgattctacattatggtgagttatataattatttcattacatattacaatgtgataataaagtacacaatacacgtaatgcacttgaattgtcctaaaatcatccccccaccccactgggtccgtagaaaaattgtcttcagtgaaactggtccctggtgccaaaaagactggggaccactgtgctaaagcaaaagtaccaaagcactttgaggtggatgcttaatgtgattagcccagttgtgtttgctaactggcacttacagaaataaagtccctactttaccacagagactgggaaatagaggccctatctttctcaatggttacatttcaaaaggaggtctcccaggtccttgagaaagacattcctgagttgcagatacatttcacaacgacaaggaaaggactacaagtttcctaatgtaaattctctaagaaaagggaagtctgggacccatagccaatgatatggtttggttctgtgtccccacccaaatctcatcttgtagcttccataattcccatgtgttgtgggagggacccagtgggagatgactgagttatgagggggagacttttcctgctgttctcatgatggtgaatgggtctcctgagatctgatggttttaaaaatgggagtttgcctgcacaagctctctctttgcctgctgccatccatgtaagatgtcacttgctcctccttgccttccaccatgattgtgaggcttccccagccacatggaactgcgagttctctattaaacttttttcctttgtaaattgctcagtctcaggtatgtctttatcagcagcttgaaaacagactaatacagtaaattggtaccagtagagtgaagctttgctgaaaagatacctgaaaatgtggaaacaactttggaactggctaacaggcagaggttggaacagtttagagggctcagaagaagagaggaaaatgtaggaaattttggaactccctagagacttgttgaatagctttgacaaaaatgctgatagtgatatgaacaataacatccaggctgaggtggtctcagttggagatgaggaacttgttggaaactggagcaaaggtgacttctgttatgttttagcaaagagactggcagcattttgcccctgccttagagatttgtggaactttgaacttgagagagatgatttagggatatgtggcaaaataaatttctaagcagcaaagcatttaagaggtgatttgggtgctgttaaaggcattcagctttacaaaggaggcagaacatgaatattcagaaattttgcagcctaatgatgtgatagaaaagaaaatcccattttctgagaagaaattcaagcgggcggcagaaatttgcagtagtaacaaggaacacaataggggaaatgtctccagggcctgtcagaggtcttcacagcaggcccttataccacaggcctggaagactaggagaaaatggtttcatgggcagggctcaaagtccccctgctgtgtgcagccagggacctgatgccctgcttccaagccactccagccatgggtgaaaggggccaatttagagcttgagctgtggcttcagagggtgcaggccctgagccttggcagtttccacgtggtgttgagcctgcaagtgtacagaagtcaagaattgagttttgggaacctctgcctagatttcagaaaatatatggaaatgcctggatgtccaggcagaagtttgctgcaggggcctggccctcatggagaacctctcctagggcagtgcagaagggaaatgtggggttgaagtccctacacagagtccctattggggcactgcctagtagagctgtgagaaaagggccactgtcctccagaccccagaatggtagatccactgacagcttgcacagttcacctggaaaagctgcagacactcaataccagcccatgaaagcagctgggaatgagactgtagcctgcaaagccacagggatggagcttcccaagaccatgggaactcacctcttccatcagtgtgacctggatgtgagacatggatttaaaggagatgattttggagctttaaggtttgactgccccctggatttccaacttacatggggcctgtagcccctttgcttcggcaaatttctcccatttggaatggctgtattttcccaacgactgtatctgcattgtatctaggaagtaagtaacttgcttttgattttacaggctcataggcagaaggcccttgccttgtctaggataagactctggactgtggacttttgagttaatgctgaaatgagactctgggggactctcgggaaggcatatttggttttgaaatgtggaaatatgagatttgggaagtggaatggtatgatttggctgtgtccccacccaaatctcatcttgaagctcccatagttcccacgtgttttgggagggagctggtgggagatgattgaatcatgggggcagatctttcccgtactgttctcatgatagtgaatgggtctcacgagatctgatggttttaaaaatggaagtttgcctgcacaaactctctctttgcctgctgccatccacataagatgtgacgtgctcctccttgccttccaccacaattatgagacttcctcagccatgtggaactgtgagttttccattaaacttctttcgtttgttaattgtccagtcttgggtatgtctttatcagcagtgtgaaaatggactaatacagccaggttttggcagaaacaaacattaacttattttagcaatgttgatgtttgtcaggtagacatttaagtgggctgggattgttaacctgggacacagccttgaactgttaaaaagctgtgctagaatttgttcaagtctcttagtgtgggacatgcacaaaatcatttatgctgagaatctgcagttctcacaggccaaggttaagtcccagtcaataaaaatgctcggaggagcctgactaaagtctggtcaaggagagagtctttgccataagaaacttaataataactaatatctctaggctactatttgtcatgcaatgagctagtatttgcagctttttcttatttaattctcatatttcctcttgaggaatatactaggattactgcctttatttgaaatgtgtaacaggctaagtaattttttcatgaattaatgctgtcctcatttatttaaactgtattttcataagttagcactagatacaggaaccaagggaacaggtgtagaagtcccaagaaactgaatgtgtgggcaaagcaaagaatggctaaacacacaacatccactgagttaccatgcacgagaagaagcaggaagatgtaggtcccctgttggccttatattcttcccacataaattatagattaacatatttcctgattttttgaagtttccagagatttaccaacttgatctttcatgtgactttctcttattctggattttcagtgacttttcctctcactttattgtctctaaaatcacagaaaccctgtttaccacaattattttcttaaatttatttctacaggtctttagttaaaaggtacagggaagcagacaaaccttaaacttgataatacgtgggaaataatgttactggtatcttagaagtcatgccagtaattcgtctaaatttaagcatcaattgaaatacggatgcaaaattattatacgtgattaattactttaggtctttcatcagtttatggtagagtaaccaaattgcccttgatgcctctcatgtgtcaagtattgttttgggtgcaaaggatagatcaataatatgacatggttcttgagtcagtttggttatgactggagttggtgagaatgttagactcacattcatgagtggatttgataaatacaatgtggctgacatgatgtctgctctcaccaagacttccatttcagttctttgatttctcctttgctttcgttaggaatggcctatatttggtacaccaaaaatttacactaattagtgagcacttctcctactttaaaagagaagctcaaacaggaaagaatacacacacacacacaatttttttggtatgagattcaaaattcctagaaagcttatgacaaaattatcaaatttgttgaattctcaaaattgctaaatttctgaataatgttcatctagctacagtacttattattccaccggaagaaagcatatgcttcaacacaaaaaaaaaatttgagtgcaaaactattaagtaaaactctgagaaaacatcatttttgtacttggcaataaggcaattacttaaaaaaagttagctaatatttgtgagtgttacatttaattaaacattaaagaactttatagaagtatttttaaaaaggaagaaaggaagaaatgtaataacccagaattcaagagaagataagcaaaatgttatttgacagaatccagaagcacatgaaaaagttaattcaccatgatcaagaaggctatattcctgggaagcaaagttggttcaacatacgcaaatcaataaatttgattcacctcatacacaaaacaaaactgaataaccatatcattatttcaacagactcagataaatcttttcataaaattcgacatctctttatgataaaaacctacaacaaactaggcattaaacatacctcaaaatgataggaaccatgtgtgacaaacctagagcaaaatcatactgaatggacaaaatctggaagcataccccttgggaactggagcaagacaataatgcccactttcaccattcctattcaacatagtactggaagtcctagacagagcaatcaggcaaaagaaaaaaatacaaggcatctaaataggaaaaaaggcagtcaaattaactctctttggtgctgatataattctgtacctagaaaactgtaaagactctttgaaaaggcccctagaattgattagcaactgcagtaaagtttcaggatccaaaatccacatacaaaaatcagtagcatttctatacaccaataatgttcaagttgggagccaaattaagatcaaaaacccatttacaatagccacaaaaaaaattaagtaggaatgcatccaacaaaggagatgaaagatttctagaaggagaattacaaaatactgctgaatgaaatcatagatgaaacaaatgggaaaatgttccatgctcatgaactggatctaccgactacgtttttcccagaactagaagaaagtcttctaaaattcatatggaactagaaaagagcttgaatagctaaagcaatactaagtgaagagaagaaagctggaggcatcacattacctgttttcaaattgtatataaggctactttaactaaaacagcatggtattgtcacaaaaacaaacacatagaacaatgaaacagaatagaaaacagaaataaggctgcttacttacaaccatttgatcttcaacagactcgacaaaaattagcaatggagaaaggactttctattcaataaatggtgctagtttaactggctagccatatgcagaagaatgaaactgcacccttgcctttcatcgcaggcaaaaattgtcttaagatgaatataagacctaaaactataaaagtgctagaagaaaacctaggacatggcattctggacatcagccttggctaagaatttatgagtaagtcctcaaaagtaattgcaaaaacaaaaattacaaaaaataaaaattgacagttgggaccctaaagagcttctgtacctcaaaataaactatcaacagagtaaacagataacctatggaatggaaggaaatattcataaattatgcaacttacagaagtctaatatccggagcctctaaggaacttaaacaattcaaaagtgaaaaaacaaataagctcattgaaaagtgagcagaggacatgaagagacagttctcaaaggaagacttacaagcagccaacaaacaaatgacaaaccctctacatcactaagtatcagagaaatacaaatcaaagcaaatatgagatactgtctcacaccaatcggaatgctattattaaaaagtcaaaaaataacagatgttgatgatatactttgaatatatgtccctacaatatctcatgtaaaattgtaatccccgatgttggaggtgggacctgcttggaggtgtgtttgggttatggaggctgattcctcatggcttggtgctgtcctcatgacagtgagtgagttctcatgagatctgatcatttatcatttaaaatgtgtggcacttccccacctctctcttgcttccactctgccacgtgagagccttgctccagctttacctttcacctgaggcctccctagaagctgagtagatgctggtgctgtgcttcctgtacagcctgcagaacaattagccaattcaatctcttttttaaaaaaattacccaatgtcaggtatttatttatagtaatacaagaacagcctaacacagttgctgaggctgtggagaaaagggaatggttatacactctaggtttgaatgtaaattagttcagcctctgtggaaagcagtttggagatttcccaaagaactcagaactaccgttagacccagcatttacgtgactagggatacacactaaggaaaataaatcatcctacaaaaaagggacacattactttgtgtgttccatcatagcactatgcacaaaagccaagtgtattagtctgttttcacactgctataaagtactgcctgagactgggtaatttataaatgaaaaaggtttaattaactcacaattcagcatagctggggaggcttcaggaaacttacaattatggtagaagacaaatgggaagcgaggcacctttttcataaggaggcaggaaggagaatgaactcaggaggaaccaccatacacttataaaaccatcaggtctcatgagaactcacacacttcgcgagaacagcataggggaaaccgcccccgtgattcaactaccttcacctggtctctcccttgacacgtggggattaaaaggattacaattcaaaatgagattttggatggggacacagccaaaccttatcatcaagacatggaatcaacctaagtgtccatagattggataaagaaaatgtagtacatatacaccatggaatactacacagccataaaacaagaatgaaatcatgtcccttacagcaacatggatgcagctggagaccattatcctaagaaaattaacacaggaagagaaaaaccaaatactacatgttctcacttataagtgggagttaattattgggtacacatggacataaatatgggaacactagcactgggaactactacagagggaagagtaggagtgggtcaaggtctgaaaaaatacctgctaggtactatgctcactatctaagtgatgggatcaatcataccccaaaactcagtgtcacacaatataccatgcacatgtgccccctgaatctaaaataacagttgaaagcataaaacataaaataaaataaatcttcgattggcatgataaatgttaaaaattaaacatcaagggaaactgtgtgagaaacatatggggatactctgtattaccttggcaacatttcagcaaatttaaatttatttcaaaataaaaattcatattaaaattacccctgctaaaattttaattaacaatatttataactttaaaaaggaaattaaatgtgtttcaagaataaggggacactgacatcctccttcttccattctgaagaagatcataaaacataagcacctgcacctgccccaagactggatcaaaaggtgaacacacagatctattaatcactcatctaaaattctcaaacgctaagatattccatagactctaaagtcagacctgaatactacctcaaaggacttgaacaagaagttccaagaaaaaaatagcaacagtagttttaggaggaaatgtgcataattaataggtcaacaaggataggtaagagacagatagcctgaattcccactaatgggaatattaaaaagaaacaatgaaagaaaagtatatacttacctgtacaaatgaaattgtaaactaaagagaattccagtttagcagattaaagctgaagtcttgactcaaatttccatttggtctaaaaccataatggaatacggagactgaaaaaaagcccaagtaaatgagacacatttctgtggaaggagttaaatgattttatttttttcaacagagtaacctgaagaagggagcctgcataatcctgaaggtcagggagcaaattaaagagtaaaggggcatccactggagattttcttctgaatgccttgggttttaagcatatccttttgtgagatgcaagggatgttgggttgtaggcagagctagaaatctttcccttcttattttctagttcttttcagaagttgccctaatcatttagaaaggagatttgcatgaacctgaaagttgcagagtttgctttgtaaagaataagaaacactagtgtcaaagatcaaataaagaaggctggttgctttacccgttattcaggcagagaaggaaaatagtgaactgtgtggaccatgtctaggttcaaggaggagacaggtgaaagcccagagtacctaacagtggagaatttctggacactggaggaaaaaaggtttgatgtgaagaagattcaaaaagtaaaatgaaaaagaaacagtgtaaatatgtcctccccacacaaacactggctcactgagggaaatgggagtcttcgtaatctccaaggtttcagaaaatataaagtatctacctgtaaatcaattacgccccaacccaatgctaatgaatgtactttctatggagagatctctctgcaataaccatggagaactgaaaaactaaacctaaatcataagaagagtttaggcacatattaggagtgttttagagaaaatgtcttctgacagcatggttgtacacaaatcagccagaacttttcatgaccccatgcattagctgatatgccaagatgcccatgcaccagccatgaatctccttctggccactggagccaatccttatcttcataaataccttccattactttcaggtttcttgtgtccatagccaaatgactgaattaaactctgaaaaacttgtattaggagcaaccttgattcttaccaaaaacaatactgcatttcaagaagatgaaactttttatatggtaaattataaaatcttgcactgctttctatacttgtatcaggagcacccttgattcttaccaaaaacaatactgcatttcaagaggatgaaactttttataaggtaaattataaaatattgcactgctttctatacttataaatattttgcatatgtcattatagcaaataacaatttttagaaataattaaagtctcaaagtgttcctttcttgaagtcagcagcagttacaatttgttgtaactagaaaaactgaataatattttattcattttaattattggaggtcatataagtctctggacttactgtattttatctaaaacatgtattttcattttggaaatggagaattatttctttattaatctaagcatgtctatgcttttagaatatgaggcaggctctgcaattttcttacaagacgctaaaggaatggaaagcaaaatcaacaaaaggaaaagagactgagaaaaaaattatacatattgtttataagtttggtgataacaagagttacttttaaagatgcttgcgcgtatacactatcttccaactgtttcagatgtaaatatattaaaacaagcattttaacctcagataaataaaaaagacacatagttaggcatcttcacaattataaactgctgcttattcttatccatgctcctaaaatgccttataatatctgctgtcactgccttggattataagcccaaaacagaattttctttttttaatagataatattataaaggtgattttctaagtgtacacggcctctttaggaagatagcagtaaggctcagatgtatgatttatagagcagagcttttaagccataaactcatcattgatgtcttacagccagatttaattaccttcctgaattttgattattttttccttgctttaaacagatcacacataaaagtatgcctacgtgatatatagtttttcttgtttttgaaatgtatacaaatagtctcctataaataaataaataaataaataaataaataatttattcattcctggacttgctttcttgactcagtcaagtcaaagctaaaatgaaagcaattattttagagacctatgtaaaatacatgcttatttagctgagatttgcttcaaaaactcgagtaaaacaaagagctccatgtaaaaatggtgacattcgtgtttaattttccttaattcatctcatatatgtatatatatatatgcacacacataatttcatacactgtgtaattttacaatctgtactgtcaccaaaatttacctattttatcttgtattctaccagagttctattacatggaaattgtgaagttcacagtaatataactactctaagttgttaatcacatataatacattaagcattgtgttgggtaattggcattcttttatctcttttaatttaatgaaaattgtattagttaggataggcaataatgtgttatggtaacaaatataaaacatcagaagcctaaaataagaaaaattatatattgttattcactctcaatgtccaaattgttctgctattatactcactcaaggatgtaggttgacagagctaataatgacacactcaaaagagggaagaaaaacatcataaatgatacactggatcttatatttatcattcagaggtgacctccacgagttcacttttaatcacaaatattatggtcatatatcacttgaaaaacaaaaacacagaagtataatcctgtcatgtgtctgcaaagaaaacgagaaatatttggtaacaggaataatgactaacctctctcaaaaaaaaattacaagacagccactatcatcatttgtgaagtaaagaaacagaagctcaaaaaagtaagtaacgttaataattgacatgaagtcattaatccagtaatactaaaaactgaatactaatccatttctaaaacctttattttttcctagtattaatattttaattggaacttaaaggtaaaacattagactaatcatcaacagtttatgatgcaccatcaccattagcaaataaatggcgcttttcttaatggtatttatttgtacagtgcaatgaatattaaaaatttgcttaaaccaagaattagagtattaccaactatattcatctgcatgtctctattctcccattcccctgtctctttaccctcagagataatcactttcccataggccagacaagagccaatcttgtaagcagatgtttctaagtgcagcagtctcaggtctcttttctgcatactgtaaaactaaattgtatttaatttgcatatatcacattttccttcctaatatgaatttataaatgtcatgaatgatgttgacaaaccatgaaacaatttcatataaatacattttctagaagccacatataatagcaaatgaagtggatttaagattttaggttaggtctctgaaatgtacaaacagaaagaaggggaaagagcagaattgaaagaagaacatgggcaggaggtcacgtcaccagcatagcattcccagtcagctttctagagctaatgactgatatgacagaagaggcaaacaatcccaaatctataaaatataacattgttaaattctttatttttataacttataaataagaacattaatttccaatataccattgccctattattttccagtactagaaaacacaacaaaattttcaaatgatttacacaacgtcatatcaaggcaaactatagccatattgagacatactcatgatgtaatataagtaaacaagatgtcagtaagttgtgattctcccaagtatataaaagcctttcaaacttttatggcatagcgtaccttctttccttttttgagctaaaattttctactctgtatcactatatctattcctctgtctgtcctactcctagtcaagactcaactaagaatcaatcttcaaaaaaaaaaaaaaaacaattcagggaggctagctgaagaatgatttagttacctattttgagctcccatcatcttcttggaacactattttgatagatatatgagttttcttgtcagtatccctcactatgctgtaaaatctataagagaggtgttagttttctatcactatggtaacaatcaccacagacttaaaataacactaatttgttaccttatagttctgtgagtcatcagtctcattagcctaaaatcgaggtgtggacaggactatatcccttctgtaggtcaaaaggaaaatccatttatttgtctgctccggcttctggagacagccctgttccttgactcatggttcttcttcaattttatcagttaataacagttaattgagtaccactcacaacacgcacttattccatagtcacatttccctcagactttgagcttatctgctttactctttcattttcaaggactctaattattgtattgagctttcctgtatattccaaaataatcttttcaggtcagctgactggtgaattttatcttcaataaattctcatttgctatgtaatgtaacatatttgcgagttccagaaattaggacatagaaataattggggagttattattctgtttatcccaaggggcataaaaattatccagtgtttttaatgagctcaataaatatggtatttatcaatctgaaacaatcaagtttcagaacatgtctgaatctatttggtactgtggacagcatgagcaatattaaatgttagaacatctgaaacagatgaagaccttttatgtggacaatactcagatctacttgactaattagtacagtctcttaaaataattcctttagattaattccttcagataacagatgaggaaattgtatcccagacagacaccgtgattttctctatgtccttcatggaaacagggagactccccctccaccctgtgtcacattttgtaactcgcacaacataaaagatctgcttgaaccctgatgactgatggtctcatgaaaaaaaagatctttattttcagctttttgtaactatgtattttagacatatacattatgagactggattggggtaccaatctcagagagaaagtatgtattttacctttacatttttttatttgattacaatctagtaaacaagttaaagaaagaaacccatggcctcccaaataattgacagacatttacaattaagattattctttcaaaattcaagttttgaatttgaggtaagaaatatcccttcagaaatctcccacatttttgctgtatctacagtatatctcattatactcagttaagtcattcagtaataactaaaatcctaaagtacttcgccaaaaatttaaccagataaaaacaattttaaaaagtagctaatgaatttaagatagtgcctggcttccattttttacacttgtcaactagcctatcttttattatttaatttttatttatttctcaaagaactaaagtagatctaccatttgatccagcaattccactactaggtatctactcaaagaaaaagaaatcattatataaaaaagacacatacacatgcgcatttatttgcaacacaattcacgactgcaaagatatggaatcaatctaagtgtccaccaaccaatgagcggataaagaaaacatggtatatagacaccacggaacaccgctcagctataaaaaataacgaaattatgtttttttttgcagcaacttggatggaactggaggccattattctaagtgaagtaagtcaggaatataaaactaaatacttcaagttctcacttgtaagtggaagctaaactatgggtacacaatgatatacagagtgatataataaacaatatcctaccttaacaagccactgtccctttaattttatctcctgtatcccgtaaaaaggacgtaaaattcacaggtgagtactattcttaatgtctccaaaattaatagctgtgcttgatgttttcttatagaattgaaattccaaatatatgcttataaataaacgataaatccaaatttgttacattgtacacatgttgccactttgaaagttaatattattttcaacttccaaagtttgtaataatattttaagagattcagacaaacatgacctcagaagaatctatgaggaggcatacatattctttagccctagatatataaaatcttatttggtcagagagttaagagttataaagtatttcttggagccgagtctaaatttcttcattttgttacattaaaaggcaaaaaaaaaggtctcagaagtttaagtttttgagagaaaactacattctaaaattcatgtttgaggattatttctccataatttgacttaaaatggttattttaataaattaaatacaagatactaatgccaaatgataaggcaatagaacagttacatatttgacatcactacaaagatattcaatacattgagttgtttataatagtgaataaagtagccaaaaactaataaataggagtattcctctgagagtctggtaacatatactgtaaaatccgcaaaatgtatatgggaacaccaccaaaagaaacatgattaatgttgatgattctgaggttttcaaatagattcgtgtgtatctgcagccacccaaccacacattaaccctgtcacctgaaactatcactatttaacaaaaaagactaatgaaacaatgtactttcctgatatatggcactgaataaaatatacctagtgattatagatagatttttaaaagctggtcatggtggtgcatgcctgtagtccagctgatctggaggctgaggaaggaagatcacttgagcccaggaggtcaaagctgtagtgcatcacggtcatacctgtgaatagcactgcactccagcctggcaacatagcaagaccctgtctctaaataaataaataaaaaccagttagaaaacaaaatgagaaaattgagaaaaataatttatagttaatgttgcttccatctgaatgtgtaatttgataataaagttattttgcatatttaaacataatttctttaacaggaaaacagaaataaaatcagaaaaaatgtaaaaattggaaattttctgccttcctgataatttttttttttttagaaaatcagggcaaaacatttaggaatacttactattattgcaaaaatttaatatcatgggttcaaagacacttgagatatataagtatgtacctttaatacttttctatttgttaaatatagcttagtaaaataaatgaactaataaaattcctaaatgttttactgaacaatgatttttttccttgatgtttagatgaaataatataatacctacaaaaagatactaagtgatgtcaccctgcgtagcttgaataaggacatttactgaaacatttttatgaaaaataaacatatttgattacataatttatataccttttccctccagatgtttccttttttccttccttattcttgaaattacttataaatgacaggaattttatatgagttctaaaatcagaataagaggaagagtggaagaattagaaaaagaaaaaaaaaatgccagttgtgcacttcttcacgatgcctttttaagagtcttagtgacatattaaaaagtacaaacaggccaggctcagtggctcaagcctgtaaccccagcactttgggaggctgaggtaggtggatcacttgaggtcaggagttggagaccagcctggctgacatggtgaaatctcatctctactaaaaatacaaaaattagccgagcatggtgatgtgtgcctgtaatcccagctactcaggaggctgaggcaggagaataacttgaacccaggaggcggaggttgtggtaagccgagatggtgccactgcactccagcctgggcgatagagccatttctgtctcaacaaaatgaatataataaaaattaaaatttttttaaaagtacaaacataatttagaaataaagttttgtgtgtgtgtacgtgtaaataaagcttttctaagaacatcatcataaaacaattgcatttgttttcatgaagaatccaagaaatgcacaaaataatcacttctataaatgcttatcttgaccacaatcaccacttattcagttatcttgatcacaatcaccacttattcaggaacagataagagatacaaatttttaagatctagatccagtagttattgaattaactactttctttctcaaagttttcctacaactaaactgatgatctcccttctaaatgtagcccctttaggatgtttatattagtgaatggccctattctaccttattacataccacttttcctccctttattccacttccactccccatttgcaataaatcatacacaggtacacatatgcaaacaccacacacacacacacacacacacactgctgtgtgtatctgtgtgcatgcacatttttctttatctatttttcaatctcttcacttgtctctagctccacttccacctgcttaaactactattatctctccgttggactatattgctaactgtttatttcacctctgatgttagttttcttcagtctttacacaaatccactctcttcactatagcgagtgatctgttttagaataaattgaatcatgatgttactatttctgcccccttcccctgcccccactggtcctgttccagctttaaaaactttaatggtttcacttagaatgaagactaaaattattatcattggctaacaaaccttggtctctacatacctcctcagtttcatcagcatttgatttacattggcctttattcatattgctatagtctgaatattttaactccccccacccataattcatatgttaaaatataaccccccaacgtgatggtataaggaggtgggctctttgggagataattaggtcatgagaccacagcccttatgagtgggattaatgccttataagaggccccgagagctgtctgtgccttctgtcatgtgagagcacagagaaaagaccactgtcaatgaatcaggaagtaggccatcaccaaacatcaaatttgctagcacctcgaacttagatttaccagcctccagaactatgaacaataattttttgttccttataagcagtttaaagtgttatgtttatagcaactgtctatatcaatttatagtgctatgttatagcaacctaaatggactaagacaagacacttgatctcacctcgcttacttctggtcatggaggcttatatattattccctccatttagaataaactccttgccccattatctttcatagtatctagcagatagtagagaccttaaaaaatacgttgaaagactaaataattaaatgaactgtcaccaaaagcaatgaatatatcagcatattatatgtgcattatcagctatgcaatgaattacagaaaattctgtttctcttactaaagacattatgactattccataccccaaatgatctattaggtcagtttagaggttacagtttattttacattgttttttataccttatatagttattgaaaatttattgaatataaataaaaggacaaaagttttacatttggtaataaatgcccaaaatataatttatataaaaagtatcagtctttattaaaatgactttgacccaagtttattctttataaacgtctgttgtaactctccaatgtaaagaaggcaaattggtgataaaattagttttgttttattttttgggacagaatctcgctctctgtcccaggctggagtgcaatggcacagtcttggcttcctgaaacctccgcctcctgggctcaagcgattctcctgcctcagcctcccgagtagctgggattacaggtgcctgccagcacgcccagctaatttttttgtacttttagtagagatggggtttcaccatgttggccaggctggtctcaaactcctgacctcaggtaatctgcccaccttggcctcccaaagtgctgggattacaggtgtgagccaccacacccagccataaagtttgatgaacctactctgacatatgttttttcatttattttagaagagtctcctcaaatgactttttatattaaacctgttcaaaacgatttctaaacctcaactctgaaaggatgctcaccaaatacttaaatgcacttcagaagtgaaagcaaagatatgttttcttcctacttgcatataatgaaagttaataatagaatcttattgataagtataatttgctaatacattcaaacacatgtgttgtcaaagttggtatacatatagtactgtgaaaggagagtctattttgatattttcccaggatagattatcattttgccttttgtacacacttttctgttgctctcatatgaccttaattgtttaaaaagtgttacttttttaaaaaatacatacttttgttctctgttagagcaatatgtatttggtatagattcagaaaaatatttgatatagattcagaaaaatattccatttgaaatctgggcttttaaatcacataaacatataatactagatgggtttcagttattttcttttttttttttttggcttagctctggttcattttttttaaaattttattttattattattatactttaagttttagggtacatgtgcacaatgtgcaggttagttacatatgtatacatgtgccatgctggtgtgctgcacccattaactcgtcacttagcattaggtatatctcctaatgctaaccctcccccctccccccaccccacaacagtccccagagtgtgatgttccccttcctgtgtccatgtgttctcattgttcaattcccacctatgagtgagaacatgtggtgtttggttttttgtccttgcgaaagtttactgggaatgatgatttccaatttcatccatgtccctacaaaggacatgaactcatcatttttttatggctgcatagtattccacggtgtatatgtgccacattttcttaatcctaacatacttttatatagtcaacaaatagatgaatttttaaaaattaatgccttagaagatgtaaagcatattcagtaagctttgaaaataactgaaacccaaatgtcctacaatcatagactgggttccagttattttcaaagcttactgaatatgcttttcatcttctaaggcattaatttttaaaaattcatctatttgttgactgtataaaagtatgttaggaatctttaacttgcaacatgtcatattacaatatattcactcaaggtcaacaaagagtatttattcttagttgactccttctggtattaagaacatggttgaacattttctgttttcaaagtactttatcttaagcttccagttacttgtcttagcaattccatcattggccagtcattcattctattgaacgtctctaatgacgggataaggctagaaaaaaagattcagaataacagtttctttgcaaagatttttcataatgtatcttttaacattgtattatggtttcaatatttgcatctcactccaaaatttatgttgaaacttaaacatcaatgcaacaacattaagaggttgggcccttaggaggtgattatgtcatgagggctgtgcactctgtaccttatagaagggctgaagggaactaactaggcccttttgcccttctgctatgtgagaacacagcattcgtcttctccaaaggatgcggcaacaggcaccatctttgaaacagaggccaggtcctcaccagacaatgaacttaccagtgccttgatctttgacttccagcctccagaacagtgagaaatacattatgttatctataaattacccagtttctgtttttgttgtggcaggatgactagggcatgtaaatattggtattatactcagaaaactcttagatacaaaattttcagtaaatgaaagatgcatttcttgctattttaaaatttgtaggttggcatgtctgtgtatttttcctttatacctaggaatgaagcagttgatatgcaaaaattattgggatttttggaatttaaattagctagccggtggtagagagatgacaagagtttagcaactgctgagagagacagagagagagagagaaatggtaaatagaaaagtgagaatagaagagacttgaatgaaacctattacaagaaaatgaagaatggagatagaataacacccacacacgaatgaaaaatagtaaaagcatttataagaaggaatttaagaaaatagacaaaaagttgtaggagatagagaaaattaaaaaaaataaaagtacagataccaagtggttgctgagttcctattatttgccagatactttaataaaatgcaacagagaaaatcaaagacaagatggacagaaatttgtaagaagaattgtagcacacagaatgaagtatgtagaaagtattatgagtgttctaagaaagaagtggccaatatattgtgcaggtttgtgtatgtttgcatgtgtgtgtaaatgtttttagacaaagaaaacattaaggaatattgattaatgatgaagaaacattaaatatgctttaaattgaaaatattattataacatactaacatatatttatcatttcttatatgccagaaatatactacacaattttcttgcataacattagttaatcctaacagtaatctaatgagaaagttactattattcttgattatggatagagatcagagccttagagaccactcatcaaaaatcatacattaatattttcaggatttgaaaatgttttatctgatttctaagctcatgctcttaactactatgccttaaatatttattttatattcacacactacatgttttatcgcatgttaatcctctgtttctcttttctttgtttatatgaaactataagatttgaatcatagttcctcaaaactatttcattcttaaaatctttttgtaatctattgcaggtgacacagactattactacactcccactttcgcagtataaataacattctttcaactgcagcctggactcagtgtaaaacactgtattcagaatacaaaactcacgtaaatgaaaggctgactttcacagaaccaactgcaggacttgagtatatatggattttggtacctatggtaggtcctggaaccaagccccaaggatattgagggacaactgtatttttatccccagaacttagcacaaaactgtcatatggtaaatttaatgaatatattttggagaaatagacatataataatattttatcacaacttccatcattttcctaaagttccagggggcggggcccacatcattgtacttttgtgattcctacaccacttattactaaggtattaaaatacaatgattaagagtgtggcagcatgatagggattgtattggatcagtagggcagtattaacaatattgagtcttccagtctgtgaacataggatgtctttccacttgttttcattaatttctttcagaaattatttttaatttttaatgcactaatcatcagaggaatgctgatacaaatgcaaaaatgatatatcacctcatgcttactaggatgaccattataaaaaacaaagcaaaaacaaaagacaagtgttggcaaggatgtggagaaactggaactcctatacatgatgggaatacaatatggtgcagctgctatggaaaactgaaaaacaagttctttaataaactgaaaatagaactacaatatgatccatgaatcctacttctaggtattcatccaaaataactgaaatcaggatcttaaagaaatattagcactaccatgttactgcagcactattcacaacaaccaaggtgcggagacaacctaacttttcattgacagatgaatacataaagagaatgcagtatatacatacagtggaatagtattcagtcttaaagggcggaaagaaaatcctgcaatatttgacaacatggataaactttgaagacattatgctaaggaaaataagccagtcacagagaacaaatactgcatactgcatgataccaatcctacaaagtatctaaagtagtgaaactcacagaagcaaagaatagactggtgccaggggaaagaatagaatggtgccaggggttggagagtgggagaagtgagaatatgctaaacaacatgtgtagatatttagttatgaaagataaaaattctagaaacctgatgaataacattatggtataaagataacaaatacagtattgttaaaaactttaaaatatttttaaaaggtagaacctctacttgactcttcttgcaaaaataaaaaaaggatttggcagcatgagccaggtgcctgagccatctttatggctgttagatgtaggatttgtgtgaaattaagcaagatagcttgaaattttaaccttctgtttccacatctgaaaaacaggaataataataaaattcagcttgtgaaatttttgtaatgattaaatagattaaataagatagtatatacttgattgaccattgatttcttcttcctttgccagaaatctggctcaccccagaaaatgctatttttctgtagccctctcactagtggtgaatgtttttatcatattcttccacaactaggacctgagttgggataggtcctgtttcttactccttcttccctattaccactgccctcttgcttaaaaacaaacaaaacaaataaaaaacacttggtatcatatcatcaaactgcctatatttcctcttcctccattctctcttgagccctctccaaactcagtttccttttcaaggttaggaaagtttggaaagagtttcaattattctttaaatttccaatattttaattcaaactggtatttttgtcaaactatatttattacatattaattccaaggggttcctctgataatctaaagtaaaatgtattctaagaaagagaaaattagaaggaatgttgtccagtgaactattgacactgcacccaacccagtacatgaaatgtgtattcatcactgacaacttgtggaattcattaaacaggacagcagcagtgcctttctccagtcagtgtaaatgtagtttttgagaggaggacaccaaaaatgtgacatttgaagacagccatgatttgattatgtgttttcttgttgctttggattgttatctgtctctatccaacataaaacaaaatccgcaaagatgagattttcatctgttttgttgtctgctatatacacaacaggtagaacagggttgggcacctagtagccccttaaaaataaagctatgcaattttgtataaagctatgtaattttgtgtaacttaaatgtaataatacattattaagtgtgttatctataaaatacaatgtgtgtggatgaaggtatatggtataaatacagagaagagtatttctaaggtgtttggcacttacaaataccacaaacgctagttgttattagaaacctgatgttagcataacaggtattacataatgcttgctatacttgaatgaatgaatgaaaatactcagcataaagcattattaatatttgtttataatgatatatatttttttcctggggagatatcatcagaattgcattccatgaatccagcagatcatgtgtggacaaatctttgatacaaccacataaaatattgatgactgtgttaacaatgttcttttaaaacattatctaagtctaagccttaacagatctcatcagtattccaattgttcaatgaagaaacatattaaatgcaaactagctgaacagtcttcactgagcatttagcggggcagcccttaggggcagtataggatcttacaagagtagggaacattaacagcatgaactgggccactgatgtcaggaacagccactgcattatgatccactagcgttataaacaaatactcagaaaggcagctaataatccgacatgagcaaagaagagaggaaatacctgaagaaagcatgaattcatagtttgagttttctacaaatacttttctaaataatacacaatcatgggataaatactaatttgatctgtaataaattacatatatgaaatataacaaaaatactcaacataaagcgtaaagaattattaatatttgcttataatgctctaatttttcctggggagatatcatcagaattgcattccgtgaatccagaagaccatgtgtggacaaatcttgcatacaaccacataaaatattgatgactgtattaacaatgttctttttaaacattatctatgcctaagctgaagagctctcatcagtattccaatttttcaatgaagaacaatatatatgtaatctataattacacatatatgagagattcagttagtgataacccatgatgtgataaattacacatatacatgtgtgtgtatgtgtgtgtgtgagtaaatttttagagattcacttagtattttgtctacacatataatttacctagatttcttgttttcctaacaggatgcaaaaaaggtacactgtggggtgggtaatatctccttactaaatatttattgactgattttgtccccacgtcattgaccagtgtcatataaatcaaactctcattacctatttttgaattgttgtttgaactccagctactatcctcaaagctcaccaacttgcccttctagctgacgcattttatgtctcaatctactttttattcaatgcttatttatttcattaatcacaaattgggtcattctgccaagtcctgaggaaaatataagtaactgagactgtctctgttcaggattttataatctaaccatgaaaacaagcattacatgacatattataaagggaaagatggacattaattttgattgggtgtcatcagtactaacattggagaacaataaataaattagtatcagtaataagtagaattttagtaaaatctagaacaataaacttttgttaaaattttacattataaaatcacaggacagcatgtggctatcgcatttcaagctgagataacagatttgctctcagatttcccacataatagttgaaccacaatgagaaagcaacttgagttccctgtttctttatagttccctgatctctaaactaggcataataatagtaaaatactaataattattgttataatcacaaggaccctatggagtacttgtgaacattaaagaatataatctatataaatggcttaattaataaattctaaataaatgttggtggttactattagtgactgatgcttacacataaaatgactattgatatgattcataatttcaagagacttcttgagtggtgtattagtctgttctcacactgctaataaagacatacctgagactaggtaaaatatgaggaaagaagtttaatggacttacggttccacatggctggggaggcctcacaatcgtggtggaagagcaagtgacatcttccatggcagcagacaagggagagaatgactaccaagcaaaaggggtttccccttacaaaaccatcagatctcatgagacttattaactactgtgagaacagtactggggaaacagccaccatgattcaattatttcccaccagttccctcctagagcacatgggaattatgggagctaaaattcaagatgatatttgggtgaggacacagccaaaccatatcaagtaggtaggaattatgtgtatgaaataagtaggaacattacttaatgttatatgagaaggcactaaatacaatcagtggcaaaaaagtgaaccctacaagcaatcaatcaagaataacttctaggaaggagggagaaagagagagagaatgagtattgttgtaaactggagttccacaaaggaaattgagcttataaatgagccctggatagatggattacgagaaagaaaagggcaaagagagaggatacagtaagaaaagcaaaaagactttaaaacaatatagacagaaggaaataaaatttaacattccaataatggaaaagaatacaatgtgagtaaacaattggtgtatgttgagaaattctgggaaataatatgagtaggcaaagcaagaatatatcacaaagggccaagaaagcttagatgtggacacaatccagtagatagtggaagaaatgttaggagatacttgagaaaagtactgttttaggaaatagagattagcggttcactgttttattaaaaatagctgaaagacagaagctgagtcacttcaacttctgcagtaagcaaagccatagtatgcaaactggcctttaaatccatgggggaatgtattatctcactttcatggtgcacatctatcatgggtaggtgaaagcaagggaaggagagatccactccacctagtcactcaaagataagggctgactgaggcattaccttttacagctgaaccatctgtgatacatatcttcttaagttgttctggcagaagagcgagaaaatgaagaatttcacatagatttttgttgcatcagcccaacaataatacgtcatacttacttatatttcactgcccagagatagttatacagttctgcctaataggtgaatatttaaacaactcatcagaacaaactgaatatttgcaaaatataactgtttcctacaaatgcaatgtgacaaaggtgtaaaattatttatttatttcacaaatgcacatggaacaccaaatgtgaactaagatttcaatgacaaaaaaaaaaaaccacacctaccttcccagttcttatatgcaaggaatttaatgtctaattccaattttcattgaataatctagactaagctgtcctaggaaaagggagtaaatgtagatagaaaatgacatattcccttgtactgccccatttatctcatcagtcattctgctttaaaggaattatctggtcacattttatcttctattcacatctgctactttcaggacctttctttccctcctctttctttgagattttcagttgctgctctgccttgtcttctgtgtccattcttagctccaatcctgagactcagctggagtctcagaggcttgcatctgagcactctgcattgctcagtgactaaggcaactgaattagggcagggacacctggaatagctcagtcctccacagcaggtggggtctgataaaagccatatgcctaagaccctgcagtatcaaagaactaagactcgcaggcattcctaactggaatctatctctatttcagtgttatgggctagattgtgttccccaaaattcatatattcaacctctatcccctagtaactcagaatgtaactatatttggatatagggcttttgaagagataattaagttaaaatgaggctcttaaggtgaaacctgtaagaagatactaggacacaaggagagacatcacgggtgtgcctgtacagaagggcaacaatgtgaagaggcagcaagagggtagatatctgaaagccaaggagagaggactgaggcaaccagctcaactagtaccttgatcttggataattccagtctccagaagtgcttaaatttctgttgtttaagccacctagtctgtggtatttaattacggcattcctagtaaaaggacaacttttatctctgtttccaataaacatttcaatcccatggtaggaaaatgacaatctgcctaatctctgccacctcctaacaaaaatcttgttttattaagaatacaaacaaaacatattttatataattttcttataattttattaatgtctgatgtaccagaaaatgacacataggtattgtatgctttgccttatttgaactcatgataaccctatgagagaggtagtaccattttcctcattttataaacaagaacagatgacttagatcaagtaacttgactctgataacatataggttaagtaggagagctcattcatctaacacggttacctttcatgacaatgatgatgaaaacagctaacagagtatccacgtgaccattattcatctaaaccccttacattaaataattggacattcataatattcctataatgtaagtattcctactagccgtgtgttatagacaaggaaatttaagcaaagagatattgagtaatttactatagccacagagctacagagttttggagccaggattcagatctaggcagtccaaactgaaggtgtgtatttttaaccaccacattctactgcttctcaaagtttggagtaggtatattagcatctggtaatggctgttgaggatattttaaaacttaggtaatgacttctgctattgtatacttttagaaaactggattgggatcaaaactgtccagtacatgctattttgttacctttggattcttttaatacctaaccttgtgcgattggggtcatagcacagcatgtatgatcatcattgctgcaaacggatacacatcttaaaagtgccaactcagtgttattcaaatttttcctgaaatttccatatgcttctcaagttccttaacttgaaaactcaaaattcttcctgcaaacattttctgattatctctactccaaaatgttttaacagttagtcaattagttaattaaaattttaattggcaaataattgtgcacattacatattttggggtacaatgtgatgttctgatatacatttactttgtgattaaatatgctaatgcacaaatttatcacctcataaacttgtcattttatggtgaaaacattcagaatctattcttttagtaatgttgaaacacacaatgcaatattatttattattgtcaccattgtgtgcaatagatcactgaagcttattcctcctctaactgaaatgttataacttttgatcaacatctcctctttcccatttcattgctcactccacccaccagcttctggtaaccaccaaccacatccagtggacagcaagttaaataataggaagttagagaaagctgacagttacaaaggatatgatgttatttaattgttcagaatatacaaaatgtgtttattataggatacagccccttatggaaaaataaatgagagtggggaaatttcaaaatcagacaaaagtaaaaagtactatgttcaccagaagatggagaagtctgataggaagacactcagaaaaggtcagtaaaaaacctctgagaaaaagaaagttgcaggaaaggtaaatcaataatgctgtttgctgaaatgctacaaaattatagtacttgtctaaggaagtagttactggaagccatagagagtgcactttcagtatagttacaagaaaaaccaaattgcagagcttaagggaattggtgaagaactggtagcaacagatacaaagatttgacagaacatctaactaaagaaaaactctattatgaattgtataagtcattgatgactcagagccaagcaagtttataattacatttttgctcaacttcgatttctatgaagaacatttaaaatgagttctgctttttcatacaattagaatgtgggcatttttcaatcgttctaaaattttcagattattagaaccacaaagacaagcatccaccttaccggatattattgattttatatgcattgcctggactctgaattagaccttttctttcttttccctgtctcagcaggacaaataagaacatctaggccaggagcggtggctcacgcctgaaatcccagtactttgggaggctgaggcgggcggatcacgaggtcaggagatcgagaccatcctagttaacacggtgaaaccccatctctactaaaaatacaaaaaattagccgggcgcggtggcgggagcctgtggtcctagctactcgggagcccgaggcaggagaatggcgtgaaccagggaggcggagcttgcagtgagccgagatcgcgccactgcactccagcctgggcacagagcgagactccgtcaaaaaaaaggaagggaggaagggaggaagggaaagaaagaaagaaagaaagagagagagagagagagagagagagagagagagagagagagagagacagagagagagacagagaaagagagaaagagagaaagaaagaaagaacatctgagcaccaatactgggatattgtaagttacctcagaaataacatccttgggtaaggggtgtgtgtgtggtggggtgtgtgtgtgtgtgtgtgtgtgtgtgtgtgtgtgtgtgtgtgttttagcagaaagagaatcttctaagtacaatgaaatgggcttctatttatcagtaccttttttcttctctctcttttagttctgttgctttccaggatatacacatggctttaacagagtctattactggaatacggagaagctattgaagtaatccttcaaggcataaggtcagaacttagagaagtcacagagtttgtatttctgaacctgattaccagaaaattcttctaaagcaggaaaagatatatgctttcaaactgttatcctacaaccaaatccattttggagacacaaggatccacaagattactcaccttcaggaaaacatgaagacaagaaatgctagtcttggtacaacctaatgaaaagacatagctgagatttcatatgaagataacattgagattgcttagaaaaaaattattggagttaacattgaaagtaacaatggtatttcttgtcatccctttctaaatggcatatatggtatgtaatctagaaatatgtacatatacatgtaatagcttacaaagcttccaataaaaaagacaaaatctctggattttgccatctaacgaaaacaatgtagttactattaaaacttgaatttaacttctcagaataaacatacagtcaaggtttttgtttatttctttgtttttccaacatggttgactgacttgggatgctagttctcggaaagatcaaagttacaggtgaatggtaatgatctgaatgaaacacagtcagatgagagccaggacctgtcagagaacccacaagaagaagctagggtacagaaaaagaaagcaggaagagtctggcagagattgacccccaaggaacttagagaccccaaaaaagtataggtgggggtgcttctctgttcccctcaccctggcaacaacctgctaaccatcgaattattagagagtccttctaccctcacaatcctgggcaatgatgtccgtggcaatttggaaaattcccaaagacagaaatccatgttgttaactcacacaggggtgcccacactcttctcaggcctgaactgagatgtcaagtgccgtactagttgtgtacacatagtgggccactgctgtgcctgtagaacctcagtcattgagtcaccacatcacaagatcccctgcaaacataccccataacctgctctgacatccacaatcaaagggaaacagagaggatccctgaggaactgtggatccctggtaatctagccctcagtgtgacctacccctggggaatgggggtgcacagacagccctccaaagcctgccttgagagaaaggaaatgtagtgtgacacagatcactgaagggagtggcaccggcagccgggaatggatatggagaggtagtcatcttctgctcctcccatctactcttgcagacacagcagaggctctaccagttaaaggccagcccttgtgaaattggtgtaaacttttccagtggttttcacaacagctacacctccattcaaagtaagcccctgccacagaggcttccatgaagagtaagacccatctctccccttctatacaaagaaatagcatcccagcaactgaaggcagacaagctacaaagttgtctgtcatgaacttggggaagaggatttgccctgagcccattttgttggtagctgccggaggggcatacccatggtctccagctgcactatggccaggagtcaaaggacaatgtatatttaaactgaaggtcatgagcaaaatgcaacagcggcatgatagggaagcagatcacattcctgtctgcccaggatgaggacctggtataggcctccaacgctcttccattgaaacattgccacagcccaacaggatctccaccagctacacctgtcagggtgggtgcctccagtcattactgagctaccagagaatgagcaggctcttatgcttaagtgccatcactggactggagagtaaaatagaatacctgttctcagaaaggcacagggctagtgaataagataagcttcctgagacctctgtactctcagcctcgcaggagatagtgtcagctgacacatctaacacatcaaaacaacaggcaacattcaagaaaaccaccatacaaagattacccacaatcaaggaacccataaagaactttggcacactgaaagcaccccaaaacaaagcatatcatacacatcataacataaatcacagtaatcctctaaaggaaaaataaatgatagaaaattcaaaaataagaagtgatatctcctttagatgagaaagaatcaatgcatgaactctagcagtacaaaaaggtagtagagtgttttgacatctctaaaggattgtacttgcactctaaccatagattctaaccaaaatgaaaatcctgaaatgacagataaagaattcaaaatacagagtgcaaggaatttcaatcagaaaaatgatgaaggatataaaaggcaaaatagctatattagaaaatagaacttcatgtattgaaaaagtaactaaaggaatttcaaaacatagttgaaagctttaacaatacactagaccattcagaagcctggtttttttgaattaaccctgtcacacaaatataaagaaaaaataatttttaaaaatgaacaaatccttcaagaaatattggataatggaaagcaaccaaacctatacttagaggaattcttgaggaaggagagaaagaaagaaacatgaaaaatataattgaggaaataattgaggaaaattttcctcatcttgtcagagaggaggacatccagatacaaacaatttagagaatatctgtaagatattatacaaatgaacattactaagtcataaatttatcagactatccaaggtcaatactaaagaaaaaaatcttaaacagtaagtatcaaactatctataaaatgtagtcccattagactaacagtggacttctcagcagcaaccttacaagccagaaggaattagaggtctattttgagccttcttaaagaaaataattttataataaatggcatccaaaatttttataacctactaaacttaatttcataaacaaagtagaaaaaaagtcattcccagacaagcaagtggtaagggaaattttcacccatagactggtccttcaaaaaatccttaaaggacttctaaacatgcaaatgaaaggacaatacttgctaccagaaaagcatatataagtacaaagttcacagatcccataaagcaattacacaattgaatatacaaagtatctagctaacaacaatatgacaggaataaaacctcacatgtcaatattaatcttgaatgaaaatggcctaaatgctccacataaaagatatcattttgcaaattggatgaaaaagcaagaccctaccatttgctgccttcaagggactgacctactgtgtaatgatatccacagccccaaagtaaagggtggagaatgatgtactacacaaatagaaaacaacaaagatcaggggtgctattcttgtatcagatgaaacagatattaaatcaagaaaggtaaaaaaaaagacaaagaaagatacaattcaacaagatttaactgtcctaaatatatgcacccaacaccatagcacccagattaataaaaacaactagacctaagaaaagaaacaagtcatacaataacagctgaagtatttaacaactattagttatataatctgtctggtgacagcaccagatagattatcaaggcaaaagaaaaccaacaaagtaactccagacttaaatggaactcttgatcaaatggatgtaatagacatctacagaacataccatgcaacaaccacagagtatacatttttcacatctgtgcatggaacgttctctaaaattaaccaaatacttggacttaaggcaagtctcaataatttcaaaaaaatcaaaattatgccagttatcttctcagatgacagaggaaataacattagaaatatatatcagccgggtgcagtggctcatgctggtaatcctagcagtttgggaggctgaggtgggtggatcatttgaggtcaggagttcaagacccacaaggccaacatggtaaaaccccatctctattaaaaatacaaaaattagctgggtgttagtggggcatgcctgtaatcccagctactcaggaaactgaggcaggaaaatcgcttgaatctgggaggcagaggttgcagtgagctgagatagcaccactacacttcagtctgggtgacagagtaagaccctgtctcaaaaaaaaaaaaaaatacatatcaggagaaactctcaaaaccacacaagtacatggaatctgaacaacttgctactgaatgattttaggctaaacaagaaaattaaggcagacataagaaaaagttgaaataaataaaaatagaaatataactcaccaaaactctgggatacaatgaaagcagtgttaagaggaaagtttaaagcactaaatgcctacataaaaagataaaaatatcttaaattaataatccaatatcatacatcaaggaactaggaacataagaacaaaccaaatgtaaagctagaagaagaaataacaaaaatcagagcagaactaaatggagttgagactgtaaaaaccaaacaagagattaacaaagcaaaagttgtgtctttgaaaggataaataaaattgataagactgctatttaagttaattaaggaacaaaaagagaagattctaatacgcacaatcagaaataataaaaatgtggcattacaaccgataccacagaaatacaaaatatattcagagtagtctatgtaaattctcagagagtaatcatggtagactatgaatatctctgtgatcaaaaacgagaaaacctagaagaaatgaataaatccctggaaacatataaccagccaagattgaaccaggaggaaattgaaatcctgaagagacatataatgagttatgaaattgaattagtaataaaaaatccattttccaaaaaaagccaggaccaaacagattaacagccaaactttaccagacatagaaagagctagtacccatcttgtataaactaataaaaatattaaggaggaatgactcctctctaactcattctatgaaaccagtatcatcctgataccaaaacctagcactgaacacatacacacaaagaaaactacaggccaatatccctgatgaatagacacaaaaatctgcaacaaaatgctagtgaaccaaatccagcagttcatcagaaagataatttgtcacagtcaagtggattttattccagggatgcacaaatagttaaacatatgcaaatcaataaatgtgattcaccacagaaacaattttaaaaacagtagccatatgatcatctcaatacctgcagaaaaaacattcaataatatccaatatgtctgtatgataaaaaccctcaacaaactaggcattgaaaaaaacatactgcaaaataataagagccgtctatgacaaacccacaactaatatcatactgaatgggaactgtaacaagacaaggatggccactctcagcaatcaggcaaggaaaataaataaatgtcttccatattgaaaaagaggaagtcaaattatctctgtttgctaatgacaatcttacacctagacaaccttgatatttcctccaaaagattcttttacctgataaactacttcagtaagatttcaggatacaaaataaatgcttgaaaatcagtttcatttacatagatcgacaacactcaaactgagaaccaaataaaaatctcaatttcatttataatagacacaaaaaataaaatatctagaaatatatttaacaaaggagaccaatgaggtaaaagatgtccacaacaagaactataaaacactgctgaaagaaatactacatgacagaagcaagtggaaaaatatcccatgatcattgtttggaagaatcaacatcattaaaatgactgtactgcccaaagcgagctacatagtcaatataatttctatcatagtaccaaatttattactcataaaattataaaaaaaaattctaaaatacatatggaaccaaaaaaagagccttaatagccaaagcaatcctaagaagaaagatgaagttgggggcatcacattatctgactttatactataaggctataataaaaaacaaacaaaactcagcatggcattggcataaagatggacacatagatctatggacacaatagggaaactagaaaataaaatcacatgtgtataaccacggttcttcaacaaagctgacaaaattaaacattggggaaaggtcaccctattcaataaatggtgctaggaaaacttgcttgctaaatgcagaagaaagaaacttcactcctatctctcaccatatgcaaaaattaactcgatgaattgaaaatttaaatttaagacctaaaactatagagatcatagaataaaacctaggaaaacctctttagacattggcctaggcaaataatttataaataatacctcaaaagcaaatgcaacataaacaaaagtagacaaatgggacttaattaagccaaagagtttctgcacagcaaaagaaacaattattagaataaacagacaacctatagtatgggagaaaatatttgcaagtaatatatctgacaaaagatttatgtccgaaatctataagaaaaacaaatcaacaagaacaaaacatataactccattaataagtgaggaaagaatgtaaacagacacttcccaaaagaagaaatggaagtgaccaacaaacatatgaaaaaacattcaacctcactaatcattagagaaatgcaagttacaacaaaaatgagacaccatttcatcccagtccatttgtactttttattatcatatatatcctcaaattcaaaacaaaataaaccacaacataaactgtgttagtatagtacattaaagtcagctccactgtgctgtatcacttggcaagtctgaaattccaatgggcttcagaaagttgactatgcaatgcccaataatgacctgataatctcatattagaggcaatgcaaatatatttataagactaagagctacaacaagcttacgaagaaaaccaatttatagcattacaggttaaaccagaagtgatttcctctgttaactaaaattacattactaaaaagtgcatggttcgtggatgtctaatgtgaaaaaagacagacagtgaatactttcctgctcagtgtgaacacttaataagaatgaaaatagaatgccttattatataaagtaataccaatacattgatttccaatctactcctctggcacaatttaaaatgagctcttgaactatagagtcacaactctttttcatttcaatgtgttttccttcaaaatagcagttatttatacatactgcttttaaaaatcatttttaggctgcagattcacaatctccataaatatcaaagatgtgaagttaagttcagatgcacttgaagtaaacaccatgctaactagcagcagtgttcaagagatcatgctgccgatcttatgaaagggaatatactattgtgaattattttgcaaatcccaaaagaagtttatctctcacattattgaagactgagaatgtcttaatatatgcacaacttgaacattgtttgtgaaaaagccagactaattcatctatcttctgatcaatcagtttagccaagcaaagcacaaaataaatgcacatcctttgctgccgttaagagcaaccagtttgcttgtctgtgcatcatgaatgccaaacaaatcttgaataagaacgaggaaaagttaaaagaaaagaaagacaggaaagaaataaaactcaattttcttgaataggaaatttctagggaggaaacattttccatttttgtcttctatcaaatttatatatatataaatatatatataacatattatatatatcctaactgtcattataggctattctaagacagattctgccaatattgaaatatctaagacaggcacaattgggccattgcaaacatcatgtactaaatggattctaaggaacctgaaaattaatgaatctttctaaaatgactgacttactgttaggggaaagcttaagaaatcaaataccaaatcaaataccaaaataccaaatcttttttcatttttctattcttcccaaaaaaaaaaaatagtgggggataaaataacgcaatgcccagttaaagtgccaacaccaaaacaacttatggctgctacttctgaccctttcagggggtcaaattttgttgtcttttgtatttctagctttgtttgagacctttgtttgcatatattcaaaggttagtaaatacaatttaatattgtttccacagaaattaagcatttacctagttagaataagcattcaaacagaggtcttgcattaaattttgtactaaactgtattccttctaccatgctgcaatctttattaagaaacaaaggacatctgatttcacttttctaagcttattttagttaaggttaattattacacagagatactaacctttcaatcataaactacaaattagcattattcatctctgtggtatattttcaatgtaataataaaaatcctggctcgctctaaaggtcaagctaaaagcaaccttaccatcatcatactggcccaagcagatttcaaagagagagcccaggatgatccctgaagctaaacatgtccagagataaaactgtcgaaacatcttctgtcaaagttcactcaaagctgatctgaaataagaaaaggtagaaagaaacatttgacatgttcattaatctgttataggtaaacacaattgtcacagcacagaaaagccttaatgacttcatagttaattacctgtgccacattatccattaacaaagtaacacactggtttaatgcactggaactgtttatcaacataaatttgcagacaagtaatctctaaggaaagacatcttttctgttatttaatttgccagcaagtaggttgagaagttaacatactaataatatcagaagcacactctttaaaatttaagacattatgggtaagtccaatgttaatcagtttaagttactaaacttatgttgtctacagcataattttacaacaaagtgtaagatagtaagccagttgttagtatcctacatgagcatttcaatgaaaatttgtcttatacaattaagtagaaaagcccatcattaaaatgttaattcctttctagtagagtgatcagagattgacttaactatgccaggaaagactaaggaaaatctgtcaattttcactacatctgctttatgaagcatttggatgcatttcattttaattctcttgttttacttttcaatccccagcaagttaaaaaaaaaaaaaaaagaaagaaaacaactgattgagaaattagtggcctgtgagcacatgagaatgtcttattgaaagaatgacatcctcagtttctttgtaaatttaggaaattatccacacagaattgttcaaaatgctcttgattataaattgtggcagactagggattggaacactgtttctctaattcagaggttccaaactcaaatgcctacagaggacaagcagacaaaggaaaagaatgaattagccaaaggggacaatagtgatggtagaggctgtgataaactgtgcaatgcaaggttttctaaagagaccagctggtgctcaacttctgtcagtggttgtgatgtggcaatgcaagccagtgtttctgggtcttctgattttcaaagagaaggcagaaatccaaattttcatgtgatttccaagtgtttacatgattgtgcaatcttctttataagactaaatgcttctagcaggtaatattgatgtctcaagttctccagttttctatttctgcccaggattctctctactagactagctgaggataaggtttatcagagggtacaaaggcacgattttaattctgcttttgtctacattttatttttgatttattgccaagtatttaataatgtttatttgtccagcagcatgtataaatatatatattgcattgtaaaattgtattaaaggtgtaagctctttttttaaactaatgggatacacagttcttgactttaaaagatcactgctctagatcacacacattttaatatgaagtctattcttctttgtttctttatctaagatataaaaggagctgccttctttttaactgggccttccacattttttcctaactggcaaagtgcttggcgcgtgcatttataatttctagggacagaaagcccaaagaagagctcattattagatgccaagagatcatcacaatccacactaacctgtagaaaaaagaaaaataaaattgaccaatgctactggttgtgtagagcagcggataagaatgtggctttttttttaaattcaagcttttcagcttactagttatatgactttgaagaaattaaatagcatctttgtctcacatttctcattatcataatggatataaaatagtatttacctcataagattgtcttaaacattaaatacgtaagggaatataaatacgtgcttaatgcagtgtacttacagaatgagtaccccctaaagcttaatatgagtaccccctaaagcttaatataaaagactcagcatctatggaacctccaaagtcttaaatacagatttactcaatctatctttagcaagggctggaaagtagatattattatccccattttgtggaggaaaggtcaggctcagagagaataagtgactggctcaaggttataaactggtgagtgtctgaagagaccataaagtctgtgagtaagacacttctgctcattccattagagaaaagtattggaaaaattcccagaaaacacagggctcagaagttttcaaggcatatggaggcccaggagagcctgctgtattgcttcccttaaactctgagagagacattctaacccccttcacaaaggattagagctctactaagatttctatatacaatggcttcaaatctttttttatttggaaaaacaaacatgacattaagaaataaaacaatgttatttaaattttaaaaatataaagagaaaccatatacaaatacaaaccagaaaggatatatattggaaaacaaaattaatacaaaccagaaaagatatgtattagaaaacaaaattaaagagacggtaatatcttagcaaaggacaaaaggacatagttgtgttcctgtgtgggtccttgatctgccagcttgacttcctttatagtagtttatagtattatgcattcacaaattatggcatattcttttattcctaactgaagctaatttggtttcatggaacagtctccaatataaaaacaacatgatggatcattattttaaaatcattaatgtcactgccattattatgcctccagaaacaaaacctcttgatctatggctctgcaagtttttagaggattatatgcatatttctgaaagcatcacagacaaaactcataaaaaatctatttagaatagatatagcatttactgcccagaggaaggagataattttaggggaaatattatacttatttgtctttgaataatgataataataacaatttctatagtttttttactctttcatctatatctgcctgatttccaaagaaattttcatcacttcaatgggctcaatatttacagagacctgaaagaaagctatgactcatcacatcaacccgataccccaaaacacagaacacatattgacttagtgagaaaacccagtttctaaacaaagatataatgaaaaggtacctcccacaaagagattgtgtaaatgactacaggaccaagatgtttagtacaatattgtgccaatcaactgacagcctatagtggcacttctgtgattgtgatcaaattaattggaagagatcaaatgctttagacaaaagactgtttttgttactagctttttaatctctagaattaaaagagaaagtcctataggagatgaattccataatcttgctaagtgactgtaggtaaatgaaaagcctgtcaaacaacacctctatggtggtactttacttttactacaaatcccacatcaaactctttccatgttccccgagtatatatttttcctacagaatttattggctaataatgttatgttctaaaaatccaaagcatgttcaattctaaaaagaattgtaggtgacctataaataaatatgttatacttgttttttaagagataattaaattggtgtattcagtactctaatatagctaataaagttatcattttgcaatcgtgacttagaaatagtattctgttgtcaaaatactggggaaaagtgtttttttcctattacagtataatattacacgtaagtggtttgcattccatgtgcattttatgacacaatttccttaggcttaagaatattttactgcaattattcaagacaaacatactaattttgaatttcacatcatttgtatttcctgcaagataaatctcatatttatttatctggcattcaatgttctcaaaaattaatttattcaacaagtacttatggagggtctactagataccactcactcttctaggcagttggaaaatatcagtgaacaaagctgacacatttcttttctcccatggatgttatattccagcaaaataaagatagaccaataacaaacataaataagttatataaaatgttaaaatgtaataagtgacatgaaaatagcagctagcatttcaaaactgtatattgtcactttacaataattttcattcagtaaatgaagtgagattacacaaagcaaccaaaatgctatccgataaaataactgaatgagaactttacaatgaaagtataactattccgacaaccctgacagcatccttgatggtatctactattctgagtacagatttctgtccatctcttggaaggagaataaaggtctttcactgcctttcactttcaaatataaatccaaagtctggaaatacacaaaggtctgtcctttttctgtttatccctgctccctgagtcttgggtgtttgcagtgacacatggcaaaagcagccaaggttgacaccacagcagttttctcttaaatacaattttgacaatgttaactattttttagcctatgtctctgactgctatgtgaataaacactaactttcttgagataccaaaacttggaacacaccgtcattactttgatgagaaaccccataccaatacacaaccatgaagcaagctggagtctcacagtgaagtgagctgtatgtatgcagtctgcccttcaacagttggttcagccaaattactgttattcttgatctgtaacaatatctagataaagctacaaaactaaaacttgtcactgctttgtattccttgtgagaaacgtatgctatctacctgctggaataaagcaaacttcccttcaaagcaacctcagcttcaaactaaaaacatgaggttttccaaagtcactgtatcttaccatactaaatatcaatttgcttaaatgactagagagaaacctgtcttctacctcagcatggtggtaaatattaataatgtcttcatcagtacagagggtacttatcacccttcagcattaccagatgaatcagctgttccttttttaaaatgtgtaatatgaagtttaggaaaataaaatttcagagagcctttcagatatattccttccttctagatcatattatatttttctttactaaatatacatatgtataagtttatatcatatattcatctataaaaatatattgatatttattgacaattttatagtacatttatacatatttatatataaaattatgttacatagtcacatatacaatttatataaagaagtatatattttatttaaatttacattaatgataggtaatatcaatgatattgatattatcgcccacttttttaaagtttgcaatttaaattcaaggggttccgttgtagctaatttgaggtaagtttggaaagtaactaatgtttttataggacactgtgaggtccaacctacctctcccacccggtcctgctaaattcggcttactagatctttgctcgggcttacagttttttttaacatgctactacatctgaatgtgtcttgactaccaaatttaaaatatgtgctaatttggccaggcgcggtggatcacacctgcaatcctagcactttgggaggttggggagcatagataactcgagatcaggagttccagaccagcctggcaaacttggtgaaaccccatctctactaaaaatataaaatattagctgggtgtggtggtgcacacctgtaatctcagttactcaggaggctgaggtagaagaatcgcttgaacccaggaagcagaggttgcagtgggttgagattgcaccactgcacttcagcctgagcgacagagcaagacagattccatttcaaataaaaagaaaatgttaatttgctttttgggtgcactctgtctcaacatatagattcatcctaaacattgtgggataaaataaaattgatgaaaatcatttttaaaattaagaatataaattattaagaactaatcttgctatcacttcaatcatttacaaggtctttcatttcagttttaaacattttaaatatataatcaacagttgtaaacattagatgagactaatttaacccaaaatatatttcccgaaaccacatgaaacacataaggtaagtccaagctctggcattcttatactacagctatggtgaattcttggagaattcaaatcagtgtcttaacatgtctgttgagtctattcattattaaattctggttttaataatagaactttaaataaaagagggaagaacactggttttctttttggggaatactacttctcaagaaaataaatgactgaccaatataattaatctgcttatgtttaaagattgtgtcttcatggaaaaaaactaatattcagtttagtctataatagatacatgccaaatgttataataatgtagtcatactagttggtttaataaaatataaatacaccaaaaatgtttttaaatgagtggaaatttaatctccatgtttactattgctattatattggatattttcttagtgtttatacatacatttactcaattagtatttattttatatttagtgcatatcagacactaagcttctactatagaaataaattattccatttcctcacaatgactttgctattgagcatgcactacatttcatatttttttacctaatatacatttcaaggtactttagtaaaataactccaaattaggagataaataagttttaattgccaatttttttgaggtttccattccatctatgttttcagaaccttcatctaaatctcagtcttttagataaatacatttctcactatttgttagaaaagtcatgggaaaaagcttagtttgaaaggagcaagcaaagggaaatataaaaagagaagcccaaacattatttcatcagtggagtgtttagcttaaaaatataaccaagtaaatttaaaatggagttttaatgctcaagcaaacgcatgcatcattttaaaaaagaagcttgaaagagagttctgtgcagtgttattacctggcacagaaaaatgattctgattaatattcttgtttgatgaatattatagattctaagaaacacaaataaattaatgagtaaatgagtattttcctaaggcaaatccatcagcaaaaaaaatccaaaagtattaagtcagtcaacagagactaaacgtaaaagtatgaaaatgtcagtgacttgtataatgtaatataataaaagtcctggctctggcatgagagagtcttgcattgcattcctagttatgttgcttttggagggctatataagggtaaactagttaaaacttgtgagaatcagtttaaaattaggacaataaaatccattttattcttctgtaattgacagatgaaaatttgaacaaaaaataaaagttaagaatattcatttgttcatttatagcataagtgtttactgagcactgattctggataatgcactttataagatgcagtggctacagctttatgagaaaaactaaatgaattaataataaatacataatagtccatatagagttttcagtctaacagagtgtgacagtcacacctaaagtagctcataatgaatcaaatcctcgtataatactattctatagatcaggggttcagtactggtccatggcctgttaggaaccaggccacagagcaggaggtgagtggtgggtgagcaagcaaagtttcatctgtatttacagcccctccccatcattcgcattaccgcctgagctccgcctcctgtcagatcagcagcagcattggattctcataggagggcaatctctattgtgaactgcacatacaagggttccaggttgcatgttccttacgagaatctaatgtctgatgattgatctgtcattgtctctcattattcccagatgggatcatctagttgcaagaaaacaagttcagagctcccactgattttacattatggtgagttgtatgattatatcattatatattataatataataataatagaaatagagtgtataataaatggaatgcacctaaatcatcccaaaccactctcctgctcccagccccaggtcggtggaaatttatttttcatgaaaccagtccctggtgccacaaacttggggaccattgccatagatagtggaatctatgacttgcttctaatgtgtagaatatgataaaggtaacaagatatcactttattgtttcaattaagttatataagattcagtcttagcacattggagaaagataaatcttcctgctctgtgtaaagaagcaaacgtattgtaaactgcctttggagaaggacatatgccagggaactccaggtgacttcttggaccagaggatggcctccagacaacagccctcagtcatataaccaaaaagaaatgaattctgccaacaatctaaatgagctttgtaaaacaattgcattccatattgttaattatattttgaaaagaaatgtaatttaaatactaaataatgagattttattttatatatgatcaattatatacaataaattattttcttataaatctagttacaacttttctgtttcttatattgaacaaattttgagctataactcagtcatattactttacttgcttttgccattaccatagcttggtaggaaataaggttttaaataatagtcttttaagtaggtgacagatttagaataaaagattcataacagttctaattttaaaaaatgacttcacatgtttaatgacatagcaaacaggtagtatctacattcctaattttttttcttaaatctgcttgcatttaaacaatgtaaaattaattggtaaagcatgtcatttaaaaaaaaaattaaattaaagttctgggatacatgtccagaatgtgtaggtttgttacgtgggtatacacgtgccatggtggtttgctgcaccgaccaacccgtcatctacattaggtatttctcctaatgctatccctcccctaacctccccacccccgcgacaggccccagtgtgtgatgttcccctctctgtgtccatgtgttttcattgttcagctcccacttacgagtgagaatatgcggtgcttggtttttctgttcttgtgttagtttgctgaaaatgatggtttccagcttcatccaagcatgtcatttttattagatatagttggtaatagaaggaaacatataacttttttttgttgtttgtttgttttgagatggagttttgctcttgttgcccaggctggagtgcaatggcatgatctcggctcactgcgacctcctcctcctgggttcaagcgattttcctgcctcagcctcccgagtagctgggattataggcatgtgccaccacgcacggctaattttgtatttttaatagagacagggtttctccgtgttggtcaggctggtctggaactcccgacctcagatgatctgccctccttggcctcccaaagtgctaggattacaggtgtgagccactgtgcccggccaacatataacttttaatagttatttaaatattaatatgtatgtaatggatactagagtaaatactgattgggaaatacaaactgtcattaataaaatatttgttttctatatagctttaatatgtactttttaacatgtacttacaacatttatttaacacgaatagagtagaaaatgtgtactttaatactttgccaggtgacatgtttaagtagaatgaataaaactaggtttatcctccattgcccctcttcttatcagaggggtcatatttcatatgtcatatcttttctacactttattttctacttcacattatatgaagtctaaccagagatcataaagtttcatactatatcaatgcagaggcagaatcaacattctatacatataactttttactttctttgcaggattttttaggtaaggtcttcggccaactgaactgcaactgtttcatttacaataattttaaaacagtaaaattctctcaagaactaagtttgtacatttgatgttgataaaaataatgctaatggtgaatattttttgagtatgatagatgttgatattattgaaatcattagatatgctttaataactttaaaaccaaatggtagactgttccatttcatttctctttgtactttaccaatttatactatgaaaatcatgtatgaaatgtatagtctagaacgtttgcagaaatatcatctcaaaaacagtaactcaaagtctaatacagaaagacatccatataaggaagcatttcacaaatatttctaagctttgatttgatatatattaagcttttaccatttatcttataaatctacatggttaaagaaatgatcaaccttctcaactggcacaatgtgaagatggataatttgacttagaaaaataactaattgtgtagtcatgtaagcccttcatttatgacacaaatccataaaggtcactgtcatatttcttagagactggattttaatgtaaagctgagttttatttttctaggaaactgtaacttttattgaaaatagttcatgtataagcagatttatggaattcaaactcatgttgtccaagggtcaattgtgtgtaattttataattgtaaaactctgtcttatctgtaaatgataagatattacaattagttggttctttatgtttgaggggcaaataaaatttgaataagttgtcttactcacaaagactatgcttcacgaataatacactaagaactttagtctcttcctacaaatacctaattttatagtgtatcctggcatttcaaaattaccaaactgaaaagtagtcgttctctctcttagtgtcaatgctaattgtatggtacgttcattactagagtacattttttctaacttaaatttttaaatttattacattaaatattagattatgctattatatagtaaattcaaactgcctgtataatattgtatcctattaaaatgatacagacattaaattttatgggcattctaatgattgttttccatttttccatacttttaaaataagttgttatatgtcccttggggatggggattattttaggaatactttactacttattaattttccaaaagtcaataatgaaaaatatttacttcccaacacaccctggcaagatattttataagtgaaagacataatttcattctgacctttttaattctaaggccttttcatgttgttttttttttttttttcaatctgatctaatttttaactctctctatttattaccataaccaaatttcattttactttatttttagctagttatttctgcctaggcattttctcctttttcatatttcgacctaagaatttgttcctcatgtaagacttctctgacaagtcacttcctcccccaagtataggtcaaatattttgcgataatccttagcctttcctttgtattcagcgaacacatctcagtttataattacattgcttgtcagtgggtactttggcaatatttgtgtttcactttatgcccctgagaagaggaatcattattagccaagctcctatcccagctttttatcccggagcccagcaaatagcttagcccagattagcattgatgttttgaatgaatgaattttaaaaagaaacgtatcattttcacaaaatgtcctgttatttacattaaagctaatttgttcttgtcaaatctgtattatatatgaaatttagttttaacacttattcctgcagcatttgctgaatatgcaaggatcgataattgataaattctaaggaagttctatttcctttaagacacatttaaggtattgttggagaaagggctatgaatattgtaaattctcacagagagtatggagatgtttgtacataaatatatacttattataaaataatattttaaatcgtcgaacttagataaaatatatgcttataaaatataagaataaaattctaatatacttggaaaataagaaccaaatctcagcctgtaagttaaaacttatggtttatatacaacaaaaactactggggctgtttttatttctgtgacccaattaaactaatcttttctcaaatttcatccctatgtctgagtatactaatattggcaaagccctctctatcctaaaataatgtctattttaatatgtcttcatagaaaagtcattaaaaagcagtgaacatagccactaagtatgattttaatatttttgttgaaatgactaaattaatagaaagtgacaaaaagtaccttaagaagaattttaaaaaacaaaaacaaaagattgaacaaagcatatgtggaaatataaattataattttcttccactttattaacactcttgtctaattagacaataattactttaaaaactaacactttccccttagaattactgctgaagttgaaaggttcaagtttttaattactgctcataaagcatgcagtgaaactttctaaactatgaaaagtctactatcttacgattcagcaagatatttatcttataaaaacatcattaataagtacaaaatctcatttaaattaacagcaagaaactttcattttcctttccagtgtcagagatgggtgaaataaatcaaaatcaaggatcttttgtggatgaaaggaagtagaaatcttaagactagaaactcactaatgtgatgcccatgggcaaagatgaaatcagatattacagatgattttgaagttgcagttttaataatgataaaggtatagtgaaagggagaattgaagcagaaatgaatttcatactgttgcccacaccaatcaactcatcatgcatttcaaaagtatattccggcacaacatggtggctcacacatgtaatcctagcactttgggaggtcaacataaaagaatggattgaggtcaggagttcaaagccagcctgggcaaagtagcaagacccagtctctgcagaatagacaaaataaaaaaattagccgggagtaagggcacacacctgaagtcctaccactctccagaggctgatgggggaggatggtttgagcccaggagttcaaggttacagtgagatatgatcgtgttactgcagggacagattgagagcccaaaaacaaacaaaacaaataaacaaaaaagtatattccactaataccttgtaaatgggggtgtatgaagtttttttaaatcagatataatgataatagcgtgtgtgcatggcagtgtgtgtgtgcgtgcgtgtcaggttgcatatattaagtgtaaacaccacagttatttcaggaagggatcataaatgcataagaatctaagtgtccataaaataccgtaaataaataattaaagctgattgagaaataatgggggctctggagactgtgcagaatttaaacttagcaactttgcagaagtctacgtctattttttccatcttccaattttttaggtaacattgagtgtctggattttcatatgcaattatgcaatttattttaattaaactattttctagtgtatagtgtggccaaggaaacgcagctttatgtgccatccagaccatgttgcaatagtttaaagccttgggcttaaggatctgttagtaacatgacatttgtatgatcagagctatctctccatacgcatttaggaccactgtactatcatcacgtccaaaacttcctttcataatcacaatctttgaaaattctcacactttagagtatcttcctgcctagaaaaatctatcacagtaatatatgcactcaccataaagataatgtaccaggatgctgaggatatactaggtggaaattttagaactgctgttgttcaggattttctcaaaagagaaatattcagaaatatcaggtagttactttacaaagtaacatatataaatatatgtatatacacacacacatatatttatatatgcacaaagggtttcttaaatgcacatgtacctttaaagtaagaatgcattttgggcatagtcatcaccaacacaaagttcattcttgcctcatgtattgatttatgctttaaattttgtaatcatgtgagcaatctttaaaatgataccagattcccaggttaaagtcatttggatgacatttatttatgttttttgtactattttgagtttgagggatggtgttagaaaatcttgtaaactagcttttggtattttctgattattattttttattttttggtgagcaacactaagactggcatttcaacttccaatgagggtccttatataatactcagttaagcatattactgctaaattcaaacaaattttaaaaacaaaaaaagatataaatgattgaaagcatgacaaacgttccctgtagatgttttctaatttttaatacattgaattaaaaatatgcctttccaagtgaattttagatattggttaccaccttcaagatcatcatttatgtatttgtgaaggtgaaagtaggaggcatacataatattatatctgtaataaatgtaactttttaaagtaacataacatctatatatggcaggaaataataatgatacaacattaaatagatatagacctgatgatatagttggaattctccaaactcttgcataacacttatgtaatcaatgtgaatttaaaaacatacaattggccgggcgcggtggctcacgcctgtaatcccagcactttgggaggccgaggcgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcgtgaacccaggaggcggagcttgcagtgagccgagattgcgccaccgcactccaacctgggagacacagcgagactccgtctcaaaaaaaaaaaaaaaaaaaaaacatacaattgacaataatatatgtgatatagtagattgtccaatattttgttggtctaaactacaaaatttgccctgatgattggtgtattgaagagaaaaacaattatttgtatctcatgatacttatcgaaagagtttgtagacaaataaaaaacacactagcaaaacacactctgtttcatgttaattaaagggagaaatactgttcacagaaattagcttccaaaaatcattcttcgtgaaaacacataagtaaactaattttaatactctcagttataactaaaatggtatcatccactatcttccactaactaagtattaaatacagagcataagctattccaactgacatattaaacaactttaagtatggcttatgtctataattttcttgtaatctcattctgaatggagctttcttgagcaacagtaattacagaggagttaagagtctggaaatagttatttgtttatagaaagaaaaactaataagagaatgaacatacttagtctaattagaaaagttttgtttaaactaccattagaagtaaaataatgccacaaactgaaatgaatccctggatattcttaaaacattattgttactttagtttcttaaaaacaaattaagcagacactcattttttccaatagcttgtaaacttttgaatcttgggtataattttaattcttgagagtgtcacatatttgataaagaatgtttgtctaagatttctatgcatatgtgtatttgagtatatgctatattaacatatgtgtattagactgccaagataaaatataactaatcaaagcatttattatttaactttgattaaatctattagcttctttacagattttgctcatttgtaagaggaggttaggtttcttcccccaggataaaagggatgagttatctgtttctcttgggacagatgtactgtggtaaatgcagtgataagagataaatgaaaataaagagaagcccctaaccaaacagaaatgaaaagaacaataatagaaaagagtgtctggggacagtgttcgaggttactttttcttttttctaaaatgattttttgcaattcatgaaaacaagcctgaagcgtaaacttgtcatctcattttaagatgcatttctcctaatattaggtattaaaatataatgatcaggcatatttttaagactcttttcaccttgtttgaaatgtattgcttcacaaagtctttgtggagctttctttttttttaagaaaagaagaaataatacaaatatagtttaggttgtgttaatgcttgaagaaaggtgtaaagggagtgatatgctttggttgtgtccccacccaaatctcaccttgaattgtaataatccccatgtgtcaagggtggggccaggtgaagataattgaatcacggggcattttcccccatactgttcttgtgatagtgaataagtctcatgagatctggttctataaatgggagttcccctgcacaagctctcttgcctgctgccatgtaagacatcactttgctgctccttcaccttctgccatgattgtgaggcctccccagccatgtggaactgtgagtcaattaaacctctttcctttatacattatccagtcttgggtatgtctttattagcagcctgagaacaactaatacagagagagaaagaaggttggagtagggagaagattgctagggtattaaaggaaagccctctgaaaatgacacttgagctgagacctgaataaactaagggatattttagagaatcccataacagggaagcaggcataccactttcaatggctctgagtggggagcatgccagccatggatgagaaacagcaaataggccagattaataagagggagggagtagtactagagatgagagacgtagccaacaagaaactgagagaatggaggtgccacttactggaatgtgatcctccctattggggagcggcaggtttggagtagaaatcaagagtttggctttgattgctcaaataaagtttgaaatatctattaaactaccaaatacagatgtcccatagattgatatgaatgaatctgaaagtcagggtagacaaaaaattgccagtcatgaaatgaacatggcactaacataggctatctacggaggatgtacaaagagagaaaaaatcaggacttgcaaatatttagaggtcagaaaaataaagggtatgtggctaaagagataagaaggagtgagagggaatgcctgaagccaaatgaagaaaggatttcaaacaggagagaatgctaatatgttgagtgccactaataggttgaggaagataaggattgaggattaactcttgtgtatttgcaaaacagaagtcactgatgcccttgagaagagtggttttagtggaggagtgggaacaaaagcctgactagaggttttcaagaaaatagagttcatataatttgttagtgtttttttttactgtgcaagtgagcaaccaaatgcggagataggaagacagtggggacaatgagtccatgaacttggcacatgtgtgcacttgtgttaaagatagagctattaccaatgaaaataatctattaaaaagtacagtgcagacaaaacaggagagagaatggacacacctgcacagtaagagaaaagtcctttcttaggttggtagaggaaattagatcctccagacagtggtaattaaccagagagaaggtccaggataggtggaagtttgcggatgagaaagatgtatcggagctttgaggataaagagaatgtatgaaggattcctttgaaaagtaatagtgtgaattaagtggcaaaatggcatacagttatacagttattgcatagggatgatggaccacttgatgtttgttttttcttttattttccagccacatgaagctgttggcatgtaggattagagtagacaaactactatttttattttttttatgtttagttttctttataatacacttcttcaagtttaccaattaaaatattttgaatctcataattaagtcttaaatatacgtgttcatgggtggtaattacttaaaacacttggatagtagcaagcaatgaaacttctctttctcttctgttgtattcaccaccactttagcctgaataactgagcaaataccaggttcttggaacactggcataaactatgtatctaggactatggctctgtccatcagcacaagccactagtaattcagaaattggtcatttatataatggcatttattgcatctttaccacgaacaatatgattttttaaacatggtttaaactatattatacaaataattcagctgtgtttgatacttcttatatgtaagaatcactttcctttttataggttacttttcctctttttataatatctgaaatttaaggatgctgtctcagagagccctttatttatgcaggcaagataagaatctatctgagatactctcacattcttaaaaactaaatagctacccatgtgtgtgtgcatagtgatgtcagaagttcttaactgagtcgtaaattccaaagaatcttagctaaaatgaagctcatatcttgctaattcttctctgttaacccataagaaaacagaagcccagagaaattaaaagatttgttcaagatttgcttgatagcatactaaggtggatttaggactttgggctctgaattgcttaatatggaagtgttgctcagggaaaagcccaaaccccagcattacacaataaatccatgcaacaaatttatacatgcagcctctgaatctataatttaaaaatgtgcaaaaccaagcatctttgaggaacaaaattctgagatattataagactttgaaagtcatattaggctttgctattgttcagattttttaaatatttttaatttttttcatttaaattttaagattttgttgtggtaaaatgtacataacatataatgtaccattttagccattttaagtttacagtttagtggctttaaggacattcacattgttgtgtagccatcaccaccatccatcttcagaacttttcatcgttacaaactggaactctatccattaaataggtgctccccattaagccctgctccccgcccctggtaaccattattctatgttatttctctattaatttgactattctgggtatggtatatttgtgaaatgatatgaaatttgtgctttcaatggacaagcatttgaggggattcaaaattgaattattttatcacgtttcagatggaactacaattattgagcatcaccattttagacattttactaggaaccttaaatacatgttttattttaaattctggatcaaaattctgaactaattgatttcatttctttataaattggacagaagctgagcatgagaggttaggtagccctctcaaagtcaaacattagaggcaagactagaagtggaatcttcaaacccatgtccattaacatttcacagaactttgaagtacattatgcttgcagtgattaaagcttgcgatcaagtgtctgactaacctgagttgcaatcctgactctgcctcttacatgctacaatattttgggcagttttctgaacttttcaaaccctcagtttttcctttgcaaaatgttaaaatgatagtttgaaaatcatctagaaagggtgttgattatagcatagcacaagacagaaacttttccatatcataaagaaaaaaatataggctttttgagatactaagaagattatcatttatatctgaaagggaattcagattgcttagggaaattatacctaagatgagactcacaatggcagataataataaaatagcgatatttttcacatattaaaatgcatgtgttattgtatataacaattatatatttaaaaattgtccttcagatatactcaaacacgtcttcaaataccttcatataaggatatttactgaagtatgatttgtaatacgaagaggttgtaaacaattagaatgtacagcaataaaggatacaataggttaaagaaaaaatgtattgtaggtatagaatatttgctatgtacctaattttttaaaatcatatttataaactaaaatagatactctaggatatgtcaaggagctaaggaaatcatttagtttactatttggatgtttacactgaatcttcaaagtgttacattttcttaaaagaaaatgttaaagcatatgtggcatttagtcaaatgtatatgaatatgtatttatggcctctttatgtaaatgcatatatgagatgttcttgaagtaaaaaataattctgtgtttttttctcttgacacaagttgaagctattacaaaagctaattatttaattaaaataacactggaaaaaatgttttaaatttcatttgttaagctagaaaatatttaagaagggaggaaataatttagatcaataccatgtgtatatttaaatcagattttcaaagtttgacctttttacagaaaatctaacagcaacaatcatttccagcgttactccaggtcaaatcatttgatagtgttatttcctatagtagtgtgtattagaatagaatgtctgaaaacttaggctacactaaatttataaaatgcattttttaaatagtaaactaactttagcttactgttgtttttaataaaatttttaatttttaacttttttagctttttgactcttgaacacatggtatagccatacaacatagtttctttctttatatttttattctataacctttttctattttaaaaattattaatttaatttttacttttaaagcattttttaaacctagacccaaaaatacacattagcctaggcctacaccgggtcaagataatcaatatccctgtcttcctcctccatatcttgtcccagtacaagactctgagaggcaataacatgcacggagctgtcatctcctatgataataatgccttcttctggaatatctcttgaagaacctgtctgagggtggtttacagttaatttttttataaggagatgaagtacactctaaaataacaataaaacttacagtattgtaaatacataaattagtaatataatcatttgctatcgttttcaagtactatatactaagtgtatgtgctattatttttatcactggcagcacagtaggtttgtttataccagaatcaccacaaacgtgtgagtaatgctttctgagatgatgttacaagggctatatcaccaggaaatagaaatagaaatttttcagctatgttatagccttatgggaccaccattgtatatgttgtacattgttgaccaaaatgccattatgcagagcatgaccatacaaatgtacagatgctcatcaaattacaatgaggatacatcctgttaaaatcattgaagtcaaaaatattgtaagttaaaatgcatttaataaactctgtctactgaacatcatagcttagcttagcctaccttaaccatgctcagaacacttgcattagcttacagttgggcaaaatcatctaatacaaagttaatttttataatagtgttgaatatagtatgtgactgattgaactgcactgaagtaaagtttccactgaatgcatatcacttggcaccatcataaatccaaaaaattgtaaattgaaccactgtaagttggcgactctctgtatataaaatatgtgtgtgtgtgtttatgtattttaaatcatcactgcctctacttttctaatttttgcatggaaatccaaatccaagggagcaagacagccaattttttttttttttttttgtatttttagtagagacggagtttcaccatgttggtcaggctagtcttgtactcctgacctcgtgatcagcctccccaagtgctgggattacaggtgtgagccaccgcactcggccaagatagccaattttaattataacccagagctaaaaatgtctagaaaattaaaatcatcagctaataaccaaactattatataaatatagattattttctagaaaagaaaagttcaaaggccatttaatagttgaaattttatgatgggtgcaaattttgatgcactatgttttgctttagatcctttttaaagaaagcattaaataaggaatgctttacagagttattgagattttttagcaaaaagaagtcctcattatttttgttttggtttcctgtgcttttggtgtcatatccataaaatcattgctgagacgaacatcatgaagcttttccctcatatttctttttgcactttaatgatttgagtcttacatttacgtcaataacctattttgaattttttgtgtgtatggtgtaaaattgtgtccaataccattcttttttatattcttatctatttttccaccaccatgtgttgattaggtcattgtgactttttggcacccttagtgaagatcagttgactatatatacatagatttatttctgagttctgtatcatattccagtattctatatgtctgttgtacaagtggtactatatcaaactaaaaaggctctgtacagcaaaggaaacaacagagtgaagaggcattttgccttaacagaatgggagaaaatatttgcaaaatgtatatttgataaaggtttgatctccaaaatactttatttttgaaactcctgtaactcaataaagcatgtgacttgattttaaaaatgggctaaagacttggaaagacaattttccccaaaagaactataaatagccaatagatatatttaaaaatgttcaatgtccctaatgataagaagaatgcaaatcaaagtcaacaagagatatctcctcacacctgtcagtatggctattacaaaacaaaaacaaagaaatcaaaacaataaaaccccaaagacagtatgtttttagtaagaatgtggagaaagtggaactcttgaaaactgttggtgggaatgcaaaatggtgcagccactatagaaatcactacggaggtttctaaaaaaatttaaaaatggaactaccatatgattcagtaatcaaaattcttggcatttatccaaaagaatcaaaattacactctcagatacaatcatatactagtactcttatgctcattgcgactctatttacaatatccaagatgtggaaacaacctaaatgtccatcaacaagtacatgaataaaaaaatgtgctacatatataatatatactgactaaaactctctcctttgaccaaaactttatttggactcttttgaatcttatgcttggctaggtctaaccttgggcttctctttctgtccttgttgaatccagtttgagcaagattcctgttaagtcagcttaggaaaaaagcttcaatatcttatgacactggactccattcagcaataattccatcaagttgatgtagctagaaacctcgtttttctgtatgtttcctcttagtaattttccattcactgaaccccaccctgctttttggtataagtctccacttgtcatggtggaagtcagaattgagtccaatctctctctgctcctttaagaccactttgctggggtccctatacctattaccatgcccatccttgaacaatatctgccttaacatctttaagaaaattctgcaatatataatacaatgttgtatggcagaaagtttcagtcaagccaggtaaaaaagccctagagatctgccaaacaacattatgtctatagtcaaagattatacacttaaaaattggttaagaggataggtctcacgttaagcattctaaccacaataaaataaaattaaaaaaatttaaaaaagtcttcactagcattaaaaattattaattataaatttattacagagctgtcctcaattaaattaaaaaataaaattgtcagcccaatgaaggcattatcttaaaaattagaattaatgtgcaaagagtagaataatgggagtggtaaaaattgaagttataaaagttatgttctaccctcaaccatcccattagttaggtaggctgggtaagtcatttttttttctctaagcctcaattgtacttctttagacttgggctaatcatactaaacaaatgggattgctattatgttaaaacacagacattaacaaacagcagttcaatctgactctggctaactatatactgaatagaatgcttaatgtattttaaccattctcacagaagtagaataaacaatataaacaataaatttccgaatccaaagtttaagagatgttaaggcaaatactgtattgtctgaaaagtatacacttttgaaaaatacataggattaatattgaaaatatcagaatatgcttaaacaagtatgcttacataggttttctcctttcatctcagtttgaaaatctagccatgtaaaatcagtttctagttaccagtgattcacagataagcttcacccattaaaatttccattcctacttaagaatcacaaagaagttaaaccccaaaagcagcatctcaaaatcaactctgaaaggcaattactttttcaataagtaaaattcatgaggaaaatttgtcactgcattagcaagttgtctctccatagaataaagaaccaaagctttacttgttcattgtgtatgagaagatcaggatcagtcagttaatgcttgtgttgagaacatttataatgtcaaaataaggttaataatcctaaaaattagataacttaataaagcaacattagactacctaaaaattccaatgctcaaaaagtaattcaatatttttagatatgctaaattgggtatctgctttctcagtaacgtttccaaaatacctatcttctcttcacattcaatttttctttcttactacaactctttagccacaactacataaaccttaaaataaaattttctgatattattattaatatatatgtccacataggtagataaaatggctataaaataggtaatttttaaagtttatgagctaagtgatgctaacagaagcaattctacaaatacatatgcaaagtgtattattcatttaaaacaattaacacaaagcactcttttttggatatggtaactaccaaagtcaaaaaaacaaagagctgaaatattatgtaaattgttcacagaaactgttgatctccaaaccagtcaattattatcacggcttgaatgttatataaaatggtagaaaaattcttgatcaacacttacattttgcctctgactactttcctcattaacttaccagccatgaaaagcactgtgcaaaagtcagcaattagggactgaataaagttttaagtggatcaatataacatatttggcatatctatgacacttctattaacattcatcaatttatgaaataacgacattaagtaattgtgttcatcccaaaaacccaaatatcaaatactatttgcatgactgtgttatacatagagcagaaggcagtgaagacatgatctttgcttttgtcacctatgaagacaaatatattgagtcacctatgaatacaatatattggagtgtgctctataagacaagtagatgccaactcctactggtcttggagaaaatgtaaataattctattggatgggagcagcaaagtaggtagcaatttcacagaatgggtggtattggggcatgttcttgaaggaatgagaggtcatcaaacagacaaaaacgttttgaacataggttataagcaataaagaaactgtggagttgcaaaaaatacagcatgatcaagaaattgtatagtcatgtgccacttaacaatgtttctgttaataatggaccacatatatgaggtgatcccttaagattggaatggagctgaaaaatgtctatcttctgttgacactgtagctgtcataacattataacacaacgcattactcatgtgtttgtggtaatgctggtgttaacctactgcactgccagtgtataaaaatacagcatatgcaattatatatagtacataatactcaataatgttaataaacaccatattactggtttgtgtatttacaagactaccttttttttttttttttttgagatggagtcttgctctgttgccaggctgggctggagtgcagtggcaccatctcggctcactgtaacgtctgcctcctgagttcaagtgattctcctgcctcagtctcccgagtagctgggactacaggagcacgccaccacttccagctaatttttgtatttttagtagagatggggtttcaccatgttggccaggcttgtctcgatctcctgaccttgtgatccacccacctcaacttcccaaagtgctgggattacaggcatgagccaccatggccagccacaagactatattttttatagttattttagagtatacttctcctacttattaaccagagtatttgaattttgcattttaagctgtggggagttgctaaaccagtaataactataataagaatatcaactaacgtttgtcagtactgttaatatcattcaccaacttttaaaatcacctattatatttgaaactgtttattatctcagtgtccctagaaaagcaagtactgcattaggtgcataagaagatgaccatcattgaaggtcaatgagcaaaatgtccaatttttttctcaacttggctgaatatgagacagaggagttcctctgagcaggtgagttatgtagcttatgacttacaaatgatccctaaaaacttcttatatggtatggtgtaaatgaaagtacaaaataatttatgacagtacgtagcagaacaaaagaggaaaatatgttttaattatcaattaaaaattacctccaaacttcaaatatgaaaacccacaaataaattgcatctctattgaaatagcacaggcacttcatggtttagatttgtagaaatgtctctgaaaactctgtatttcctacttttatgtttgtttatatttaggagcagcctacacataatttggctcacttaaaagactttcttaatgagtagtaatctacatagttccttgctgctttattttttagattgggctggggaagtcaataaccactagaaactctcaaaccaagaaattctcctgaagcaatctttcagctgtaaaccacctcagctaggaacccattgtattcctataaatttccttcagtattcctaagactaaactaatctgaacctcatgactgacaatgagttgagaatgaccttttgcaccagtgcattaattgtgaaagctttctgcagcaggagctaggaaattactcttctgagtacagcagccagagcactgaaatggctctggctgctgtactcagaggagtattttgaatggcaatgcttaactcttcagccacacatcgtctacatttttatattttacagacattttagatgtgtccatcatcctccaaggaaattggatttctgaataagaaatttcttttcaccctgtgatttctacatgatacttatagaaacagtttgacagctttggagaggatatcctatgcttcatgtagactttctgcttacggagtttaacacactcataaatttagctttactgactttacaatcttttatatgagaacagaaaagtcagcaaatttggaaatagaaagtttatgttccgccacatataaagtatgccaagtaatactttggccacttcacaaggaagaaaaggatatatatccaaatttatataacattcaagaaaatctttaattatattccagagctgataatttaaaatttatcttcaataattttatttgtttccaaactacctgctgctgagaggaaaataagaatatgcaatttgaaggcatggcttgtagtgtatcatagctctatttattatattattatattcatctacatacactgaactgaaattgtagagttcatttatcatttagatcaacttttaagaagatatatttccaattcttacctgtccatctcaaattgagctcactatattcactttatgtataaatggtatgtatacataagcaaaatataaatacaagcagtgatatatttattgcactttgtatcttaaactagtatacgtttgcttccagcagtattttgattttactgcaattcagatattctgattatcttttacctaaactttaacaatcaaaacaacttatcagtcatctaactttaaacttcctctgaaatcatagtctttgtacacgaaatctaactggggttaaatgttcttcttgttctctctgattgagccttccctgggacatctcatgcatagaaaagagttcacaaataaaaatcggttagagctgtgattcagtttacataagatctagaaatataagttccataacttctaaacgaagtcatatccttaagccattcttaaacttaaaagcgaataactccaaacatccctgattgaataactcaaaataataagctcatcaatctgataggaatgtcaatctcagatacattgccaagaaaatgaaaatgatgtagtaaagattaaatgagaaaatgatgccacatacttagcataaatgcaaacacaaaataaatactcaagtaaataaaaccattctttttttaaatgtattctaaaacaacaacaataacaacaacaaccacaacaacaaaacaggatacaggtgcagaacgtgcaggttcgttacataggtatacgtgtgccatggtggattgctgcacctatgacctgtcctccaagttccctcccctcataccctaccccgcaacaggccctcgtgtgtattgttcccctctctctgtctatgtgttctcattgtagagtaactcccacttatgagtgagaacatgtggtatttggttttctgttcctgtgtcagccataaaaagaaataaaaccattcttaggatgatatttctccttacccttctctttttacaccgagaagaattatcactttgacaactgacgctctctttctttctttcctgaaagtaagttacactgtaacttatatgagtaaatgagccctttatatgaagcttaacatttaaattctaaaggattcttaaacacatgtgtaacaacaccatgtgttagttaatcctatcataatatatcatgttcatatattagattaatacaattaatcacattctaaattgacaacattttctgagatcttggtttcttaatatttgcagtagaaacaaatattttttctcacccttgagaattaaaagtgaagcagaaactttagagtcatgttaagttgctgactatctaacttggtttctgaatgataaagtagactctaatggtgattgctttttcagtaacaactttcagtaatatttgtatttttctatcacacctttccctgaagaagaaatgctttcagatgaatagggaaagactctctaagtataggtttgagttttagaattggctagattggagagttttagatggaagagggaggtatcaatcaagtacagaagttaatgctacaataattacttgggaaaattctcacacttcagtgattgccaatcagcctgcactacttactgagtgaaatgtctatggttatcagaaatcgtacaagaaaaaaccaaaccgaaacaaaaaatagtgtagttctttttttctcaacgaagtatatttaagagcattaatttagatccaactaggcctaggtttgagcacaggattttccactgtgattaacttaaactctcttgtttgaagttgtctcacctataaaatttgggacaattgtggtaattccagaatgaaaataaaatgatgtacatacatcatttagtatattaaaaattctcaataagaattgatttttctgttaatacgattataatataatttgaggctacaactaaagaatgaaatgaatagaaatgtaaacagaatggtcacttttgaaagggcttattctgtttagaagaatgtatagacatgatcaaataaatgttcagataaatttatagagatgtcaaataataactgcaaattgtgcaattcaactaaaatgtcgagagacaatgagacaaataccttttttattcaagttttaagaaaaattactgaagtttagaaaatctatggaataaatagaacaatacaggcataccttgttttgctgctctttgctttatttcactccacaaatattccaatttttacaaattgaagttttgtggcaacctggtgtccaacaaatctatcggcattgtttttccaatagcatgtgctcacttcatgtctctgtgtctatgttttggaaattatcataatatttcaaactttattattattattatttgttatagagatcagcggtctttgagatcaactactattgtagttgatttgggccaccacaaaccaggtccatagaagatgataaacttaactgatacatgttgaatgtgttatgactgctccacccacttcagcttccctgtttccagaggcacacaatattcaaattaggccaactaataattgtacagtggtctctaagtgttcaaatgaaaggaggagtcccaggcctctcatttttaatcacaagctaaaaataaataagcttagtgagaaaggcatgttgaaagcccagaggccaaaagctaggcctcaagcaccaaacagccaacttgtgaatgcaaaggaaaagttcttgagggaaactcaaaaagtgctacttcagtgagcacatgaatgataagaaaacaaaacagtcacacaccagggcctgttgtggggtagggggagggggagggggaagggataacattaggagatataactaatgttaaatgatgagttaatgggtgcagcacaccaacatggcacacgtatacatatgtaacaaacctgcacgttgtgcacatgtaccctaaaacttaaagtataaacaaaacaaaacaaaacagtctgattgtggatatagagaaagtgttactggtttggatagaaaatcaaaccaaccacaacattcccttaaaccaaagcctaatccagaacaaggccttaactctcttaaattctgtgaaaactgagagaggacaggaagctgcagatgtttgaagttagcagaggttgtttataacatttaatgaaagaagtcatctccataacataaaagtgtaagatgaagtagcaagtgttaatgggtaagctatagcaacttatctggaaaatttagctaagatcattgttgaaggtggctacactgaacaagagatttttaatatagatgaaaataccttctatggaaggatgccgtgtaaaactttcataactagagagaagtcaatgcctggcttcaaagcatcaaagtacaggctgactatcttgttatggatgaatgtaggtggtgactttaagttgaggctgatacttactgaccattctgaaaatcggagggttgttaagattatgccaagtctactataactgtgctctatgaatggaataacaaagcctggataacagcccatatatttacaagatagatatgaatattaattttttccattggggcttcaaatgaatatttaagccccaatggaaaaaaaaagattattttcaaagtatcactgctcattgacaatgcacctagtcacccataagctctgatggagatgtacagggagatcagtgttgctgtgatgcctgccagcacaacatccattctacagcccatggatcaaggagtaattttgacattcaagttttattatttaagaaatacatttcacaagactatagctggcataggtagcaattcttcttatgtatctgggcaaagtaaattgaagaccttccattctagatgccattaagaacatttataaattataggaggagatcaaataacaactttatcaggagtttggaagaagttgattccaacactcatgaatgacttcgagaggttaagacttcagtgtagataatacctacagatgtggtagaaattgcaagggaactagaattagaagtggagcctaaatatatgactgaattgctgcaatctcatgataaaatatacacaaatgagcaactgttttgtgtggatgaatacaaaaaaagtggtttcttgagataaaatctattcctggtgaagatgccatgaactccattgaaatgacaacaaagaatttagaatattacataagtttagttgacaaagcagtggcaggttttgagaggactgactcccattttgaaaacatttctactgagggttaaatgctatcaaacagcactgaaatctatggggaaatctttcatgaaagaagaaaagtagcactggcagttgaaagttaaaagcttcccatttctgatcaaaaagattctttcaaatcagaaaataaatgaaaaaaaaaaccgccctatttttgtattttaatttccaccctaaatttctacttcgagctttattttagcatgcccattccttaggtttccttttgttttgaataatacttccatagctatcctgaaaacttttaacaagttaaagtaaaatgatgtgattataagttaagtcattgcagggatggatgtttttatctatgtatgtgtatttttccccaacatctcccctgaccatcaggctgtcatcttataggatacagtggaaatttacgtttcttttagagatggtgtatcactatgttgcccagactggactcagattcctggggatcaagcactccttggcctcctgtgtagctgggattacaaatgcacatcactgaacccagctagtgccaatttttgaagatattattgttattatgtctttgcagaaataaagttattttatttatttgtagttactacagaagaaatgactttgatagataaaaaatagtaacaaatttcaaatagaatggaaagagtaaattatctaaaatatcagaaataacttgttttagcttatatatacttgatagtttaaaaaatatttttctctcaaagtagcatactatatttctgttgtgaaattatttagttcacatatcatgatcttttaaacttattttatttacaggtatatctgcatataaatttaaatcttcatgttgaaaatacatgattacctgagaacacagtttaatttatttaaaacagttacattatgttagacttatattttgtttttattttttcattatgtatatcgctatgcttattgaaatgtgtgtatatatatatatatatatacctctttacatgcttgcaatagttaacctctgcagaaatgtttatgcttatttttgcttattccatttatggtcagagagagagagagaaaaggaaggaaggaaggaaggaaggaaggaaggaaggggaagggggaaggggaagggaggaagggaggaagggaggaagggagggaggaagggaggaaggaagtaaggaagaggcaaggaaggcaaggaaggccggcaggaaggaagaaaagcaggaagggatggagggagagtgaaaaaaagaaaaagaaaagaaaaaatagccaggaagactgttcttacataaaaacgttctcacctattggttatttcttactctaacaggcacttacgatactatttaggccacctgctaagttctgtatacagtggcatctgtacattcccttcttatcattggtagagagactcctaaatcaatactcatcctgagagtgagctttaatatagtatgggtggtatttataagtaatgaagcagtcaagaggagaaacaagtccatgtttatctgaaatgactatcttctcattcaatgcagttacagccacctacagaaagggaaaatcatccaaacagaatttaagaaagaaagtttacattcgcttgactggaaatcacaggcaaattgctttgttggcatgggataaatgaaagttaaacacgtttggatattaggagagacaagctaatttgaagtattggaattaaaaaattaagtacatagatttcttgaaacaatcactcacagatacagtgacatgggtttgctcaaagaatagagaagactggcacattttgacagaatgttgccttgggtttattatttgcatcagatctgctcaatagtttagtgctgtatagattctgtgtttagaaggattccgagggtgtctgttgctgagcagagaaaaagctacacactatttgctatatcagccaggggaaatggaatgagatgagatatttgtcattcatgtggtagtgcaaagatctgcagctgtgctgccttacagaacctggttttccaccctctacatcatttcaaaactatataaatttgatcaattacttaacctttttaattctctattttcaattttatcacttgtaaaatgaagataataacagctaccctgattacctacagtgaatttagaggtcatagataaatgttctaacattatgcctggcacatgatagccaacatttacctagtgccttctattatcatgatttcttccctgacaactgagccactttttatctttagaaggcaccattttttaactattgccagtgtcatttgtgtaaaagtttcttagtaaagcagtctttgataatgattatgacttttctgtgtcctcaagaagggttccttgacttatataataaattcttctttgtctttcacatttaaaagggaaagtcaatattaatcaaatgagtgtgttcataaaagtaatgtcctcctcttcggaagaggaaaaacagcattggtttacccaaaatctgtttctgtgcttagaataaagatctagtgtctgaaatcataatggcattctaacaaaggattaaacaaataacttcagaaaacataatacaccttaatgatatttcaaagtatttatcaatgttattgtcaactttgaaaggtgagaattttgtaacatgatttgacaatgcttaactacaggttttatgtaaaaaaaaaactagtcacttacatgttcctcaaattattagttcatatgttacggaagaaaatgtttgccacatttctgaataaaagtcatcaaaatattgtgatctagatgtcatgtaaactgaattaccaagaccctatcttaagtgactctatcaagacccataaccagaagtaacaaaatctctgaaggaaaggatttctgcatgttttcaatatgacagaaaattattttttattgttctatgatgataatgatggcaatgcagtcccacctcacttttgaaaccagacttcagtgtttctctgaatacttttaagtgtggccaacagcaaagtggctgaagtagtaggattgaagactgttagccttaaggacaaaaatggtaatataattttcatcatactataattttacctaatattccttatattgaatgtcaggagaaatatattcatatatattatttccattaatgcattttaataacatatttagaatgttacattatttagcatctcagtagcaataaatagttttttatttctttatctttttaacactttgtaaagaaaatacattttactggtaagttatgcattgcataggggaaaacaaatggacaaaatgaacatatgaaaatcagctatgccttaatgattatattttatgtattttaaatatagtattcctaaatctattttacaaatgatgctcagtaaaatccttaacctctccattgcagcaggttcccagcatgaaggggctaaactaacaaagctaggggcctggcattagccccccagagttactgcaagcaggcctggagtactaaactaatctttggccccctgagatcttccagagacaaagtcaatcgactgaacccaccatattcctctatcaaactcccaagggaatcaaagaagataaaagcaaataccttatccaaagggcagcaacttccaagattgaaggaacatctgcccacacagattagaatgtaccagcatgagaactctggacgctaaaaaatccagggtgatcatcctccagatgatcatgctagttccccagcaatggttcttaaccaggctgaaatgaccgaaatgccagaaacagaattaagaatattgatagggatgaagattactgagattcaagagaaactcaaaacccaatccaaggagtctaaggaatacaatacaacaatacaagaactgaaagacaaaatagccattttaagaaaaaacaaagctgatctgatagagctgaaaaactcacttcaataatttcaaaatacaattgcaagtatcaacgcaaaatcaaccaagtggagcaaagaatctcagaggttaagtctggtactacaaattaattgtcatacaaaaataaagaaaaaagaataaagaatggacaaaacctttgagaactatgggattatgtaaaaagaccaaatctctggctccttggcatccctataggagaaagagtaagaaagaaagcaagttggaaaccatattttgggatataggccatgaaaattctccaacctcacccaagggccaacacttaaattcagaaaatacagagaacccctgtgagatactatacaaggtggccatccccaagaaatgtagccggaagattctcctaggtcaaaatgaaagaaaaaatgttaaatgctgctagaaagaggcagcaagtcacctacaaaggcaactacatcaggcaaacagtggatcttttagaagaaaccctaaaagcctgaagagattaggggcctatattcagtatattttttaagtgataatgcttcagatttcttcctacataattagaaaaaataatcacaacaaattggagaggaaatacaataaccttaaagataatctgggtcttatctaattccaaccaaaaatttcatatctagccaaactaagtttcataagtgaaagagattaagattcttttcagataagcaaatgttaaggaaatttgttagcacgtgacctgccttaaaagaggtccttaaaggagtgttaaatatggaaaggaaagactgttacaagacattataaaaacacactttagtacataaatcgacattctaaagcaactacacaatcaagtctgcataatggccagctaaaaacatgattaaaggatcatatctgcacatatcagtattaaccttgaatgtaaatgagctaaataacctaattaaaaggcatagagtggcatgctgaataaagaagaaagacccaactgtatgctgtcttcaagagaactatttcacaagcaatgacacacagaatctcaaattaaagggatggagaaaaatcaatcagacaaacagaaaagagaaaaaagcatgggttgctattttaatttaagaaaaaacagagtttaaacacacaagcaattaaaaagacaaagaagagcattacataattgtaaaagtttcaattcaacaagaaatcccagctatcctaaatatatacatgcccaacacaggggcatccagatttataaaacaagctcttagagacctacaaagagacttagataaccacacaccagtagtgggagacttccaacagcccactgacagtattagacagataatcaaggcagaaaattaacaaatatatttggaacctgaacttgacacttagccaaatggacctaacagacatagacagaactttccaccaaaaaacaacataatatacattcttctcatctgtacatgacacatactatataatcaaccacacaatcacccataagacaatcctcagcatatgcaacaaaattgaaatcataccaactgcactgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaataaataagattgataagtaggctactgaaaaataaaggtctgaatatccacaatcagaaatgacaaaggggacattacttccaattccacagaaatacaaaaaaaaaaaaaaaccttcaagtaatattacaaacatgtctatgcacacaaactagaaaacctagaaaaactgataaattcctggaaatacaaccttgcaagattgaactaggaagaaattgcaaccctgaacagagaaataatgagttccaaaattaaataagtaatacaacgcctaccaaccagcaaaaggcttggaccagatatatccacagctgaattctaccagatgtataaagaagagctgcatcatttctgctgaaactattccaaaaacattgagaaggagcaactcctcctcactgattctatgagtcatgcatcattctgatatcaaaacctggcagaacacaacaacaataacaacaaaagaaaacttcaagccagtattcttgatggacataaatccaaaaatcctcagaaacaaacaaacaaacaaaaactagcaaaccaaatccagcagcattctaaaagctcattcaccatgatcaagtaggctttatccctgtgatgcaaggttggttcaacatatgcaaagttagtaaatatgattcaccacatcaacataattcacaacaaatccacatgatcatctcaatagatgcagaaaagtctgttgataaaattcagcagcccttgaggttaaaaacctccaccaaataaggcattgagtaaacataccacaaaatagtaagagccgtctatgacaaacccaccggaaatatcatactgaatgagcaaaagcaggaagtgtcccctgctgagaaccagaggaagaaaagaatgcccactcctaccattcctatttaacatagtacttcaagtcctagccagagcaataaggcaagggaaaaaaaataaaaatatacaaataggaagagaggaagtcaaactgtctctatgtgcagattatatgattctatatgtaggaaaccccatagtctctgcccaaaagcacctagatctgataaacaaattcagaaaagttttagaatacaaaatcaatgtacaaaaatcagtagcatttctatacactaacaacatccaagatgagagccaaatcaagaaggtaattgctttcacaatagtcacaaaaacgtaaaatacctaaaaatatagttaaccagggaggcaaaaggtacctataatgagaattacaaaacattgaggaaataaatcagaaataacataacgggaaaaacattccatactcatatatagcaagaatcaatactgtaaaaagtgcaatacttcccaaagcaatttaaaagaacaaagctggaggcatcacattacctaacttcaaactacagtgtaaggctgcaataaccaaaacagcatggtattggtaaaaaagcagacacatagaccaatgggacagaatagacaacccagaaataaagccacacacccctacaaccatctgctcttagacaaaattgacaaacaagcaatggtgaaacaattcagtgttcaacaaatggagctggggtaactggctagccatgtgcagaagattgaaattggactcattctattcaccacatacaaaaatcaactcaagatgaattaaatacttcaatataaaactcaaaactttagaaaccctagaagataacccaagaaataccattctggacataggcaaaattttacaatgaagatgccaaaagcaattgcaaccaaaacaaaaattgacaaccgggacataatttaactaaagaacttctgcatagtacatgaaactatcaagtgtaaacagactttgatagtttgaacttctgcatagtacatgaaactatcaagtgtaaacagactttgatagtgtaaacctacagaatgggagagaatatttgcaaattgtgcctctgacaaaggtctaatatccggaatttctaaggaacttaaattaagaagcaaaacaaacaaacaaaaaccacacaaataaacaacccattaaaaactgggcaaaagacatgcagagacactttcagaaagaagacatacatgcagctaacaagcatgtgaaaaacgctcattatcactaattattagagaaatgtgaataaaaatcacaatgagataccatcttacatcaatcagaatggttattattaaaaagtcaaaataacagatgcctgcatggttgcaaagaaaaggaacacttataccttgctggtgggaatgtaagttgattaagccattgtggaaagcagtttggagatttctcaaaaaacttaaaacagaactaccatttggttcaacaatcccattaattgagcacattcccaaagaaatataaatcattctaccataaaggcacatgcatgagtatgttcattgtagcactattcacaatatcaaagacatggaatcaatcaaaatgcccatcagtagtggactggataaagaaaatgcagcacttatgcagcatgtcatattacacagccataaaaacagaacaagattatgtcctttgcaacaacattgatgaatgtcattgttctaagtgaactaatgaaggaacagaaaaccaaacactgcatgttctcacttataagtaggagctaaactttgagtactcatggacacaaataagggattcagagacactgatgcctacttgagagtttagggtaaggattgaaaaactacttatcagctactataattattaccttgggtatgaaataatctgtacattgcacccccatgacacctaatttacttatataacaaacctgcatgtgtacctatgaacctaaaataattaaaaaaaatacatgctaagattaatccatatcagttatttccagaactgtcatttgaatgtggtagagatataattaatataattgaaagaatagttagaatgcctgggttcaaattatggctccatcacttgttagatatgcaattttgtgcagtttatctcatctccccaaacctcaatttcatcacatataaaatattttaagcgtaatatttcataggttgtacttcttgatctataatcagtttttacaaccttttgaatttgtttatgacataagtgaccatagcaccactattatccataccatgagttgttctacaaaaagtgcatagagaccattttcttctagaacagtgatttgactataatagattatcatgaacattttaagctttatctgatttgaagaatatttactttctcaaatattacttaatatttactggctcttggtcaggtggcatggattcacattttgattctatcattcactactgcataagtctgatagttttactcaaattataggtgattatagacaggtatctgatgatggatttttttcaaaaatttctgaacagtattgatagatgtggtatcaacggtacagtgaaacttgccatttctctttctcagagagtggagattaggcatcttaaaaagagaagagcatattgagaggtaaacagcataattactcttaacagtgagccagatattttgaatgctcagatgtataaagctgagtctcatccaactaaatatgaatggttgtctgccttagcagagtattttaatcacattcatcacctccagagtaatgctgattacaaggaactccattaaaataaaatgcatttgatattccaaatagttttcatgatagtatggctgaaatatgtacatttaaattatctttaatatagaaaacaaactgatctttctaacttccaagtcaatacacaacttaccatccccacttttagctataactcaaccctagaaaagtactgttagaaatcaaatataaagtaaaaatgagtgtattgggtttcatgttatttagtcaattatagggctaataggcctataagaatttaaattgcattgaaaacttgaagaaatatgacatgcagagattatcctagtagataaaattccttagatggtatgggatagtaatataaatttttagaattatttccatgtttcctactttaagttttacacctaccatacctggagaataggatatgtaggtatttgaagacttaaccacaggaaatgggggcgaggaagacatattttaatttattttttcaatacggtgtctcgctctgttgcccaggctgtagtgcagtggcgcgatctcggctcattgcaacgtccgcctcccaggttcaaacgatcctcgtgcctcaacctcctgagtagctgggactaccagtgcatgccaccatgcccggctattttttgtatttttactagagacgggtttcaccatgtgggccaagctggtctcacactcctgaccttagtgatcttcccaccttggcctcccaaagtgctgggattacaggcatgagccatggcgcccagccagaaagacacattttaaatcttagaaaataagatgcaggaaatcctgttgagaacatagaagcaatcttcatgatgttatacagacctacttctctaatataattctaatagggtttacacatgttaatagtaagagatgtggaacactgtagctgtacttggtatactcctagaggctgacctctataggtaataaatgaaactggaccatggactacttacctaagctacagaacctagagtaaattgaggtggtaggcttgcctgatcagccccaaagaagggtcagagaaattaagtaagactcaactgacaaaatttgttgcaaactccagggacagtaaagtttcttaggaaaaatgagtagtacatcatgcaacagtaacttagtactatagataccactgttcttgcccaggtccatataaaattgagaggaaaggagtctaaataaatcatattttgatatattttccattggaagtaacttgctggtatagaaacttgaaatttgaaacaactacttctgtccagtttgccatttgcaacagctaccaagactttattctcagaagttacaaaaataacaaatggagactaaataaatacacaaataataaaataattaaaatagtaaaaataaagcagcatgtagatttaagattcctgaaaatacacagcctatctgactttttgaagcctgcatttatttcaaaataatacaaggtctttcaccagtaccaaaactgttttgggacagtattctgtgattctcacttcatgaaaaactggctatttcatttcaacaaacacacattacatgtttaccagacataatgcttagggttgagtatacaaagataaaaaaaaccacatgctggctgtttcatcaaatacatagaaacctaaaagaataaagaaacccataaagagatcattttaagaaggggaataaaggacatgatataaactcagagcaggactgcttagccccaatcactagattggtcatcacttttgggatggcataatttctaacataatctttaaatgcaggtaatgagttaagtaagtaaataagtcagagtttatcatgttttagcaacaggaaaagcatgagaaaatatatgcaattataaaataacatgcatatgttgtaggaactatattctatataattgtaacataaacatcaagttatgcatattagtggaaaaggctgtagaagcaggccaagaccacgacacagaggacatgttgtatgccatatggataatcacaatagagccagagacttgctaaatagaagtggaataaggccagttttttcttgtggataaatcactatggcaacattgcggatggtgaatttcaagagtgcaagataaaaagcaaaaggtcatggctcatatttggtattatatttgcatcaagtaaaatagactaacccaagttggactgtgacaaatatgctgaatcttacagagttgaatattttttatccagatgataaaacatataatgtattgaatggcaaaaattccatctatgtagatatatagaaaatgaagaaaatttttgattagacattatattacatagatcggacattagatctgacattctattacagcagccatgtgaattttgcagttacatggttttactgtttctctttgttttctctctttatagtcaggattttacctgagtatctagattatttctcagcttttattttacttaatctatagtgttggcctcctcttaggcctaaactgaactatttcaaatatctgactcctaattgtgcaaccttaaggctgtcagaatcaccccaatgcaggccagaataacgtgtgtgtgtgtgtgtgtgtgtgcgcgcgcgtgcgtgtggtcatctttattcttggcatgcttaaatagattttcataactgttccctcagataacgagcaataatagctctaatgatctctgaaaaaaaggaaacaaaatatcagaagcaaacatttgttttcattattttctcagaggagttttacaatttttatcgcttgagttagacatcatgttgtaaagtgagtgccttagttttagggaagaataattcaagattgactatcaaaacctgaccgtggatatttgctttaaattcttaccaccactgattatcttctttcattccaaagaaaaagaagagaaaaccaaacaattcattactatatggaacttacacctccctctgataagaaatcagttgctcaagcactgaaacaagatctttgcaaatgcattctttttagtatttgaaacttaatcacatcgtatagaaacagaattttatacgtaagtaaagaatactatgatcggttccaagattctccacttattcttggattgattgaagagagaaggaaatacacctactccatacattattatacattaatgaagaaatacacatttccttcaaaagttatactgcacaatctatttaagcctcagttttattttctgtaaatgaatatgaggataataatatcaataacaattgtaataatatctacttccattgttgttgtgaggatcaaatgacagggggtctttagtatatgcctggcacaaggaaacaaggaaacacacaagtcttagcaattacaaataattcatatatatatatatatacatatatatatatatataaaatcactttaaaacaattctaatacatattaatgtatagttatgggagtaatgtgtgtgtgtgtgtatatatatattatttatgcaggacatatctaaaatatatatattcataaatatatgtgcaggacatatcttaatatgtatataaaataaggcttacattgaatgagtcaataaacacagaatgaaagattgctgaacttatggttttactttaaccagatttttaggaattttccactcatgcaattgactaggataatgtatatgaatgtgtatatgtgtgtaagtgttttttaacacctttatgtatatatatattacatatttatatgtaatatatgtaataaatatgtactagacatgtaataaatatgtatatattacatatttagatgtgtcctgcatatatacttaaataaaaatataaatctgcatctatatacacatttaaatgtgtcctgcataaatgtagcaattcacaatgctactgacgtgatcctaccaagcaaacgtttgagtaatccttcttcctctaattgtattcattcagatcaatgcaatcagtcccactcaagtggacgatcatgcaatgattctttacaaaattggtaaatgaaacatcagttttcctagtgacaaaagcttgtatctaagggttttacaaacactgagaaatcaataaatagtgctggaaaagtattgtgaaggatattgttagtttcaaaattaatcatatttagtttaatattgtttaataatactgattagatttttactgtaggttaaatttctgagcgaagcatttctctctcaagactatgttgcccaccacacagttttagaatagcagtatattatgttattattagcctatttattttctactggctgctgcagaaaataaacacctctataatgaccacagtctagatttcagcctgtgtcaaaaggattttgaattatacttcatttttagcttttgctcccaccctttgcacaaagtagaagagacagaacagaaatgttttcctaattgctgttgcaagaaatacttcatctagaaaaaaatgaggaattaatttattttagcaggaaaaaatgaacaataaaaaatacatagagtgaaaagttgtagtcttctaatacctcttttttacttgatgactcaactttttgggaggtttctgggtctaccacctaattatttttactcaaattttattcctggaaggaagatggccatatgcagtaatttatggttcaaaccagaatacttttgagggtgagagcggtattgttaataataatgcagcaggcataaaccggattgctttgggaaaaccagtatatatgatcacctgtatataagggactacaatttcagtacttgacagcatggcaacactctatttagcaatgttttaggtttatttaatggtcacttcccttgccatgtggtaattacatctgctaaaagggtaagaggctgcttgctgtcacaactcaggctattcacatacttaatagacctgaacaaatactcagaagagtttcattgaatagctgtgtgtaccattgagataatctatcatttaacgtttcaaacaaaaatgatatctttcctctgatacttcaagtcattgcaacatatcagtaaaacagcattaaggaagtgttgataacatatcttttgaatgctgataatgtgactaggtctagtgacatctttcatatatttaatctgacaaacatgaacatacaacacttgaaaataagaggacttcttgatttatagggagtatattgtcactatgagttttttcatgccatagatatccattcctagggcaaaacaataaggacaacgtacaaaatcaaatctgctcatgtatcacatggatgaaaactaaggaatcatagaattctgagtaggtatagaccttaaagttcattctattttccaacattttattaaaaataatcacctttataatatccataatttatgagtatatttttctgactataaatgtccaaaaatgtcgataaattcctcaaaagaaagcccagttgaaaatatacaggagtttattcattcaaccttaatttgaaaaactaataaaagttattatttttttaaaccttacttctaatgtcttgaacaatgctgtagagtttactcagattttaaaattataatccttaagtagtgggactaagcaaacctgtattaaaccattttgcaatgtataatatcttctatttctataattatcatggattaacttccagatatgtcataagtaattgtattgagatttgtataatgtttaattgcttctgagttttctgcctttgattatacaaatgaatattacacatccttaaattctgaaatacttacaggtatttctcgtatatacgtagtagtgtaatttgttccctgaggcactcctaaatttgaatgtaaagagtatagaaattactttttccctttacaaggtacaatttaattatcaattcttttcctttacttaatcttcaaagtttcaaaaagggagagacaaagaaaatctattgtcagtagaaaaatgaatatttaaaaaagcagaaaacatcattgggtagttaggctaaaagaaataatctgttctccaagttcaaacaaagcatttcgaaattcattgttttaagcattaatttatattgctaaattttaaaagagatttaaaaaatcataacagctaagacacaacaagcagtagaagagacatatgaagaaatactacactgatggaagagacaatgatgaaaagaacatgtcatttgaagcaggattgtgataaggagagttttgaaaaagtttgagtgctatagaaaatgtctcatatttatagcagaggttagaaagaactcagatgtcaatgcaaataatggaattataggttgatgggtgcaccctgttctccagctggaaaaagtgtagttggggctttgggtgtacaaaactaagggggcagtaatttagttcatatagccacggaaaataacattctaaactagaattggaggctacatttagcaccccctaagatgatgagaagagctaaccaactgggttgaagattggtaccagtttaaactgaaacactagaaagaattaatcatcttatgagttatagcaagattcatgtcctaaattttaattatcataataattttaaacagatggatagtttggataaactttgaacttcactatgcagtaaaacagattttagtattccatgttttaaatagacctgtaagagatgtatgatagaaaacgttggcacagatgaaaattacgaagatagcttttaatttctacctcaaatttttaaaagattatctctttatgccataggtaatgggcatcataaatcactagctgcaaaagcaggtaagtgtgaacattccttcaatgccttggcataaatctagaacagttatttctttagactttatttcatagaattcattcaatttggcatgtgttcatagatgtggctgtttgtaactgaatgaagttaaaacacacacacacacacatacacacacacatacacacacagggcctgatttcaagtttttttacatttaatagtccacattaaagaaaatattcttcaacaaaattaaatttcaaaactccttacatgagtcattgtacaacttaatactgtgaacagacgcacgagaggaatatatttaggtaaataaaacttgtacaggttggagaacaatattctacctttcatagtagcaccgtagtgttgttcaaattgcagctttatgctaattagtgttgttctggctttttaaaacgtttaagaagtaacagtttaaataaattccgaattgattaagtagtcagtattccacagatcatggaagattttagaattctggatatatttccattcatctgtataatcagtgtctgggcaaataatcaatatgtctaaaatcttcatgacgaaacacttaaatatttcctgacaaagctctaagaacattttaatatatctggccatatgcctgtaaggttgtattacattttacaggtatcttatttatttaaaatttgaaaattgcgttttctaaatttactgaatttctttccctagacctgaaaaggcaaaacatgttttatcaaaaaggttaaatcctttcaccacaaactccattttgacttttcccttgataaacattgaagtaatattttattttgctttcacagaagaaccaaatggctcacattaattctgtgtcttatgtttatcaatgaaccaatagattgtgatgaacagaatcaaggctttgaagttgaaagtgtctctgactgatgctacttcacctctgtgagactcagttttcacatcagaaacactggccacgtagcagcccctttattcttcggttatattttctttcacaacttcacagttatacaggacttagaaagaacaatgtcagacagactaaagtgggacactgaactgtaatcagagaaggagatctctttttgagaaaggtgtcagatatcctgtgaagtgaactgtctatcgcaaacatcactggtgtctctaaacagctccaccagtcgcaactaaaagttagcctttttcagcagtgtagagatgagaagagagactgataggtaatatgaaataatagaacttacagcacgtattcagattgtatttgtgtccagtcgcaatgtataggttcatacatgtaaacttcaaacacatatgtacagtttaagcttcactctttatcctcattaggattcaacaaaactgttttgtaaaaaggccttaaacattcaattaatagcagtataatctaattccaatataggaatcataactttcaaaaagatccatttgattcaatttttctaaagtacataataaaagtcatcttataggcttcttacatatcttaggatatcttttagagtcatagtgaattggcttcattaactggtcttgaggtttgggaagttaagttcttcaagcccatggctaatagatttaacattcaagaccatccatttgatatattttcaaacttcacaggactcctgtttttattcccaaactataaccttttgaggtcaaaaataaaactttttaaatcttcatgtattctattcacttaatgttataatttttataacttctatctttgtggtataaacaaatatattcaagtgtgaaaaattttaacatcatgttgtgtggtaaatttatttacattcagttttggggtagaaagtgtattcttaaaaagtttaaaaccaactgttttcatgattaagctaatagaaattattaagcacatatttgtttgccaagagaaatattgagattgctgatactcatttttttttctccaagagtaaactatagtgagttccacaaatgcagtaaatatatctgttttagttcaccactatatttcaagtgcaatgctcggtttagacttaaaataattttccttatgcaaggtaactgactatatagaaattatttgaatagagtttgatttttctatccattaagaaattaccaatatggaaaataaatttccttaagggaaggtggaggcataggcagattgattctgctcaccctccatcttattcccccaagtgtagattggtcttgttaaatcgcccatgcacttgttgcagaaacagtcaaaatggcgggttagaggctgttagcatgcctcagccactcggaaatagcaaaacagtgcataaagattgacactgtgagctttaattcacgaaggaaagtgggaattcaccagaataacaaaggacactccagatccaagggagaagatagtgggcaagccaccccctgatggcgtttggctggtaaaacgatatgggtgcagtggaacattttctttcatggccagacatatctccaggcttttgatgcaccatatctcctgggataggagcttcagttgccattcttttcccacacagacaatttagtacagcagcactccctccacgtcacactcagacatacctccagtcatttggcacacacacgtccacagattagtagtttgagccattcatcccttcccatgcaaagaccttattacagcagcagtttctctgcttttggccagggtatatttgcaggcatttgacacacacattctcttggcttaggaatctgtgctgcccctcccttcaggtgcagagattgtggtacattggtgctctctcttcttgatgcccagacatatctctggaatttggagcactcactcttctaggttatgatttaggccacctcactcttcccatgcagagaacctgaggcagcagaagtttctagaattcatgcctaggcacatctcctggttctcacaggctgcccactgggacccttttcaaagctgatgcatgtgcatgccattgggaaacctgtgggtgggcctgctcagtctggtcccacacatcttggatctttcctaaggaggaaggtgataccactgtgcattccacagatcaacccatggtctgaggcaacagagagcttctcccattaaaaaaggattaggtatatacccacctattttgaccacaggtggctcatacccataagtgacacctactggcctagagtttgaaatgcaaaacacaatagaaaatgatattgattcttcctatccatgagcatggaatgttcttccatttgtttgtatcctctttaatttcattgagcagtggtttgtagttctccttgaagaggtccttcgcgtcccttgtaaggtggattcctagctattttattctctttgaagcaattgtgaatgggagttcactcatgatttggctctctgtttgtctgttattgatatataagaatgcttgtgatttttgtacattgattttgtatcctgagactttgctgaagttgcttatcagcttaaggagattttgggctgagtgaaaatggccataccacccaaggtaaatcatagattcaatgccatccccatcaagctaccaatgactttcttcacagaactggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatataaatcaatggaacagaacagagccctcagaaataaggccgcatatctacaactatctgatctttgacaaacctgagaagaacaagcaatggggaaaggattccctatttaaaaaatggtgctgggaaaactggctagctatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcccaaaagaagatatttatgcagccaaaaaacgcatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggaccataaatcatgctgctataaagacacatgcacacgtatgtttactgcggcactattcataatagcgaagacttggaaccaacccaaatgtccaacaatgataaactggattaagaaaatgtggcacatatacaccatggaatactatgcagccataaaaaatgatgagttcatgtcctttgtagggacacggatgaaattggaaatcatcattctcagtaaaatatcacaaggacaaaaaaccaaacaccgcacagtctcactcatagatgggaattgaacaatgggaacacgtggacacaggagggtgaacatcacactctggggactgttgtggggtgcggggagaggggagggatagcattgggagatatacctaatgctaggtgacgagttagtgggtgcagcgcaccagcatgtcacatgtatacataggtaactaacctgcacattgtgcacatgtaccctaaaacttgaagtataataataataataataaaaagaaaatgagctgacacaagtcaacagacaagtcaacagcagtggggaatgagataggcttcctgagatctccatgattccagtccaataggaagcattgagcctgctcacatgcacagtgcattgctactaaaaataacattcaggaaagccatcatacaaaggctatatgtaaccaaagaacttatacagactctttagccctgaaagcacccagaaccaaagccagaaggaccctacaaatcatacattatagacacctcctgaaggagaaaaattccatccaaattaaaacaaattcaaaaaataaggagagatagcttatctagatgataaagaaccagagaaacaactatgaaagtatgaaaaacagagtgccacaacacttcgaaagatcacactgattcttttttttttttttttttttcttttgagatgaagtctcactctgttgcccaagctggaatgcagtggtacaatctcggctcactgcaacctccacctcctgggttcaagcaattcgattctcctgcctcagcctcccaagtagctggcactacaggcatgcaccaccatgtccagctaatttttgtatttttagtagagacggggtttcactatgttggccaggctggtcttgaactcctgacgtcctgatccacccgcctcagtctcccaaagtgctaggattacaggcatgagccactgcacccggtccacactgattctttaccaatgaatctaaactaaatgaaatctttgaaataccccatgaaaaattaaaaatattgattttaaagaagctcaatgaaatccaagacaaagctgaaaaaaacacaaagaaatcagaagaacaattcagaatattaaaaaagggtagatatcattaaaaaacaaacagaatttctagaaataaaaaattcattaaaataattacaaaatacagttgaaagttttaacagtaggctataccaactggaagaaataacttcagagctggaagacagatcttttcaattaatccagtaagataaaaattaacaaagagtttttttaaaaacttaacaaagcctttgagaaacataggattatgtagtgtccaaacctacaaactgtaagtattccagaggaagatgaagaaaaagtaaaatgtaaggaaaatgaagaaataattcagcaaaactcccatgggattgtcttttttgtgcaaatggtagctatttttattatttccttttttttttaaattttactttaagttctgggatacgagtgcagaatgtgtaggtggttacacagatatatgtgtgccatggtgatttgctgcacttatcaacctgttatctaggttttaagccccacatgcattagctatttgtcctaatgctctccctcacctcagccgccaccccccgactggccccggtgtgtttttttccccttcgtgtgtccatgtgttctcattgttcaattcccacttatgagtgagaatatccagtgtttggttttttgttcctttgttagtttgctgaggatgatggcttccagcatcatccatgttcctccaaatgacatgatctcattctttttatggctgcatagtattccatggtgtgtatgtaccatattttctttatccagtctactattgatgggtatttgggttggttccatgtctttgatattgtaaatagtgtaaatcaaaaccacaatgagataccatctcacaccagtcagagtgatgattattaacaagtcaagaaacaatagatgctggtgaggctgtggagaaataggaaagcttttacactcttggtgggtatgtaaattagttcaaccattgtggaagatagtatggtgattattcaaggatatagaaccagaaatgccatttgaccaagtaatcccattactgggtatatacccaaaggaatataaatcattccactataaagatacatgcacaagcatgtttattgcagcacttggattgtcttgggagaaatttggacatctagatacaaaaggctcagagaattcctagtagataaattggaaaagcctcactaatgcatatagtcatcagaattttcaaagtcaaagtggaaaaaaaaatcctaaaatcagcaagagagaagcatctaatcacctataaagaaaatcgcatcaaactaacaaaagacttttcagcagaaaatctacaagccaaaagagattggaagactatttttagtctcttccaaaaaaaaataccagctaacaattttatatcctgccaaatgaagattcacaaatgaagatgaaatagtctttccaagacaaacgaaaggaattcattactaccagatcaccttacaagaaactttcagtacaactttcttcacaacaaagtttcaatgcaacaaggtttaactatctatcctaaatatatgtgcatccaacaccagaacactctgattcataaaacaaatactactggtcctatgaatagagatagacagttatacaataatagtggaggacttcaacaccctattgacaccactagactgatcactgaagcagaaaatcagcaaagaaacttaacttaaactggactatagaccaagtagacataataggtatttacattacatttcatcctaaaccacagaaaatacattattttatctttggatagagcattctcctaaaccgaccatatgcttagccatccagcaagtctccataattttttaacaataaatcatatcaagtatcttcttggatcacagtggaataaaattagaaattaataccaagagtaattctcaaaactacacaagtaaatggactaaacaacttgcttctgaatgacatttgtgtaagcaacaaaattaaggcagaaatcaggaaagtttttgaagcaattgaaaatacagacacaatatttcaaaagctctgggatacaacaaagaaaagtactaaaggcaaagtttatagtgttaaatgtctacatcaaaaagaatgatctcaaagtaacatccaaattttgcacctcaagcaactagaaaaaggacaaaccagacccaaatctagcagaagaaaaaaaataacaaagattatagtaaaactaaatgagatcaagaccaaataaataacaaaaaggaccaattaacagctagttctttgaaaggataaacaaaattgacagactgctagttaaattaaccaaggaaagaaagagattcaaagaagtacaatgagaagtggtaaaagtgacattaaaactgatactacagaaatacaaaagattataagagactactatgaacacctttatgtgcataatctagaaagcttagagaaaatgcatttctagaaaaacagacaacttcccaagattgaagtaggataaaacagaaatcctaaatagacccataatgactaacaaagttgaatcatcaacaaacatctaccaacaacaaaaagtccaagaacagaaagattcaaagccaaatttcatgagatatacaaagaagagccaatactcattttactgacactatttcaagccatcaaggaggaaagactcctccttctctcttttaacaaaagtggtatcatcttgataacaaaatcgagcgaggcgacaatgtaaaagaaagctactggccaatatccttgatgtgcctaatgcaaaaatcttcaacaaaatactagcaaaccaaatccaacagcacatcaaatatacaatacaccatgatccagtgggtttatccaaatgatgtaaggatggttcaacatacggtaatcaataaatacggtttaccacataaagagaactaaaatagaaaaaacatatgattatctcaagagatgcagaaaattcatctgataaaatcaacacccctttatgatgaaaaccctcaacaaattaaacattgagaaacatacctcaatataataagagccatgtatgacaagtcaacaaccaaaattatgctgaataagggaaagttgaaaacaatctccataagaactggaacaagacaggatgtcaactcttattcttattcaacatagtagtggaagtcacttgtaatgtcatttttaccatttatcattattcttctgggaatttctcttatctcttggttaatttaactagcagtcaattctgtttatccactcaaataactaattgcttgtttagttgatcctttgtgttgtttatttggtcttgatcttatatagttctgctatgatctttgcctgatctttcttcaggcaaaataaagaaaaggcattgcaattgggaccaaaaaaaaaaaaaaatgtcaaattatctctgttaaatgatggcataattgtgtatcagaaaaccctaatgactcccccagaagacctctccacttgataaatgacttcagtaaaatttgaagacacaaaatctgtgtacaaaaatcagtagcatttctatacaccaataacattcaagctgagaaccaaatcaagaatcaatctcatttaaaatagctgcaaaaaataaaataaaatacctagagatacaattaagcaaaatagttaaatatctgtacaagaagaatgacaaacactgatgaaagaaattatacatgacaaaaacaaatggaaaaccatcctatgctcatggattggaagaatcaacatcattaaagtaaacatactgcacaaatcaatctacagattcaatgcaatgcctatcaatttagcaatgttatttcttacataattataaaaaaaaaatcttaatgtttagatggaagcaaaatagatcccaaatagccaaagcaatcctaagcaaaaaggacgaatctagaggaatcacattgtgtgatttcaaattatataatactataagtctatagtaattaagatagcatgctactagtacaaaaatggagacatagatcaatggaacagaaaagataactcagaattaaagcacacacttacaatcagtcgatcttcaaaatgttaacaaaagtaaatagggaggaaagatgctctattcaataaatgatgctgggaaaattggctagccacgtgcagaataatgaaactggaaccatatctctcactgtgtacaaaaatcaagtcaaagtggattaaagacttaaacataagaccagaaactataaaatcctacaagaaaacctagaaaaatctcttctggacatttgccttagcaaataatttataatgatgaccctgaaagtaaatgcaacaaaaacaaaatagacaaatgggtcttaattaaactaaacagcttttgcacaacaaaataaataattaacagattaaacagataacctaaacaatgggagaaaatattttcaaatcatgcttctgacagaagactaatatccagaatctacaagaaactcgaacaactcaacaagaaaaaaaataattccactgaagagtgggcaaaaacacggacatttcttaaaagaagaaatacatacagccaacaaacacataaaaaattgctaaacatcagtaatcatcagagaaatgcaagttaaaatcacaatgagatataatctcacccagtcagaatggttaatattaaaagtcaaaaaacaagagatgttggtgtggatgtcaagaaacggcaattgtttatacactgttggtgagaatgttaatcagttcatcttctattaaaaacagtatgtagatttctcaaagaagtaaaagtagaactaccgttcaacccagcaatctcatccctgagtatctacacaaaggtaaagaaatcactgtaggaaaaaggcatctgcatttgtatgttcaacacaatactactcataataggaaagtaatggaatcaacctaagtgtccaacagcagttgactgaataaggaaaatgtggtgtatacatcatgacaaactgtgcagccattaaaaagaataaaattatgtcctttacagcaacttggatggaactagaggtcattatcctaagtgaactcagaaaataaaatattccatgttctcattcataagtggaaactaaacaagaggtacatatagatgcaaagatggaaataacacacctcagagactcaaaaatgagcgagggtagaaaaagtttgagggttgaaaattacctattggttacaaagctcactatttggctaatggatagagtagaagcccagtccctaaccaatatacaatataattatgtaacaaatatgcatatatacccccgaatctaaaataaaattaaaattaaaaaaagaaattaatattagctgtagagagtagtatatcttcactgaaaagttatatgttaattttgtatggtgcaccagaatatataaaagtatatttacagtacataaaaattgtaacaaaatatatatttccttttaaaatggtttctggaataaacgactcaacagaaaagcaagactaaaggtaaacaagaaagctatatacatataggtttcttatatatgtgtgttagtatacatatatacatatatataattttagattcaggtggcacatatacatatttgttacattattatattgcatagtggtggggattgggcttctactctacccattagccaaatagtacatatatatatagatatagatatagatatagatatataaatagatacacacatgcacacctatgcacacatacatacatatatttaaaaacacagctaatgtataccttacatatatattacatacacatatattttaaaagcatgttcccattagtccgaaacacagaaatggattttatgaatttgtatgccagaataagacatcacattgagttgtagaatattccaacactgtgggttcatgagccattctgaaaaataaattacaccaataatggattccaatactttaaccatttcttgcgaaattttctatatattaatattactaatttgtaaaaatatttacattatagtcacagacactaaaaaccttaaaatcattgaagaaaatgtccattttcttagtaaatgaatgaatatttaaattatacagtaatgagcgaaatttagtaatgaactgaagtttaattcaaaattacaaattagcagcttagatcaggcatgattcctcatgccagtaatcccagcaatttgggagaccaaggtggaaggatcacttgaactcagaagtctgagacgagtctgtgcaacacagtaagacctcatctctacaattgtttatgtttatataaatataattatatatataattatatatatatataattggaaactcatttctctgattaaacaaaggaatgtaattaataaaacactgcaacctcattattcataaagaaatagtctacaatttgtatttcactctaagcaactcatttaggagcttgaaaattttatttttacagttttttaaagcacaaaatgagcacattcaagctaaaactgataaaatgggaataataccatccatgtgagtggctgagcctagtaataatttgcagtaaatattatcacaaaaagttggaactggaattcttgggaaactgttttctgctgaataatttcaagttggaattcagttctggtaaaaaaaaattactgctgatatgcactaacttgattgtcacaggttagcatgtaaatgaagaaagatttaagcaggtacctgtctaaattaatgtaggcagctgttacaagtacatgcattcaaacctcagggcatagctctgcctctctaaaaaggacttgcccaagatcagaatatagaataagagctttacattttatctttatttaaattctccctcccctttttgtggaattgtgagtgagcagcaatactacatgccttttataaccctttctaaaaatatattgaccacagttttactaacagttagaaaattggagtatgatctcaaatatacttaatgaagacacacattccacagaaaaaaattagtttaaatttagtttcctaagaaaataattattattatagagaaactattttgaaaaaggagataagaatttaaaatatttgtaaaataataaagttgattctccagtcatacctcaaaatcagtttcatctttagcacatttctacccatcaggggtgtgtgtgtgtgtgtgtgtgtgtgtgtgtgtgtgtgtgtgtgtatttgaattgacagtgaatagctataaaataaagtggtatgaaacaggaccgaaaatgctagagaaagagaatgatgagagggcacaggtcaaataataaaatgagagatatggaattcagaacttggttttcaatgaagatcatcgagattcacaacaaagtataaatgcaatccaagtaatctaaggaatctagcaaaatgacataagagctgaaagacaaaatattcatttataaaaggaacaaactgatctgatgaagctaaaaagctgactacaaaaattttgaaaaacaatcaaaagcactacacagcagaataggccaagctgaagaaaatctcagagctctaagactggttcttcaggtcaactcattcggattaaaaagaagaaaaaaaaaacagagtaaacaaaataaacaaaatctctgagaaatatgggattatgtaatgagaccaaacctgaaattaatttgcatctctgaaagaaagagagagattgcaagaaacttggaaaatatttttgtgggtattaacattaaccatggaaatgtctccaatattgctagagaggttgacatgaaaactcaggaaagacatttgagaactatactcaaacacttgactagatgagcctaacagatatctatagatttctccaacaaaaaacagcagaatatacattcttcttacctgcacatggtacactaaaatcaaccagatgattttccatgaagcaattctcaacaaattaaaaaaaacacatgcacacaaaatcatatcaaccacattgagaccacagcacaataaaaatagaaatcaatacacgggagatctctcaaaactataccattacatagaaatgaaacaatctgttcttgaatcacttttgggtaaacaatgaaattaaagcagaaaacaagaaattatttgaaactaatgaaacaaagatacaacataccagactctgggacacagctaaagcagtgttaagaggaaagtttctagcactaactgcccacatcaaaaagacagatttcacactaacaacctaacaccacactgacaggaactagaataacaagagcaaaccaatcccatagatagaagaagacaagaaataaccaaaatcagacctgaactgaacaaaactgagatgcatcaaaccatactgaagaccaacaaaaatatgttggttctttgaaacaataagattaatagactggtagctagactagaaaacatgacagaagatccaactaaatacaatgagacgtgacaaaggggatattaccactgatttcaaagaaataaaacaaaccctcagagaatctggtgcagatttctagtcacataaactagaaaaccttgaaggaataaataagttcctggaatcacacaacctcctaagattgaaccagaaagaaattgcaaccctgaatacagcattaatgagttacaaaattgaattagcagtaacaaaccaaccaaccagaataagccctataccagatatatttacagctgaattctacaaagtggcttaacaaaatctggtaccaatcctactgaaactattccaaaaaactgaggagggacttctccctaacttactctatgaggccagcattattctgataccaaaacctggcagaaacatgaaggtaaaagagaacttcaggctaattactgtggtgaatgtagatgcaaaaatcctcaacaaaatactagcaaactgaatccagcagcatatcaaaaagttaatcaaccaaaattatgaaggctttattcctgggatgcaaggttagttccacatttgcaacacaataaaatgattcagcgatccatcgtataaacagaactataaaccaaaccacgtgattatctcaatagacacagaaaagacttttgataaaattcagtgtccctttatggtacacatcctgaacaaagaagacatcattttgaatatacctcaaaatataatagccttctattgactgacccacagagaacatcatactgaatcggcacatgctggaagaattcttcttgagaactggaacaagacaaggatgcccagtttcaccaatcctgttcaacatgatattggaagtcctaaacagaggcataatgcaagaggaagaaataaaatgcatccaaatagagaggtattcaaactatctctgtagacaatgggattctatgcctagaaaaccccatagtccctgcccaaacactcctagaattgataacgtcagcaaagtttcaggatacaaaattaatgcacaaaaattgtagcatttctatacatcaatagtgtccaaggtgagagccaatcaagagcacaattgcattcataatagctgcaaataaataaaatacctagaaaaacagctaactagggaggtgaaaatatttacaattagaattataaaacactgctgaaagaaatcagaaatgaaacaaacaaatggaaatacataccatgctcatggataacaagaatcattatagtaaaaagggcatactgtccaaagctactacaaattcaatgctattccattcaaactaccaatgtcatttttcacataattacaaaaaactattcaaaatttacatgaaaccaaaaagagcctgaatagccaaagcaatcctaaacaaaaacaacaaagttgaaagcatcacactacctgactttaaattatacgacaaggcaataataaccagaacagcatgatactggtacaaaaagaaacatataaatcaatggaacaggttaaagaacacagaaataaagctacacatttataaccatctaatctgggacaaagtcaactaaaacaaccaatgggaaacaactccctattcaataaatgaagctgcagcaactggctagccctatgcagaagactgacactggatcctttcctttcaccacatataaaaatggatttaagacttaaatgaaaaacttaaaactatgaaaattcttgaagaaaatctagaaaatactagacattgtccctggcaaggattttatgactacgactacaaaagcaattgcaataaaaacaaaaattgacaagtgggacctaattataccaaatggcttctgcacagcaaaagaaactatcaacagtgtaaatagagaacctacaaaatgggataaaatatttgtaaactagacttctaacaatggtctaatatccagaacctataaggaattcaaacaattgaacaaccataaaacaaacaaccccattagaaaataagcaaaagaaatgaacagacatttctcaaaagaagacatatatgcagtaaacaacctataaaaacattctcatcatcaataataagagaaatgcatatcaaaaccacaatgagatagtatcttacaacgctcagaatgactattattaaaaagtcaaaaacaaagatcctggcaaggttgcagagaaaagggaatgcttaaacaccgctggtaggagtgcaaatttgttcggccactgtggaaatcagtttggagatttgtcaaagaacttaaaatagaacaatcattcaacccagcaatcttattcctgggtatatatccaaaggaatataaatcattctaccatgaagacacatgcatgcatatgttcactgcagcactacttatagtaacgaagacatggaatcaacctaaatgattatcaatagtggactggataaagaaaatgtcatacatatataccatggaatactacacagccttaaataagaatgaaatcatgtacttttcagcaacgtggatggaactggaggctattatcttcaacaaattaatgcagaaacagaaaaccaaatgccatatattctcacctatacatgggagctaaacattgagtacacatggatacagacaaaggaacaatagacacagggcctacctgagggtagagggtgggagttgaggatcaaaaagctacctattgagtactatgctcattacccaagtgatgaaataatctgtacaccaagcccccatggcatgcaatttaccttgtagaaaacatgcacatgtaccccaaacttaaaataaaagttggaaagaacaaatcataagaaagtaatcaaagtagaacccagatataaatccatgcattcacagccaactattttttgaaaaaggcaccaagaacaggaaatggggaaatgagattttcttcaataaatgatgctgagaaaactggataaccatatgtaaaagaatgaaaatggactcctatttctcaccatatacaaaaatcaaataaaaataaagacttaaatttaaacctgaaactatgaaactattagaagaaaatattgaaaaaatacttaacgacactggtctatgtaaagagttttctttgtgtgtgtaatatctcaaaagcacaggcaaccaaagcaaaatatagacatatgaaattacattaggctaaaaaccttctgcacagaaaagaaaacaatctagaaagtaaagagacagccagagaatggaagaaaatatttgcaaactatccacctggcaagagattaacaaccagaatatataaggagctcaagcaactcaatggcaaaaatagatgaaattaaaaatgggtagaagatctgaaaagacatttttctaaagagacatacaaatggcccacagttgtatgttgaacaatgaaaaattgttcaacatcactagtcttcagtgaaatacaactcaaaagtgcaatgagctattatcttaccatagcttaaattgattttatcaagaagacaaggaataacagatgctggcaaagacgtgaagaaaggagaactttgtacaccgttggtaggaatgcaaattagtgcaaccactatgaaaaaaagtatgacagtttctcaaaaaaattaaaaataaaactactatatgatccagcatttccactattaggtatacattcacaaaaaggcagtatattgaagagatatcttcactcccatgtttattgcagcactatttgctatacccaaattatggaatcaaccaaagtgcccatcaatgaataaagaaaatgtgagatagatatatatatatatatatacacacacacacacacacacacacacacacatatatatatagttgaatattgttaagtcatacaagagaatgaaatcctgtcatttgtagcaacatgatggaacaggaggtcattataagtgaaattagccaggcacagaaagacaaattgcatgttctcactcatatgtgggaactgaacaagtgactatcatgaagataggaatttgattattgggtaccagtggccaggaaaggtagatgggaagggagggtgaagagagtttgaataataggcacaaatatacagtttgagagaagaaataatatctagtgtttgatagatcaatagggtgattatagtttgcaatgattgatagtatatttcaaaatactaagaataatttgaatgtttctagcataaacaataaatatttaatggatatctcaattacactgatttgatatttacaaattatatacatatatgacattatcacatgtaacctgaaaatatgtacatctattatgaatcaatgcaaaaattggaaaaaaaaattaaaaataaaaataaatataccaacaatgctgtgaataaaggtaatcaaagcagcacagtagaatacagagagcatggaatgagaagcagacaaacttaaattcaaattcatattaggagacttctagctaaatgatcgggggcatatcacattaataaaaattattaacctccagagagccagagccagagacagagcaagtcagacacagagaatgaaaaaacatccaaactaccaatatccttatgaaagacgggacatcactatagaacttaaaaataacaaaaatataataaggaaatactgtaacaactctacatttgcaaattcaccaacaaatataaaatggaccagtttccttgaaagacacaagactcactcaagaaaataatggataacctaagacatgtcatatatttagtcaagcaattagatttagacttaaaaattcttccaacaaagaaaaattttgtctggatggactcactggggaattccactaaatgctgaagaaggaattttaacaattctgaacaatcccttccaaaaaatagaagaggaagtaacaactctcacctgattttacaagggagcattgtcctgatactaaagtcagacaaaaacatgatcaagtaaaacaatgaactaatctctctcatgagcatagatgcagaatttcttaacaaattattaacaaattgaatatggcaatatatacaaaacatactacatcacagtcaggtggagcagattccagtaatgagagcctgtttcaacatcagaaattgagtctacataattcttaatattatcagaataaaaagaaaaatcaatagattcagaagaaaagcatttgataaaattcaagatttgtttatgatatacactttcagtaaactataagtacttccttaacctgatagagtttgtctacgaaaacgtacagctaacattataatggcgaaagactgacaaagcaagtatatctcttcctcatcactactatagaacattgttttggaacctagacagtaaaataagacaaagaaaattaataaaatcctccagattggaaagaaagctctctctattaaaaagagaacatgattatctatgtagaaaatatctgaaatctcaaaaatgaaaagaaaataaactttcaagaatagcaaaagaatttagtaagtcacaggatacaaaaatcaactgcatctctgaatgttaacaatgaacatctttaagtcaaaaactgtaaccataccatgtacaatatcataaaacaattagatatttaggttaaattctaacaaagtatatgcatgatctatattcagaaaaatacaaaacacaaaagaaatgaaagaaggcctaagtgatgggtatacatattctgtgttcatgtatttgatgacttattaatgagataaattattcccaaattgattctatacatttccaattgaattcttagcaggatatttttagataccaaaaaactgattataagtttacatagaaaaggaaaataattataatatccaaaacattttgaaaaagaatttatttcaagatctcccactacctgatattcaaacttttttaaagttatagtaatcaggacagtattttattggcaaatgggtagatacacatatgaaaggaataaaataaatagaatataaatagaaccacacaaatgtttattttctgacaaagttgctttaaagacaataataaaaagacttaattttaaataaatagtgccagaaaaattagacctccaaacgtaaaaacaaaaatggaccttcacctgtacttcacattttttatcaaaatcaacagtaaaggatatagatataatatagaatgtaaaatgttaaaactttacaaaaaaaaacaaagaaaatttggaacataagtttaagcagccattttatagaaagaatatcaagagaaaaaacattattaattggactttaacacacttaaaaaaatgctctgccaaaaaacatatttaaaaagtgaaaagactagtcaaagattagaaaaaatatgtatttgtcaatcccctatctgacaaactgtatgcattcaacacagagaaagagcaattatgacacgataataaggaaaatatgtgggcaaagttcagtacaggcactttaccaaagaagaaatatggactgcaactaagcaaatgagaagatgctcaacaacagtcattaggggcatgcaaattgaaaccacattataatatttttttaaaggctaagattacaaagaaaacaaaaccttgttacactaaataccagtgaggaagtagagcaattgacacactcatgcattgctggtgaaaatgcaagataagacaacaactttggaaaatagtctgccagtttttaaaaagtgatcatttaactaccaaatgaccttgcatcaccacccctaggtatttacccaaaacagattaaaacttatgatcactcagaaatctatgcaaatggctatattgcccttattcataatggtgaaaaatggtaagcaatcgaaatgcctttcagctaataaaaagaaaaatgagctctggtaatccatacaacagagtactattgagtggtaaaaaaagaacgaaccaactattgatacctacaatccatgtggatgagtatcaaatggatatcctaactgaaaaaagtcagattcaaagggtcatgcatgatttaatttacatgacattcagtaaaaagcaaaactataagaaagagaaaattttgctacaaagcagcagcatggaagtttctttggggtaatgaaactatttcagtatctttattgtgatggtggttacaagactacatgtttgtcaaatataatatttcataccctaaagtgtgaattttactatataaaattcagttaaaatcattaaactatacatttcaacttattatatgaaaactaaatcataatacaactgacttttaaaaaacatctggtatattaaccactttattatactatccctttatagaaattctcatgttaaatctatatattttatgcatagaaaaatctacaagaaaagatagtctcaaaagtatatttgtccatgaggattttgcttttgaccaatttggttaattctactattttattatttgagtgtcttgaaaaatattctgtgtattttctgtgtcagtcagaatgattgccattctaactggtgtgagatgatatctcatagtggttttgatttgcatttctctgatggccagtgatgatgagcactttttcatgtgttttacactgttggtgggactgtaaactagttcaaccattgtggaagtcagtgtggcgattcctcagggatctagaactagaaataccatttgacccagccatctcattactgggtatatacccaaaggactataaatcatgctactataaagacacacgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaagaaatatactttctgaatgtcaagatctcgactttctttccttaggtcaaactgcattttagagttatccctcttgagcacttagaagctgcaataatcctggcaattggcaaactggagactgaatctaactctgtagcatgtgaccatagacaacagtatcatcacattatttctctaaaaaacagccaccttgctcttgataaatgctgtaattcccattttagtagacaatccttcctttcagaatcaggtttgccatttgattttatcaatcacaagtttcaaatgatcaataatccattagaattattttcaaaaaaatagcttttggaagatgatttcaacatatttctttctctctcacccaccccatcccccaacaaacgcagccctcagtatttataaatgtgccccatgctgctttcttggtcatgctatgaccatcaccagcattacacatgttgttgtacttatcttctttctaagaatacttcaatcatcatttagtacaaaataaaattcatgtttctaacaaaaactcttcttcatctcggcaaaaggagaactctttcctctgcagttgtgtgtagtttttgtatgagtttagtaagatatattagatggtacttcatagtagttacgtaggtctgaatataccttcttctactaggttttaaggttcttaaagacagtatatcagcatttttgagaaagaactttaggcgaaaattcatgtcccatatttttgttaggaactatgattctagagaatagggtgtgagggaaaaggagagtgaggcaggaagcaagcagggtcaatatgacaatgcattactgagctggtcactgatggcatcaggtataacgaatcacttgattttgaaggactgtcttcaaaaaggtcaaataatctctttccaggggggacaaaatcataggccagcttctgtttctctctgaattaaggtttaccagagggagcactaccttcctgtacaaatggattgcacatccatgagtgctacaagggtcccaaagcattacatgcctcagtggcagcactgaattctcacagaagacatgaaagaagcacagaaaggacctgatgttagacctgccgggtgcttcttatgcgaaactggccagaggtcactcatattcgttgctccaggtgctggcgctgacccagtggctatctgccctggatataggtgacactgaaagaacctgaagtggcacataagaggtgtctgattgagcatgcatttgtggtaaagctgtaaccataaagctgaagttcatctttgaatcacccactatactacaaaatggtgtatacatcaattattaaaatacttgctaaataaataagatttctaagaatgtataatggaaaggtaagagtgaatgctcacaatataggtgagcaatcctgcttacagaaaaggtaatgagttagtaaattccaaatgtatgaaattgaaaagagtgttaactactagtgtaagtacaaaattatacaaatactttgctgaaaagtcagggccattttcttattctaattttagtgaaaacagctgtgtgacctctctgggcctcactttttttcatctgtgaagtcaaaagcataaatttgatgacatttaagattttagtcaaactttgaaactgatgtgtttgaagttctgaatctatggcaaataaataattaaatattaatttattaggtatgattgagtacaaattgtgagttaggcacctctccagttcctaagaatacagtaatgaaaaagcagatatgaatactgccctattcgagtttaaatcctaatgtggagagtcacaaagcaaaataaatatctatgcaatatgttagaagtggggaggccagagaactgcattgcatgtttactcgggtggccagggtaggagtcactgaaaagctgagctgaaagatccagccaaatggataatgggggaggagcactctaggccattgtctgagcagggggtgaacttcacatgttctggagaataacgaactctttgacttgagccacatgatagaagttagagactgttatgaggatgatgccaaagagttaagaaggacagatcatgtagcaccctaggacattttgagaaatttgggttttactcagaatgagtcattgaggattttgagcagataaatgtatagcttgatttaggtttataaaaggatcaggatcaaattggctgctatattgagaatagattataatggggcaagtgtgtaaacagagatatggaaataaatagtttccaaaagacacatctagcataatttctgtaaggtaacaatgtggctaaaatgtgttttaatttagtatttttatggtcgtcagggtggttaaaaggttttatttattttaaagtaggtaaaacatgaatttactttacaaacatgtaaaaaacaactaataaaagttctactcaaactatttcaaaaaattgaagtggagggaatacttcaaaactcattctatgaggccagaattaccataccaaaaccagacaaacatgcaataataataataactataatccaatatctcttataaacacagatgcaaaaatcctcaaaaaacactagcaaactgaattcaacaacacaataaaaagatatttcaccatgattaagtgaattcatcccagagacgcaagtatagttaaacatatgctaatcaataaacatgatacatcataacatatgatcatttcaatagatgctgaaaaggcattccataaaatccaactttccttctttaaaaaaaaatttcctttggttattatcttgattaaaaacacctaacaaactaagtataaaagaagtatacctcaaaatagtaagggccacatctaacaaacccacagctaacataatactgaatgggaaaacattgaaagcctttcctctaaggtctgtaacaaggcaaataggctaactttcaccactcttattcaacacagcattggaagttctagacagaggaatgaagcaataaaagtgaataaagaacattgtaaaggaagaagtcaaattgtccttttttgcagatgatatgatcttatatttagaacataaatattgaaaaaaacctaaggattccactagaaaccgttagaactgatccatgaattcagtaaagttgctacaaaatcaacatacaacaattaataacatttctatattccagcagtaaacaatctgaaaaaaatacaagaaagtaattcaatttacacagctaccaaaaacaaacaaacaaacaaaaacccgggaataaatttagccaaaaaagtgcaagatctttactggaaaactggaaaagattgataaaataaattaaaaaggagacaaaaacatggtaagatacctcatgttttgggattggaagaattaacacagttaaaatgttcataccagctaaagtgatctacagattcaatactatccctatcaacataccaatgacattcttcacaaaatcgaaaaaaaaaaaaagctaaaatttgtatggagccacaaaagaccacaaatagccaaagcaatccagaactaaaagaacaaagctatagtatctaaaaaacagcatgatgccgtcatagaaatatacacataagccaatgtaacagaatagagaacccagaaataaatccatgcattttcagccaactcatttcaaaaatggtgccaaggacatatgctgataaacaaatacttttcaatgaatggtgctgggtaaactagatagccacatgcagaacaatgaaaatagactcttacctcttactacatacaaaaatcaaataaaaatggattgcatacttaaacgtaaaacctaaactataaaataactagaagaaaacattggggaaacacttcaggactttggtctagacaaagattttttgggcaagtcctcaaaagcacaggaaagaaaagcagaaatagagaaatgggattacactgagctaaaaatacttctacacagcaaagaaagcaatcaacaaagtgaggagacagtccacagaatgggagaaaatatttgtaaactatccatctgacaaaagggttaataatcagaatacataaggaactcaaataagacaatggtaaaaaacaaataatcaaattttaaaatgggcaaaagatcttaatagatatttttaagagaagatacaccagtaggtatgtgaaaataatgttcaaaatcactagccatggggaacgtaaatataaaccacaatgaaatatcatctcaccccagttaaagtagctataattaaaaagacaacaaataaccaaagctgatgagaatgtagaaaaatgtgaccctcctacattcttggtgggaatgtaaattggtacagccactatggagaacagtatgaaggttctactgaaaactgaaaatagaattagcatatgatccagcaattccattccttggtgtatgtccaaaaaaaggaaatcagaatatccacaaaaaatctgcagtctcgtgttaattgtactactattcacaacagccaagacatgacattaatctacgtccatcagcaaatgaacagattaagaaaatgtagtatatatacaaagtggcgtattaatacattaaaaagaatgctactctgtcatttgcagcaacatggatagaactggaggtcattatgttaattgagctaagccaaatacagaaaaacaaatatcccatgttctcactaatatgcgggagctaaaaaacttggtcttctggagataatgactataacagtggttatcaggggctggcaagggtagggtagaggatggatgaagaaagattggttaatggatacaaaaatatatatagatagaaggcacaatttctagcatttaataacacagcaggagtatagctaacaataacttattgtacatttaaaaatggctagaagatttggaatgttctcaacacaaagaaatgataaatgtgtaagatgatagctaccccaattaccttaatttgatcattacacattgtatgcatgtatcaaaataccatatgtaccacataaatatgtattattatgtaccaatattaaaagaaaaaatataaacagaaatatatttatacattctcttttttatatactaatatttaaaactaaatcatactatatactagtatacaaaaactatatattaatatataaaactaatacatataaaaataaagccatgcatacatatttagtaactaaaaatgtactctttctctttccaagtattatgttgtgtattcctctcaatgccatgaaataagtaatttttcatttacagatgaggtcacatggtcaaggacatatagaaagtgaaaggaaggcttacatattagtgaagcataatcactgatggcagaaaaaaaatgaagaatggggtggtagattcctattactgctattaccaatgactacaaaattgatggtttaaaacaacacaaatgtatcttataattttggaagtcagaagtaaaaaataggtctcactggactaaaatcaaggtattgacagggctgtgttttatctgtaggcttgaggcagaatccatttatttgccttttctagcttcctgagtctggtcacattgcttggctcatggctcatggcccccttctatctttaaaaccagcaatggccacctgagtctttctcaatttgcatcattctgacttctatttctgcttctctcttcgacttcaaaagaccattgtgattatattggacccacctcaacaatccagggtaatgtccttatctcaagtcacttgagtggtaatcctaactcaatcttcaactttaattcccacttaccatgggctataacatattcaacaattgtgaggtataagacattaacacctttgagtggctaatgttctgcctactacaaatggtgagataaatttgaggtgatgggatgctagataagtcttttcctttcctcataacttttgtcagaatctatgtgaatatatatagcagaatatgtaccatcactatttcaaggctatcccatttaatttttgttatgaggtcattgactctttacagaaaacatctaacatgtcagcgctttgtccttattattgtatttatctgtgtggtcatgaaagaagtggtctatgtgggagacttttccaaattatgaatctagaatacccataaatatttagtctcacttattcctacagtgtgtatgggtaagtgtattatttttcataagatgatggctggggaaattgggaatacagaacatgaagacagttaacatacgtgccagcctagttgttacccctcattatattacagactggtaaatgtatctacctaaatggaatgatgatgctactcaagactgaagaaggtagccttagaaaattttctaatgtagatcgttgaatgttgaagaccttgccatgttaagtgatgtagagaaaggtcctagaatactggctttctcctgaagagacaatagatttccactgatgacgtagagtgacacatcctgagtaaggctataaggattgtggagactgactttataccagggtgaagtcgggacatgttctttcttcaaaagcttttctttaaggcctgcattctagaaaggagagacagtcccaagggtactttcctaatgtcatggtacactagctcctgtgttaagttggcagcctggggtgagggaagaagtcttcgtcacaaagaatacattgcccagtaggaaaccactatggaaatttatggacttaagttattcaggaacagtcatattgcatactgagtttcaaatgaccttgtgtagaaatattcatcaatgtcttacaatattcaccataagtctggtaaaagttacaaactggtctttatctaaccgtttgaaaaaagaagggataggtgtccacaacacagtgcggagtgtttaaaagagagccatacaagcactaagaaagccagaagtgagtaaccagcagaaaagtagataaaggttctgatctggatccagatgataaatggaatggcaagtgaaaatcgggatatattttccagaagataaatgttcctggatatcttggaacatcaagtaaattattaagttcttatatataataaagcaagattgtagattcatctttttattcaggcatttgaggaaagtgtgacttcaaggactattgaaatctgagacatatgttctgggtacattaaggagaaggtatagtagtattgaagaatataaaaatatatttaggtctcgtaagtcagcacttctccttacattaactatatgactccttcattgtggattattattccatccaaaatttcctatttagaaggccacatttggttcatgcaaatacgaaaagatgccataatcggagaaaaaagtttggagatcatgaagatgcaaacaggagtatttcttaatactttattaagcttatacgaatacactaaagtacagttttaatttggcttctaagtatactttactctatacaaattaccaccacttgaaagaaaaaaagagagccagagatgaatatatagtttccaacataatatagaggcatagtagcatccttaacatgacatacactgtgctcctaaatactgctcctaaatattaaggataacatgctaaaatttgtctttatccccatgttttgggttataaaatattagatttagaaaaaagaaaaaaaaagaaagtaaaaagaaaccactctaacacaaggaattttattttcataaaacatccatatccatatactttgtaggcagttttcaaaatggctttcagtgatcctcttctcttaatattcatatcctgtcctttcagcttgatagttggcttgagattaatcacacttgagcttaatcacttccaagtctagatgacaaaagcctttgacttttctcttgcacattcttttttgccttcttatttattagccctgtcaaagctgcttctatgttgtgagatgctttatggataacatccatgtggtaaaatagtgaagtaggcctcttgccaaccaccagttaggaataaccatggaggaactgagtcccaccaacagctacttgagtgactataaaagtggacccatcactggttgaaccttgggataactatagcccaattgacaccttgattttagccttgtgagatattcagaaacagaggatgcaactaagcattgttttaatttctgacccatggaaactgagataataaatgtttgctgctttatccagtaagattttgaataatctgttaaacaaataaatagtacacatacatatacaaacttgcaagataaaacataactttagaggaaaaaaagaaatcaagcaagaactagatacagttaacataaacaaaactcatcatatttcattacagcatgtggaaattgtgaagtatctttttcttatatatgttaattactcagtaaaaaattagagtatcgctgaaatctgtataccaaagttgaaaaagacaaagaaaacttatagaatgtatgggaggtggtgaaaagataattaaaagattcaaaatcaaaatttatataacagaatttgtattttaagaaaaatgtaaagtgttacaaaaagtatgtctccttctctggcagtaattatcctatttgctataatataataaataggttttgagtaactgttttgtggccgatttaagcagcaatccacgtaaacagacacctggatttccttcagtaagggagcaggaaatgacaattacattcttcagcaaaaacattttatctttgtttacagacattttgtgtgtgtgtgtgtgtgaatgtttctcacaaattgcaaaggccccccaccagtcttaacaaagaatttatttgaccattaactatatttcatgcgtaacatatattttatgacatgaattatattttgaatttagatttttacattttgttaattactacttcacaagaaggggaaaaataaaaaatcttcaaaaagcaattatagctcaatgatttaaatcaattcaccgggttatggttgtggcagataataaaaaattaaattcttcttccaaagctaagttgattactctgagtacctacctgtgttcttccaaaattttataaattacgtgtgattggagctcagatgaaatttagattgctgattgactttaactataggaaaaactattcaaagaaaagattaaatgagaaccaaatccttttatatacacacagaaaaaaaaacatgaaagtgaaagtgatctaatcagaagtattacaaaaaatagacaagaagaaccaacagttatacgatctctctgataatggtaaattctctctttaagtaggcatgttgctattgatgtatgctgaatgagtgtgttttagttttccaacatagcaaatctgacagtgaacttgaaatcagttagactggtaaggggtttctggctggattccacataatgctgttggctcatgggatttccttggtctagccaggtttagaaacagtttttaatcagttaatactggatttattatgttaaagaatgggggagggtaaaactcactgattcagaaactggataatatataagtgtataatataaaattaatctgcagcgaaggccagagtgctttcaaatataagccagtacatttctttaacagtttccaaatgtctgggaattttaatcactaattatagcattaagtgagccaagaattttagaaaagaatatacttttattagatattttcttgaagatatggcagtctaacaaggaacaattttagataataggaaaacttattggaatagtagtcaaaatctccttcctgaactgtgagataaatacttaaaaatttactaaatccttcattcataaataattcttattttccacctattaatttgttaggtgattgaatgttatcttgcactcttatgtacaatagggtttctcaagcacagcactattcgcattttgggccagatgacaccttgttgtgggggtgtcctatgaattttaggatgtttaacagcatcctggcctttctccacctgctggatgatttgcgccctcccagttgtgacagccaaaaatgtttctaagcactgtcaaatgtccttttgggggcaaaataattgtctgttaagatatactgctcaaaaagaaagaggggaggagagcaggtagtggcgatggttaatgggtacaaacatacagttagatgaatggataagatctagtattcatagcaagaaagagtgactacagtctgcaataatttgttcacattttaaaataaccaaaagagtataagtggattgtttgtaacagaaagaaaggataagtgcttgaggtggtgattaccccatttaccctgatgtgattatcatgcattttatgtctgtatcaaaatatcttatgtaccccataaatatattcacctattatgtatccacaaaaattaaaaattaatgaaaggtttctatgactcatgtgcaaatataattataatcttagtggtcacaaccagtatatatatttttatccttcttgtgtcagggttccccaggaccactctaaagtttgatgatatacatattcacaactatggtttattacagcgaaaggctacacagcaaaatcagcaaagggaaaaggcttatggggcaaagtccagcggacaccacgtacaagtttccaagaaacctctcccattcgagtcgcacagatgagagtacagatggtccccaacttacaattttttgactttacattgggtttatcagagtattataggcatttgtgacttacaatattttcaacttacaatggttttataaggtgtaacaccactgtaggtcaagaaacatctgtgattcatagcaatgagttgtaacaccagttgtggaatgtcctctagataagttcattagagacttaatgctaactgcttagcacataccacatttccagactttcagaaataaagcaattgtttagaaaaaccatcattgtttttacaaactgtttaggtactacacaccatgcttatcagttagggaatgacgagatccctttcagaaatccaagttcccagacaccagccactggtcaactttgcaaaaagatcattctaatcacagcagtctcaggtctgttatgttaaccctttctctatgctttcctacaaaatgttttgtgacatgtcagctgcattttaggcacccaaagacttatacaataaataggtgaactaattaatcaaccagtgatgttttcagttagaattccttaaatgtctctattgacacgtttgttcctaaggactcttacacctacaaagaggaaaatgttccacataataaagcataactacagttttataatagaggaaaattttagttaatcaaattgtaccagcattaacctgcatttccagaaaagtcttcaaacaactcaagatccaatgggaggaactcattttcagtgaaaagaaaatgatgtatggtaatattctggtcgatgtaactttcaaatgcaaccactaagagaaagaggaatttaaatttcttgaatctaagactccatgaataaccattttctgtcaaggagccaatattatttttaaaaataaaatcactcaatggttacatttttttttttttttttgagacggagtctcgctctgtagcccaagctggagtgcagtggcgtgatctccgctcactgcaagctccgcctccagggttcacgccattctcctgcctcagcctccagagtagctgggactacaggcgcccgccaccacgcccggctaattttttgtatttttagtagacacggggttttactgtgttagccaggttggtctcgatctcctgacctcgtgatccacccgcccccgcctcccaaagtgctggaattacaaggcgtgagccaccgcgcccgaccactcaatggttacattcttatttgagatatggagttgtctagagcccttcactcaagacgatctgctttagattaataggatgctttgagaaaataaacttcatgttacttttgagaaaatatgatgcacattaattttatgataattaatgttgaaacacctcccataaccacacatccctcttttatacacgggataaaattgttagtttagattttattacttaattattgtctggtcatcaccccttatcccctcctgaatatttaatgagaccaaggtccgtgctcttttttaattcacatttgtctctccaggaccttgcataggatgtagtaaagagtatttaacaagaatctgttaaaatgatttttttgaaaaagctcagagagataactgtccataccccatgtgtccccacggtatattcgatctttattttgaaggcaaacactatattttaaaaatcaaaatctaataaagataaagcaccatccctttacaggattgatttctttgattgtaaagtgtgcgaaaaaagggtttccggtgcactctgacaccattcataaaatcctaaccaggacctggtaaggccttagtttgtcaacactgtaccagaaatctctaatataaacaggctcatattataatcttctgcatttgtaatttttgagaacagggtggaaaagcactcatttaagtggaggatttttcttttaaatgctgtacttgagaatgtatcattattccagatgagacagataagacgcgttgctcccttgccctggcagtggatttgtttgtatattatgctttctaactctctttctttgctgagctagctattttatgtttctttgtgaatgactgtaccttaagggaactatattctgtatccattattttataaaggtgagtgggctcagtaaatgcctgaaaaagtaccttgactaagatcacagagttaacataataaacctgatagtgctgtaggaagaaagacctagttaggtgtggagtaaaacttagccttataattcccaggccaaagtgtttccaccatcaccaaatcagcgtcagtaactaatcaaataacaatttatttaagccattaaaaaatgtaatgctttcactgcaatgtgaacatatatttaaacatgatgacgatttgtaaaaacaaagatttttagaactaagaagaaatatatattacaaagtagttagtattaaataaactgtttcctggatcctgaatgatgataaaagtttaccccattaacactagggagcatattcaaagaatccaaaattctagcaattctttggtttagtagaagccacaagaagataatttatatctgaaattctgtaatattacagcatcccagttccttttgtgaaacccagagttccatttactcattcgaatggctatacttttttagaatctcttcaaatttgttccatacatactttttagatatgaactaaaattaggcagagtaatatagttttctcctcaatatggaattgaaaaaagaaatactccagttacattttccagctgagtactttggcttattattggatttgattttacctttaacagtgatacaaaggcaaatgcaattgacaaagttaaatatgtggtagcagagtttgaagtttaaaaccctacgtgcttgcttgcttgcttggttttgcttttgttttcttgagcaattgttgactactcagcctgctctgtaaagttaagagcatagactctggagtatcagatgtagattagaattctatttttgccactacctatatttatgaattaaaacttttttttaacttccctgatctcagttttctcatactttaaaagaaatttatgtgtagacaaggaggggtcttactactctcattagcaataaataatattattacttcattgtcaagtttcctactacctaggtacatgaagcgcccttgctctgtctctctttctctctttctctcctctctttcttccagtttcctttatttaacagcaagttaaaaatgcagttggagaaatcaatttattattctcaaacaatttattttacatttataaaaccgtagagatggcttatattgtttatgtgacattgtttatccacaggataaaagaaaaagagttaaacagtaaataattaaaattgttagtttatccacaggataaaagaaaaagagttaaacagtaaataattaactcccacagctatagtcattcctctttaaaaactctagtcaactaaccaaaggaaacacctttttggtgaatacaggtaagttagggcaaagttttggtagtgaaattgtaaagaatcgattactactgtgatgaatcaaatcataaagaatttaacttcactgtactatacaatctattttcaagttgaaagttagttaaaaatgtttcactttattttctttgaagacaataagttggaggcaattcaaacattttattatgaattatcaactaagtttatttaaataatgaatttatctttatgcttaatgcaaattgcatatacattgtattcaaaataaaatgcaaataccaaagaaaaattgttttctaaaataatgttacaagtttatatttgtttcacagtaaattatttttaaatttttgtcagtttacaaacaaaagattgcttaacaattgcaagcagcaaatttaccaatatataaaattcaaaatgttcttccaaacacaaatataattaagcagcaataaaagcttagtatatgaactttattaatagtggttatatctagtttgtagttgccaagaagtaccagctttacatgcactggcaacagtaataaacaatttatggctttctaataaacagatacgtgttaaaagcacatttaaaagaaataccagaagagtttataacatttagcgagcatatggtctctataaagtagtaaattaagtactttataaaactgttagtattaatactatattacaatattttatatttgtgctgcatagttttcaaagtatcatttagaaggattctaatatttttagaacttatttattcttcccaactttgccagataagatttatctctactatgttgaagaattaaaactgagactcaagatggttaaaattttgactgacgtatttcaccacttggtaggagggccaggactcataattaggtttgtgtaattctaagtcaatgattgttccagtttatcttgctgttgctcaaacaggtgtgcttttaaatttgcttataaaatatgcacaaacagatggcacctgctaaatacataactggcaataatatcttgatattttcaaatactcaagagtaatctagcacaaagagctcagaaatttgcaacacaatatattgcacccagaaaaaacccttaaaaccgtctagttcaatcatctatgttagagaaaaattggacaaatagaattaaatgtctagccaatttactatctagaaaatttcaaagttcagactcaaaaatcacttctttgaatccatttctagagctttctgtgttacatcaagaaaacagatttttttccaaatgtttatgtttctttgtccaatctaaaggatgaaagatactaattctctgtaatacataagaagaaaagagaattagacagtatctttatcaagtcccatcagattagcaacaaatttacaaaagtgatgttataaaactttttgactaaaaggctttcccaatattataaaaagggtatcacattatactgccatttaatgctattaagaaaacattacctactacaaataaatcttaccgtcatgtttctcaatctattataattaataaaatattaggaaaagacttgttttattgtgaaaatgttattcaatatattttattccagataaatggatattaaaggatatttatagtactttcaatttgttctgaaagctacatctgtattatcaggaatatgtataagcactaaacattgttgcagaatttgtctaaggctaacaccattttcaacaccatgaagaataaaacaggccgggcgcggtggctcacgcctgtaatcccagcactttgggaggccgaggcggacagatcatgaagtcaggagatggagaccatcctggctaacatggtgaaaccccgtctctactaaaaattacaaaaaattagccgggcgtggtggcgggcgcctgtagtcccagctactctggaggctgaggcaggagaatggcgtgaacccgggaggcagagcttgcagtgagctgagatcacgccactgcactccagcctgggtgacagaacgagactccgtctcaaaaaaaaaaaaaaacaaaaaacaaaaaacaaaaaacaaacaaacaaacaaacaaaaaaaaacaataaaacaattttcctatatgtcagaaaaaacttctttacagcttttatgaagtgtataaatccctgcatgaatatattcaactcagtgactctattacattctttgatgtccctcatgtttctaaaaaaaatgatgccgagtgtatctttaggatttgaaagcaatgaaagtatataaagccaactgacaggacctcacttatttcctgctggtttatcagccgtcaggaaggatttgcactcaaactcttccacctttccccccttgttatcaatggcatacatggagccacaggaagagtaacgcatagtgtggccatctaaaacagggtaaaattcagacagtcttatagaaataaagtcacaaatgaggttcgaaaataattaccaacagacacaaaagaagaatctttaaaactccatgatctaaatatatattgacaatataattctatgccaatgagtagttttgaattcagcaccatatactgactgcctatttatcacatactaaagatacaaataagtaaggagttacccacatataaatattccatcaatgtttgcacatccatggtatatattataaagatacatctagcaccagaggatgttgggtgctatggaataagaaaatagagacgtgatttttttttttattttcgagacagggtctctgtcacccaggctggggggcagtggcctgatctctgctcaccgaaacctctgcctcccaggttcaagtgattctggtgcctcagcctcctgagcagctggaattacaggcgcatacaccatgcccagctaactttttgtatttttagcagagacggggtttcaccatgctgcccaggctggtctcgaactcctgacctcaagctatctgtccacctcggcctctaaagggctgggattacaggcgtgagccaccaggtccggcagaggcatgaattaaaaacaaacaaacaaacaaaaaaaaaaacttaaattacattctcaccccatcaacttatttgatcttaccaagtcatttcatctctatcttccattttttaaccacagtgtaaaaacatttgacttttcttcccactatattgttgtaagtataaaatgccacaatatatgtgaaaatggtctgaaaatcctaaagcacttctatattgctctatatacactagagcaagaagaggttaaatggtttcccctggtagcaccttcctgagcacagaaaggtgacctcggcaccagggtgtactggctcacttccctaaatctggaatgtaatctgaagagtattacccaaatcctttttctattgttttttttttgttgttgtttttttgtttgtttgtgtttttttttttttttttgagactgaatctcgctctgttgcccaggctggagtgcagtggcgccgccaccacggccggctgattttttttttttattattattattttttatttttagtagagacagggtttcaccgtgttagccaggatggtctcgatctcctgacctcgtgatccacccgtctcatcctcccaaagtgctgggattacaggcgtgagccaccgcgcccggctccccaaatctttactgccaagaaaagtgacaggtttagtaatttcatagtggtttggataatttggctttcaaatttcctttagattagttcctttagattataacattgctaacactataaaactctagtttgagtgaaattcttgtggattcagatactgcaatcaacgaacattgagccaaggatgaattggtgctattcctggtcaattctctttggcaaataaagatagactcgttccatgattgaaagctacataaaaaatatctaatatcactacatatcaaatataatttaaaatataaaatcaaaattaagtccttattaagccttggtagattaagaaaatacaccattaatatgccgacacacatctaattattaaattaaggaaaatttttgtatcaatttttgattggtaatacagaaataaattttcactacaaagaaattttgaataagtattgacactgatataaagtacatcatttaattattatcattattttttcaaattttagttatatttagaagattagattaccttagattccaattcaaagactatatcccatatgattatttcagcttttttcagaatgcattatttaaaaaacaaaacgtttatggacataaccaattataatgtgctgctgctcacaaaacaattgattataaacatgccagaaaaaatgacacaagtcgcatatgtgttctttccagattcaagctattatcttctaaatattctaagtagatagtagattaagataatttatttgccatgtttttcacacttagagtttttctttcttttttttttttttttttttttttgggagacagactcactctgtcacccaggctgaagtgcaatggcacgatcttggctcactgcaacctctgtctcttaggttcaagcgattctcctgcctcagcctcccagtcccttgccatcacacctggcttattttgtattttcagtagagacagggttttgccatgttggccaggctggtctcgaactcctgacttcaggtgatgcacctgcctcggcctcccaaaatgctgggattacagccttcagccactgcacccagccaggtttccctttatgcagaaagcagcttgcaggcaatgctaatattggtttaattttcttaggaggaacccagtatagtacgggaaataattaatataatttgttcttaaaaatatagcttagtattgtattaatttttctagagactgagccaaatcaagtttattccaactaaaatactgcaaacatttacttaagctaatatgtcttattcttaaaatgcttaagggtgcagctctagaattatatttcttagtcacaccttactgcaaattatattaattggagaataaatttatttataatcctagacacgttttaggaagagaatttgaatggaataaacagggaagagaaagatacatcttcttatgataaaataaagatactagagatctttatgacacaatagtaaacatatatatgaattatgaattaatctaatcatgctcatacataaagatctaactgtgtatttttcattttaaatcagttaaattagttacataatctactgtataagattaataaaaatgaactaaaaatatctgttggctcatcagaataatgcagcacttttttcattgggttattaaggataatatttataataataagtgcatacaaagttcttattacagtgcgtagagcacaatggatgctaactggatgttactttctctctctctatcgtgtaaacaccatgagacaaggcgcggtagctcatacctgtaatcccagcactttggcagcgggtggatcacctgaggtcaggagttcaagaccagcctgaccaatatggtgaaacccccgtctctactaaaaacacacacacacacacacacacacacacacacacacacacaaaattagctgggcatggtggcaggtgcctgtaatcccagctactcaggaggctgaggcaggagaatagtttgagcccgggaggcagagtttgcagtgagccgagatcacgccattgcactccagcctgggtgacagagacagactctgtctcaaaaaaataaaaaagtaaaaaataaaaacaaaaaatagtaaataccatgagtgcaaaaagaaaagctatcttattactgacgtgtccctatcctttatatagtgtccattacgtaataagagcccatcagtcatttttttcaatatgtaaatacggagaaatatcttgactacagtgcaggactccatgtttgtttggctctctgctcaaattagacttttcttccatcaatatagaataagccatgcatagacatagtttctattaaaaatctgtaccctaatgagtagaatgggctcacacagatcttggaaaaatacatttagtaggcttggtgaaactgtaatggctttgtacagaactccactgcaacccacctgacaaactaggatatgctaaacaaaccagtcatttatgtgagcgtgtgtatgtgtatgtgtctttctgtctgtctgtctgtatgtatgtgaaagagagagagagagagagagagaaactatggatacttcctttataaattctggctttgccttgccttagaacaggacaacagacttcacaatttttctacatatatgcaaataaattctcggcactttaactgtctttgagttacactttgatacatccacagtgcaatttatgtcaataaaaatgaaattcctaagtaggagggagctgtgtcttaacgtgattagtatttggacttcctattattgtatttgaagacagaggatgcttggctttatgaagcaagctcccaattggattaccatatgtctcaaaaaacatgatagtaaatgtcttttgatagcatgagatataaaggagaaatataaaaatttgctttatgaatgttctgcttccagccggggtatattcagttgtagttaagatagttgtgttctattagctggggacaatttgtaactgtccttattagaaacatacatgtgtatgccaaactgctaagaaatgagaaatttctgtctatatcacctgtttttggcttgctcagaattctaccttttttttttttttttttttttttgagacggagtttcgctctgtcgcccaggctggagcgcagtggcgcgatctcgactcactgcaagctccgcctcccgggttcacgccattctcctgcctcagcctcccgagtagctgggactacaggcgcgcgccaccatgcccggctaatttttgtatttttagtagagacggggtttcaccgtgtcagccaggatggtctcgatctcctgacctcgtgatccgcccgtctcggcctcccaaagtgctgggattacaggcgtgagccaccgcgcccggccaattctaccttcttaaaaattggctttcctttagaaaactacttcatttgccttctttatggtagtcacagtgctatgcccaccaacaatgacaagtaagagacctaaataagaccaattagattattccttaaagttttatttatgccgagagagagacagagagagagagaagggctcctttccttagtaattgcaattatgaatttaggttgagttgtcagcagccttaatatatagctgcatggacaaatattgactgagagttaaagccaaacatcatgggatgcaagcaaaaggcatcaaaagaaacagattcctcaggaggtcttattgggtctctgaatacagccatgcctgaaaaactcactgtaagacccttcattgctttatattatttgagctgcttttctttcccttgtaatcaaaggaccactgacaaatactggctaagtagaatattaataagaatatacacgaaaaagaaaaacatgaatatgcttttggtataaatttacctaaaatattttaacatgcaaattagataccatgtagtttgttaactttaatagttcctcaaattaaaatgttttagtatgtaaatacagatggtttccaactttaaatggttcgacttataattttttatttgattgtgatgtgaaagccatactaattcagtagaaatgtttcatcaaattttgaattgtgatattttccaggctattaatgtatggtaaaatactctctcatgatgctaggctgcagaccccagccagccacaagatcatgagtgtaaataagtgatactctacagtgtattgtgttgctgacgctttttggatattgtcttttcacatcccatcatgtttacaaaatggcatttttgacttacagtgttgtaaatgtatgatgtgtttatcaggccacaactccatcataaatcgagcagcctctatatacacaatatgtatataattttgagtatctcttcatattaatgtaaagttttattttacacttcatttgtggctacttttttcctttaaataaaggcaatgaaaccagatcaatgagagtacttgaattaattctagttgtagaaaagcttggatgatacccttacaaaggaaacccaaataaaaacctaaccaattgaacttttgggttgtgtttggaactatctcttttcaatgaattaacatgtgttatgtgtttatgatgacaaatattagactatattctttaaggcttatcatcagcaaagactttccgggttataggacttctctttatgatttcatctttccaatttttctgacttatgcctgtattttcttttatctttgcctcctataggtctggcttcttctgtcctctcatttcctggtctcctactgactcgcctcttatctctatggcatgtgaccttgggcatgtctttcagtgcctgtcattcttcttatacttcacttcctgtctctgccttccctccccctccatcttactacttctcagcatccttatatacaggtgaaataaaatcacttaaaattatcaattagatttctagtaggaaattgaaaagtactatcatcattttctttataataaagaatgtgacatgatatttaaagaaaattatttttagaagtgttcaattccacttgaacactaccgggcaaacacctaaattttcctttgttcaggttgcaaaatgtgagcatttcctaaatttgctgtgaaccctcaggaataaagcaaaaaacaattttcaaaataaaaatgaacaatttaatagatttaaatatgaatgtttcctaaaaaggatatattaataaagttctgtactaatatatataaatcctaaataaatttccatttcaatacttccttttgatatttctgtcttctctctcttgatatagaaacaacctgcatgtatgcagttcagttccttaggcatatatgattcattcatcttaatttagaaaatatcaaggccatgcctgggagcagaattggggcattatttgtctttcggcagcgtatttttaaaattgttatgaataagtaaattgacaaaatcctttctaagatgtacagacattttcaatcaataatgcacactatcaggacataaaatcttccctaactttttgagaaatctttacgttttctttagggaatagattcacacttaggttttatcacctatcctacactgacgtttgggggctgaactttttgaggtaatgggtgcctctgtacagctgcaacccagaatgattctttcactactatgccctgagcaaaaacagtcttgggttacaggagtgaattagtgccttctcctgtttcctgcaccctttatttcatgaccttatcccatgtatagggcgagtaagagtagtcagttcatactgatctcagcagatagcgatataaacagatacttggctcatagggcataacttacatttactaagaaaatgctcaaaaccattcattgaagtttttctatacagactttcaggaattttaatgagtacttgcttataaaatgttgacaaccttaatcataaagtggtaaaaactaatatgcaatgtatcaagggaacaatacctccaactgttttcccagaatatactttacaaattaccaaagcagataactgaccacatttcctttttaatttacctcactagttctttgaagttctattcaccattagctctttgaataactgttttaaaacagatgggatgaacatctggataacacaacatatatattttttttatcaattgcctcactgatgtgaggaacatctcctcccacacacaccaccctgtgcctcatctaatgtgttaacactttggataatgagaacaacagaagtggatactaaatatcttattcaaattaactcaaatctgagtgcaaatgtggaagtatccatgcaattcacgaactgctgccccagactgtgtttttaacagcagtgtttgatgatgttggcactcttgatcattttctgtttttgaagttactgagttcaatgatccatcctttgtgtttatttatcaggactgtgaacatcacaaacaatttgagatgtttagaattaaatgttgattttagctggcagaaaaaatgcaaagttaggtaaattgatgagcatcattttcatgtatatattatctctttgttaacagttatctttcccagacataatggaaatggctgaggagtatgggtaaactgaagtatctgagttcaaatttatgcatgttaagatagaataataaacatgctactcttctgtgcagaaattcaatgccaaactaattcatgaaatactgtacaatactatacaatacaatatagttcaactatattggctcgaatcaatataactggtagtttaagtcactggtagttcaaagaaagaccaactagattctgagcctcaaacagcattattagggacttgcctgcctctttgtctggcttcctctacgatggcttacttttcaggctgggtttcttaataatgttggtaaatatgatcacaacaagctctaaaattctacactccttgcctttctgcctgaatcttgcccccccaaaaataatttatttcaggcacttccagtccaaattttaaaactgatactaattttgtgtagtttgggtcatgtttatgacctactaattagtcacagttgccaagaaaccgaatgacctaggtaatatgctcaactctgaagctaggctatcaggttttgaaaccaatggattaagaacaggtaagtagctgggcgcagtggttcatgcctgtaattccagaacttgcgggggccaagacaggtggatcacttgaggtcaggagtttgagacccgcctggccaacatgggggaaaccctgtctctacccaaaatacaaaaattagcctggcgtggtgatacacatttgtaatccaagctactcgggaggctgagacaggaaaatcgcttgaacctgggaggtggaggttgcagtgagccgagatcatgccactgcactccagcctgggcaacatagcgagactctgtctcaaaaacaaaacaaaacaaaacaaaacaaaacaaaacaaaacaaaacaaaacagttaaggggtaattctccaaaggaaaactatcattattttatcaaactaatgaaggaagcatgctggtcagtcaaaccaacctgtgtctataatcaaagtgcaagctttgcagaggagcttttaatacataactgaaatattattcataagtaattggagtattctggggaatagatattagtaaaagttaaggaaatagaatgacaacaagtgataacaacatatatatatgtatatgtatctcctaacattagtctaaacatagagtccataccactgacagcaggcactggacatggttagaggaccattctccttaccataaagtgagaactcagatatactctccaactaatttaaccttgaatcacattttacctatgtatgagctatagcataatgtcagagcatattaatcataaccatatagcaagaatattacagattaaaattgtcatagcttatttttcttgtcttataagaaatgctaattagggtgaaattcatgttataaaagtatttacatataaatacttcaagaaaaaatttgctggagatattagcagaacatgtcgtacttaaaaaaatgcaagaatttggtctaggctgggttgaatatgtttaggaaaacacagtcttttgaagaaaaagtagattgcaatatctcaaataataactagtgacaatgaagaaaataaagtgttcttatgaacataagagttgatatttgtaacttttatggcatagctgatgaatcattcagtaaaaccaaatgaaacaaataccttcaatctctcaaatcaaacaccatactattgagattttagctataactttatgtttgtcttgtttgaaaaaatacttcaaaaccccaaaatattttttgttaaaccatcttacatggttaaaacattccttttagagtaaacacttatgaaattcttaagcattgtaacttcatcattctaaaggattaaaatgtttattttaaattgaacatttatgaaatgcttaagcattttagctagccttttttaaagtgcaatcataaaaacaatggttttataatgaaagaaatatttcataattgcattcatacatttgaactgtttatacatgtggcaataaaatgaaatacaattgtgaaacacatattttatataaagtatagttgccaatgtttttgttttcttgaaataatctttttattctttttcgcttttaaagcataagtttgtgtcacaatttaaattcattctagaaacttgcagttaatccctgattacttgtcatgattagatattcagctaaggtatacatcacagaccatctgtgagaggacactatttcatttgtcttctgggtaatagggaggctcattttgaggatgaacccaccctgctcttttgtgaaagcaggagagtgccaggtggttggtagagataaacacaaagggtaataccggggaaaaagaaacgcagggctttcccagcaaacctttacaatattggtgcactacaacaggtggaaaacagtgagatgtcatatatgtgtgcaaagccagaacacatttcacaatttgtagctcagattccatgagacactaagaatacagatgttaggaagtttcaaatttcaataagggtagaatgtaataccaccttgaaaataccctttctcaactgcatgtacttatattgctaactggagaaaataactctggagagtaatcatggaactgtgtggagtttatttggttaatgggaccaaacatacagttaggtagaagaaataagttctagagttcaatagcacactctaaggtgactagttactaattcattgtatatgtcaatatagctaaaagagaatatttgaaatgttcccaaaacaaataaataataaatctttgtggtgatggacaacctaaatatggtgaattgatttttacgtgtggtatgcatgtatcaaaatatcacatttactttttatggatacataagagttgtactatataaatatatatatatatagtatataaatatactatataaatatgtacaactcttatgtatccattaaatgtaaatacatgaatagattaacaaatagaacaagaaaaaatgattagtacagaatatttagcctttttctaagtttcatgagaaatctgcagatttcctagggaaacttatgatagcctattaacatgcaaatataacgtattagatctaatttttaaaagtaaaaagggatttttttaatcgactcgaagaagaaaaagatcttttaccatggttttcttgtcctgggctcaacatgtaatgatgaaagcaaactagaatagaaagtaaggcaaagaaaaataaatatatatttttttcagtggtctctaaatgtcttataaactttgttatgtctcttgtctagctttattccaggcacaaactgatcaaaaattggttcactgaatgagcttgccatatcagatatagaaattttgagatttgctaattcaaagtacaagaacacagtaaatagtaagagaatacatgagcctgtgagtatattaaattcactggcatgttttttcatctatttccctttagaatctattacaaaacctagagaaatgtgactcctatgaaccactgttatgcaaaggtgtgccagattcattgtgtttagggtagaaaatatagctgggagtaagaaaataaaaaataaagattttaattccaagaatgccccaaactaagtaaatgatgtattaccaaatttttattgctgcataaaatacctctttgtgacaacccagtttacaggcaatttcagtgttgactattagagaactattaagctgagaaggtcatgtagcatagggtaaacctcatgacctcatctgttagaacatgtgttgatacgatagaccaaggaaaaaatatgctctgagtaagaggtaagcatgcaggatcaattcaaaatggtcccagatgaagatgccttctgagtatatgtcagggaagtgaagacaatgaatagttccatgcaagcaattcaagtgagaaagggcaatgcgtaaggcaaaataaatgagataagaagcaactgttgccctcaaagagcctggtaagaggaagaatttttgtaagtcttgcttatttttcattagaaaaaaaatttagaggcaaatctttttatttaggcatattataaaaatatttctgtatcctaactatgaatgagaaaataagcataaactcaaattataaaaagatccaacaggcaaaaagctatgacatacaacatttgtttgaggttgatacttgaaaagaaattacccacaagttgtggagaaaataaatagaaatctgtttttctccactgctttaagaatctatactaatttcaactctcttagacaaaatttcacataggccacgtgcataaatatttttatgttgccattataccttatatggcaagtaattcctgtatccatactaactttactctgttgagctaaatacctttttagcaaaaaatagaatgtatcaaaatcgtaaatgctgacatttattgggaaaatggaataaattacatgcgctataattctcaaacctgtttagtgcaaaatatcttaaaagatgaaaaaagttcagagagagcaatcacaaatggatagaaaggaaaattcaaaatgatgtcaagaaaaaactggaatattagctccaggagagcaaaaacttttgtcttttattttttaaactactctcaccctggtacccagaattttgtttggacatagtaagcactcaatagatttagtgaatgagtaaacacattttaaaacatcaaaagtattacctgtattacagtgaaaaatacctaatgaccttctacaatgtgccattctttatgcaaagtactttatatataacagcctgtataatcactgttaaaaccacagagaaagataatcatttattgatgagaaattagaagttcagatctattaagaaagtcatccaaagccatgctgacttcaaagtacagactctttactttaggacatggcataacctccagagggtaatgatattgagaaagctttgccattggaaacacaatttcatagacaagaagagaaggttatgttcacattacttttcatgcttcacatggcaataacattctgatctttaatgttaggatttataactttacactaaatactccatgatctgttgtctaaatggtaacaccaagaatcatcacttttcctctgtaataagatgtgcagtgtctttgtgtgaaatatagctatatacattgtatatcttctagttgagaaaattaatcatgcaatgtatctggaataagaaaaaaatacagcaacaataaaaataggacaataaaatgagtaatacgtttaaatttctattgccagaaaaattgttcaaaatagaacttatgaaagagaaatagtgtagcacaaaacaacagcagaggagaaatgatgaaaacaatgagagaaagagataaattagtgaaataaagttgaaaaaagtttcattttaacatcattgcattttgtgaaaaaattttacacttttacattaaagagtttaagcgtatactaaattgaatttcttacttgatgcttctgctttaaattatatcaacgcttaattaccatttaaagcttattattagttaatttatatatcattactaatgtcagcatcttgtcaggcataagagttaaatataaatttatattccccaggtgaatgcaattgatacaagaaaaaaaaaaaggagttcctttctctaaatgtatcacatagtgatacaactttttatacactacaaatagactgggtcagaagttaaaaaaagtagtttgtagggccaggcgtggtggctcacgcctgtaatctgagtactttgggaggctgaggcgggcggatcacaagatcaggagatagagaccatcctggctaacacggtgaaaccccatctctactaaaaatacaaaaaattagccaggcgcggtggcaggcgcctgtaagtcccagctactccagaggctgaggcaggagaatgacgtgaaccccggaggtggagcttgcagtgagccgagatagcaccactgcactccagcctgggcgacagagcgagactccatctcaaaaaaacaaaaaaaaaaatctatccactatacacctttttgtgttcttaatataatcttcccactgaatacacaatcatatttactaacgtctataaccataaatgctatattttaacattatagacttagtagggttgttacttaaacagaatacatgacaacatcttcatgttctctaatctgcagacaccttttcaggcttttgcaaaatacgtaactgtttggctcaaaatttattacgagttcaaaaatatttttaaatactgaatacaaacagagagtattgaaaagctattttaaatattcaagaggactggagaaaactcctccattaattttaatgatgaaattaaaactgaacctattaaaactaaacctattagtcatcaagaatgatgattaaatgaaagtatcaaacagaatctatgagtccatgctaataagtgtttagatcaattaataaatgagggagtagaggaaaagcctcccatttagaagaattccaattaaattacatagacagtccacactaaaggagggaaagcataaatccttacatcttaagtgtgccctggtgtaagaaacttctttcctaagagtacagtatgggaagggggaagaacagtgacatcacagttgagaaatccgacaagtcctatttcatccaggagatcaaggtcaaatttaatagtcataaattacattggtagtatgtaccattgatacaatgtgaggaaaataacaaattccctctgtaatatacctcccccaagcactagtcttatcaataggaaaagcaccaacaaatcccaacacatggtatgtattctacaatatctgactagcatgcctcaatactgtcaaggtcatcaaaaacaaagtccaagaaattgtcatagccatgagaagcccaaagagttaggacaactaaatgtaacatagtgtcctggtgccaccttggtatagatagaagacattacataaaaacttaggaaatatgaataaactatgaatttcagttaataataacgcatcaatatttattatctaattttaccaaatataccatgctaatggaaaaatgttactaataggtgaacctgtatgctggggtcatacggggattttctgtacaatctcctctatttttctgtaaatctaatttttttctattaaaatgtctattaataaaaataacttaaccaaagagtctaaatatgaatgtgattatatgcaggtctgaagggcataacagcatgagagcatagagagaatgcaaattacacagtccagaggatttgacaagaagtcttcttgctttgcaataagctgcttgggcacacttagataagtcatttaagcctcttttccctggtttgctatgaaatgaatgaacaggactacaagagttctgaggccccactgagctctgttgtccgttgatttacctacaaaatgatgtcaccctcagagagattacaatctacttgagaaagtaaacttgctaacattgaaacaaatcaaaacatatttaggaacatagttcaaggctgggatcatattctatgtagttcatattctcaggatttcagagaaactaagcagcattatgaaatacttaagaagtaagcgagacttaaggaccattttgaaaaattggaaaatatgaatgaagaagtgaaggacaccccatatcccaaataattggaatctgactcttacagcaaattctccttttgcttcagttttaggttctgaatggggtaaaatattccttcaaatccctctatgctttattatcacatatagcatgaaacccaagtgccttacatggtgtatcccaccttccttgacattgtccttgttagttttccaaacccatgtcatgccacttgtaaagtgatctgcattagcacagtcctgagctgtctttagtttcctgcacagactatagttttagtttgaaacctaaatagtgttctgtgccaggacaggactctgtctgggaaagaagtgtaaaacttttggacttggtttggaaatgctcgttcattttaattcctcagtttgttttgattatctgagcctgcagaaatgatgcacccaacatttctctcaatcattcaaatgatttaaaacagatgaaatttttgtatataatatatcagatttcagtgagttgttaacttctgtataggagccaacaggaattttaaaaatctgttgttaaacactaataataatcaaagttgcaagacacttcatgttgagaactacaaagacacagccatagataaagttaacagcgacctggtgtcactgctcactccagggtgtaagcttattgaatagaatggcaggcatgcttgacagcagagtacgcaatgcctttttttttttttttaaatctcccactctttttctattttatcaagcatacataattaaatttgttaagtgaaaggatgcttaaaacacttgcagggatgtttctcaggaacatcctgagatttttttttttttcaaaaattagtgactttaaagaaaccagcatcctttgcaaactcaccaaattagtgtgtgcgtcaccaagatagaccatattttcttatgggtgggatgctagcatgcaacctgggatcccaaaatgtgatatatttacaggaaacatcatcacaaaatgccatgagaaagcagactgtgtacagaatccattctgctaaaggtggcatcagagcatccatctttgggaagtagttgtgacaaagtttctagaatccagtgcctgagggtcagcagtccagctctggtgtctgtatccctcaacagtatttcttcctgcataagccagttagggtgaaatctgttctttgcaactcagagcactgatagacaatccttcttttcttctggtgatacgtttctctaattctttagcaaatacctttttgtctgtagttctcaatttttggttccctccttaactgaaagtaaaaactaatactctgttgtccagtattgtagtctaaacacatatgtatctatttacattaaattagttcaaattgaataaaattaaaaatttacttcttcagtcatcctgaacgcattttaacggcttaatagcaacatgagctaccagcaacaacatcaaacaatgcagatacagaaacatttccattactgaagaaagttctatcagaaagagctgctctaaggcatagaaaatttgactagggcatatgtttctgcatctacatcagagaatccccttttaatgagttaactgattctgttaatggtttcaaattatgaccttgataccatgacatattacattcatctttcactctattattcattttgattttgcaagtaagtttacaaatgatcagattagattcagagctcattttgttagaataacaaaaatttaatctcattactactcattcctaaacattgaagttttcctcccagttaccttctcatgaatgatattaaactccagagtaaaatctgaaggctgacactaacagagccatccttttcagaaagtacatccaactatgttaaagtgttcattttagttcaacgatacctgaaatgcaggctgtgaggtggacatttaggatatgtacctgcctagcatacatttcccatccttttactaagagtactccaatttttgaagtctcccctagtatacaaagtcttggtacttctgtcagtcaagttattttctcactctcccctggccttgtgcttgacttaggaaacaattaaccaattggattatgctgtagaaacttacaaggagggaaattaaatgaagttacttaatctcaacgaaattacccaaatatatgctcatgagttccccttcactagacccccagagctgcccttattttgtccttcctgagttttgattgttcaaaatttactttgcatatgtgtcctcctgcaagattttaatgataatttttagattttgcttttagaatagccagttggcttttgcaaaagtattagatgatatcaatgtgcccatatttttacctacttgggaactttttcaaattacatctgttcttgatattctgaaatgccacgcttacccctttcttatctgtcttggtagcctaccacactattgacacactcatcatgaaccagataggtactttgaattcatctgcctgagaataatttaaccttcatggtctatttctgccaaaatactgctttaatacccccaatatttgttaactctatttgaagttaaatttctatctgtttgtgctttgagagatgttggcaaagagaaaggaggaaaataaactattttagataggcctagccttgtcaaatgtgttggagactttatagaaatcatgttgtcaaagtgatcaatttaaagaaaaacatacttatgtcttcttattttctgtatcaggatgtaactgaatatcttttggttagacatttgatcatatgttattttcccaaaccatcatttcaaggttattatcataagacaaatcactctaaaatctaatagttcaagccagtcagaattgagtgatgaaaatatacagctttatttataagtacattttatcattaggcttgaattggttcagacgtcatgaaaaattttgcatgctagtagtaattcctcaaactccaaagggattagagtttaacaaaattgccaatccaaaaaaaacaccaagcaaacagacatttattttaataagtacaaattacacataattataaatattccttatactaatatttaaactcagcagacagaggacaggttgaggtttgatttatattcacacttccgtcttaaaattttcaaaagacatcttttatttgcttacacatgaagaatgatcagtatcactatctgaatataaattaataagtgaaagtatctgtatatgtaaattcaggcaaactcaggcttaaaaatctaccttattgtaccacattgcaaaatagaaaggattgtaattctttataagtattcggtggaattaagtgcaatgcaaaacatgctatgaatgtcagctgttatatggaaaacatctaccagaaaagccacccatgagtccactcagataataatttttcctcttgtctgttttataagctgttgaggaatatataaaagaaatggaaatttacaaatttcaaataaatgaaacatacatatttttatagctatataatattacatacatttaaatagttacttgtattttattggctcttcggctacattccaaaacttaagcaagttaatttaggaagagccattaaatgcacgttctcaggcatattttcctacttgtaatgttcatgttcaaacatatttttcaatatgtaaaagtaaagtctttgtaaaataaataatttaagacattccttgtattataactgcattcagaatgtataatacaattatggcttggaaaaatcaccttaaaattttgtcttatctttttgttgtgcagaagctccactcaaaagaagacatacatgcgtccaacaaacatatgaaaaaaagctcaacatcactgatcattagataaatgcaaatcaaaaccacaatgagataacatctcattccagtcggaatggctcttattaacgttcaaagaaacaacagatgctggtgaggttgtggaggaaagggaaagcttttacactgttggtgggagtgtaaattatttcaaccattgtggaagacagggtggcgattcctcagagacctagaggcagaaataccatttgactcagaaatcttgttactgggtatatacccaaaggaatataaatcattctactataaagacacatgcatgcatatgttaattgcagccatattcacaatagcaaagacattgaatcaacataaatgactatcaatgatagactggagaaggaaaatgtggtacataaataccatagaatactatgcagcataaaaaggaatgagatcatgacctttgaagggacgtggatggagctggaagccattatcctcagcaaactatcataggaacagaaaagcaagcatttaaagtgggagctgaattatgagaacacacggacacatggggaacaacacatactggggcctgtccaaggggtggggggcagggagaacatcaggaagaatagctaatggatgctaggcttaatacctaggtgatggtatgcatctctgcagcaaaccaccatggcacacatttacctatgtaacaaacctgcatatgctgcacatgtaccccgaacttaaaagctgaagacttttttttttcttagagggagaaactagatctaaatgagtcataaaatacaaatgaatacaaatgcttaattctcctaatacgtcatttttaataaattaaaactatgcttatcagttcatgtgggattgtctaaaaattataaatgaaagatttaaattctctaccttcacaaatcaggtacagctagcattgatgtcattgagatttggctgatggtacatcattagattctataattaatcaccaacacctgcagatgcattctcaacatgaaattacttttgatatcacatggagaaggagagatctcactaaatcttttaactatgagtactttggaggtaacagagatgattgtcatcttgtcacactgagacatgttgattctagcacttttggattcttccatgaatatgttaaaccattaccaataggtcaataacctgcccttttcacccctgactagaaacactattttaaaagagttcttattgatttttttctagctgtttttatttttctcactttctaaaataccaagaaaatatcattcaatgctgcaaaaataacctaaagaaaaaaaatctaggagcatcatacaataaaaatgaactgatttcttatgaagtcagcttcaaaactgtgtaaggcccaattcttatctctgacaatctgttacttaacatttgctgcttaacacttcataaaagtcaagtctagatgaactggcatacttcataggctttttttttttttttttttttttttttttttttttttttgagacggagtctcgctctgtctcccaggctggagtgcagtggcgcggtctcggctcactgcaagctccgcctcctgggttcacaccactctcctgcctcaacctcccgagtagctaggaccacaggcgcctgccaccacacccagctaattttttgtatttttagtagagacggggtttcaccgtgttagccaggatggtctcgatctcctgacctcgtgatctgtctgcctcggcctcccaaagtgctgcgattacaggcttgagccactgcgcccagccacttcatagtcttataaataatttactgtaatactcattaagggcagtaaaacaatcagcagttactacacactgacagattcaagtatagagtgaatgagatactatgtatctactatatcttgaaactaaaacataaataagtgtcacaaatttaaaatatacatttaaaaaagaatagacacacacacaagcacacatacatacaatcacatacacatccaaacacaggcgtattgttatacatgcatataaattaatattaaataaaacttatgttttaacaaactctgtatacttaaattcaccagtggttagttatcccaggcagtattacctactaagccttagggaccattattttcatttaaattccagtagtaggtaaaacctaaatgtcaaaacttagcacaatgtttaatgagtggataaatattagaaaccacgtctcctgaaatcttaggtaagtcattattaggggcttactactttcagtacctgacatttactcctttttttcatattagttttattttttattaaatgtcctcctgccttgaagataatctatttaataaagaagaaaaaaaagtgcttttttactttgaggtttacttgaacataagcatcacctttgtaattccacacaagcgtcacctttgtaatttgtcctttaagacaattagactgttttatatcaatgtattattaaacttgattgcacttatgcaggacatattataaaagaattatgagggaagtacacagatgctgttagagtctactaaaaaatagattatttactattggaaacccaaaggagagaatgcctcaaaaatgtggtaataaatacctgtgggaaaatcttaagttgaagaataatcctggacataattttatttactattgttattatatctttatcctaacgagattaatgactgatgttttcactgcaatttcagttaataggaactctatacaatgaaattgcttgatcaactgatagttttttagtttattgttttattgacacataatagttatacatgtttatggagtacatagtgatgtttagatacacacaacgtatagtaatcagatcagggtaattagcatatccattatctccaatatttatcatttatttgtgttgaaaacatttagtatcttctagctatttaaaaatagatattattgttaaccattgtcattctacagtgctataaaatattagaacttgatcattctatctagctgtaattttgtgttccttaacaaatatctcggccgggcgcggtggctcacgcttgtaatcccagtactctgggaggccgaggcgggcggatcacgaggtcaggagatcgagaccacgaggaaaccccgtctctactaaaaatacaaaaaattagctgggcgtggtggcgggcgcctgtagtcccagctactcggagaggctgaggcaggagaatggcgtgaacccgggaggcggagcttgcagtgagccgagatagcgccactgcactccagcctgggcgacagagcaagactccgtctcaaacaacaacaaacacataaaaaaaacaaatatctccacatccttcctttccctctaacctttccagcctgtagtaacctgttttgcattttacttctatgagatcaacttattttagcttctgcatatgagtaagaccatgcagtgtttaacttttggttcttatttcacttaacataatttcctccagttccatccatgttgctgcaaatgacagaacttcattttttatgtctgaatagtatttcatgtgtatatgtgtcatattttctttattcagtcatccactgatagacatttaggttgattccataccatgacaatcacgaatagtgctgcaataaacattggggtacagatttctcttcgatgtactgattaattttcctttggataaatggtcaatagtgagattactggtatgatcattttaatttaaggaggtattcatcaaactggttgataaaattaactagtcccagcttaagatatctgggatctagaagcactgtttatatactttgcatgagacacagttctaaccatacaattaaaaaaaaaaaagattccaagcagttcatacctgtagcctcagacttaagcttaccctctaattagttaaacattagggcaatgattttctgcctgtattttataaaatgtcttcatgctggtggtagagtgaatgtggaggaaaagaacatatttaagtggaggccattcatgatataagataccatggaaagcttgagttttcagtttaggctacagaaaatgcaaataaataaattaaacagttggtttaaaatattactacaagtaggattttcccctgaaggaaggcttggttttgtcatgttttatgctcggtttgttaggttttattgttggcttcatatgtctcttgctgatgggagtatgtgacgtcaccacacggcatagagaggaccaagaagctgtcccagtatcataacagaaggagactggaggcaatgtgagaaataaaaatgcagagttaagaggaggtttatacaaagaaagaactagggagtgcgaagaagagacataatttaaaagaaatgttttcttttattatggaaaaatatgctgtttatagtataatgtgaatcctcttctcattatttttactcaaacttcattaaaatatcaatttctggttgatgcgttgtgctttttaagagataccacgaaagaggacttaggtggttattctggaatatgggtatttacgatgagtaaggtgactattttcatgcaatcatttcagaatcagcactgtgagctgtcctgccttaagacaatcgttgcgcacatctatacaatactatctatttcactccaccaccataccaatcatcgagcgctggctgctcagcagggtgcggatgtgtacttgaccatagccatagtggttctcttgagatgcagacagtttctacactaaaaatgagttgacgtttaggagaaagaaagaacaatcttggtggtatccatttgaaaaagggaagcggaacttcaaggaaatattggcacaaaaactaagactgcttacaagaggattacctcatctgggttagaggaggatttcaaggatatgaggcgctctcatcacaataaagcagacattcccaacagtcacagaagcaggcaaatgaaagatgatgtaaacttatataagacttgagttgcttcatcttaagcatccatccaatttcagtacatgggttcttttgctgtttcaaagttctttttttttcttttagtactgtacatttccatataaactttcattcagagtttttacttttaaataatttctgtagctgccttttgtacttatttgaagaataattgaaaagaaaaaaattgagaaaattaaaacagatttctttttgccaaaagaaagtattggtaatttatagcaaagctggaaacgagggcctcttaagagttttccaaagtatgtcagctagtagcatggggttttagatcttttctttactgcaatcaatcctgctggaaatatgaagtcagttcagaagatcagtagagttgagctagcaaaagaataaaaatcctgaaaggagttattaattatgtgcatactgtgtgcagacagaatcagaagatactggccaagacattatgaaacaaggaagaattcacgagaaactttgaaattgccatatgcaagatgcaagttccctttacccaattttgcactcatcttctgatgctagaaaagcaaatgagaatgttgctaacacaaatgttatgtatttgcactgatcgagatgggtgagttcaacaagggaatccagtctcagtgtggattactgataaatgtccttgcttttgtgctagcctaaatttctagtgttgagagacacattttgtgtagattccctatttatattacattaactaagtatcttgaggatatgatgatttcagtaaatgtcattcacacaatccatcaatagtcccggggtggaggggcgttatcagctattgtttctctgaataagtattatcaaacattgcttttctgctatacagaagcactatggaatgaaaccacaaagtctgtagacaatgtttttgcacactgtaaaaattttataaagtcaggtttcatttaatttacacttttgtttctggttagtgtttttactataatttgggaataatgtacagtggtaaatcattgtgaagtaacactgcattctccttaaaattgggatgtattcaggcatattaattatttcaggattcattaaatataattctaaaagagtttctctttaaatatttatctactcttgactggtcgtattgaatctcacattcattactaaaataaatttaagaggccttgataattgcagaccaaatatatagttacaattgtcgctatttataaagaggttcaagaactctaacctataattcacattaagttgaggcatcaaagaaaaaaatacacaaaaaaggcatgttggcagtgatggtggtactaccaaaggtagagttgggtttcattcctttcctgttccagcctatctattgcttttaaataacttatgctgctcgtgtgtgaagggatttctccttttactcacatatttacaacctctaattcaggagagagattagagatagagaatctaatacccttttaagttgcaggactataaaaacaaaataggcctcactccacttttctaaggcaagattctaggaaaggataaatatattcatgagtcaaaatccactacaatgaaataagtaaccaagggtaaatatattcatgagtcaaaatccactacaatgaagtaagtaacctaggttactgaccagaactctgcattgaggataaagccaaattctttataacctcaactctgtcagagttggtagtaatcaggactaggattcagtaataagcacttttatttaatatatatatttatctgtctctctctctctatatatatatgtatatatatatatatacacacacatatgtgtatatatatatacactcatatatgtgtgtatatatatacacacatatatatgtatatatatacacacatatatgtgtgtatatatatatacacacacatatatatagcatttcttcccctttctgttcaatacagcacactgattctttcctactatgtgatgctccgggctggtatgtaaatcaagaggcctgccttccctagccaaaatgtgaacacagcagagagttagcagggtgtaaatgaatcctactgtcattcccaataatttgaactgtgagtacaatgacacaagaatgagaaaaataaatggacttcattcattcaattggtggtgctctatcaacattgtcgatttgtgcttcctacatagacccctgaggctttactgcagcatttttataaactagtctcattctcaaaccttctcaacatttgtgtgggctaatattctccagaaaagatccttttatgattaaattggccactattggtttatgttcatgcaactacagaatcataatttatagcacatggcaagcatataagaaatatttgcacttattcttataaacagcagtggtaaattctacattgtttagccctttggggtggtttgcttgaattctatatagaattacaaaatgttccgcagagaagttctcaaataattcttgctgtcattcatgtaagataagtaagacactacttcgtgtgaggtgccacacataagttctagggaatacttcatcacttttgagcaagccagcaagaaagcccttaccacaaggaggatatattttaagagaaagagaaatgtgagtcaatcagttttgatagcttatatgcaatggacagttatcagtctgagcttacattacatttactaacgtaaatacaaaaatctttgggacatggtgagagatgtcagcattagctagctgtgggtcagctgtttactgcaaaacctgcaaggcttgggaactgggagaactgtttgttctcaagaggagacgtgaaacccgaaatatctcccttgaggatgggattttttaatgtacaattctttatatttttcactaaaatctatgtaattttctttcacaatcaacataatctgacaaaaatgagctgttcctcataatattgagacattcttggaaacattttgaggaaggaaagcttaggaaaacactatcaagtttctggccaaagagtagggctccacacatcaggatttgaggtatgaataaaaatgaggcatttttacactcatcaggtgataaagcaattgtgtaaaaaaaaaaaaaaaaaagaaaattctagaatataaattatcttttaacgaatgagaacaaattactttggagatatttggtagcttccttaatcatagtagctttgaatgatatagatgcccgattgtcaacagagatcaaaactaaatcagaaacttaaaatggcccaataaaatgtaaagctccttagaaaaacagcattgctataaagtctcaaatacagtaatgtgggagaaaatgacacgcacagcctatggtaagggataagagctgcaatatggagaagtttatcttggattctattttattacctctacctaagccactttttaataaaaatcatcaacagttcacaccataaaacattttggacctagcccaagtgagaaaagtcaaatatatttatatatgttttttggctttttaagagattatttattttttattatactttaagttctggggtacatatgcaggacgtgcaggtttgttacataggtatacacttgctatggtggtttgctgcacccatcaacccatcatctacattaggtatttctcctaatgttatccctcccctagcccaccatcccccgacaggccctaagtcaaatatattttatatgagatccatagtactcacaaaatttaatacatctatgtagacattgtcaaatataggaagacacttaacatatttctttgaatatactgaccctttttatatattaatgcctgtgtatcaaagtacatttcatacacagtttatcttctcctgaaatgtgattataaaattgatactctacaactgatgaaaagctagtaattgaaatgaagtcattctaatgaagcaataacactaacatagttttccaataaatatactgtgaatgacttagcctatggaaaaaggttttgaataaaaattattattttctaaatatctgaactgtaagatattagttctctaaatctatcttttttcttttccctggatttgaatatcatagctcactaaacatctttacaatttgcttcctctaaacacattctttcttctggaaataaaatggtgctttgaaagaatattaccaataggaagacatatttcaaacacgaggttcctgctttcaattacctaacagctggtactatgcgtttacatttagaaagacaaaaccttacaaagatgtattatgctttttcaagtaatttagatttgtcacagtgcaagaaaaactcattggcaaataattcaaataggcttgtaagtctcagagataaggggctttaaaaaaagcaaaatacattctttaataagcaaagttatgagacagatctataaaatagaattgagaaatctttcaaagtattccatgcagaacagctgatttagtaacctactgtgaaaagaactattgatactccaatagcagcggtgatacagtgaaaaggtaaattttgaggatgcgatatgactgcttgatctagtagtacaatactgtgaacaagcagggactttgcagctagacgtatttaagttccagttctgactccataatttacactgctgtggttcacttaaaactctgtgagcctcagtttctatatctttaaaattaggctaataatgcctatgtaagtgttgtgaaatgctcagaaatataaactaaaatcaatgctattgttttcctgtcatctggcaaagagtattgctccaattttatgtgtcaagtaatgtaaaacgtaaaagtactaacctaccaaatctgttctttttctaattgattacagaagaatccattaactttagtggcaagaatgtctgttatctctcaattgttctctcccttcaggctgatttttttgctaatatctttggtgctgagataatccaaaagagaacccccatctcctttagtggcagagctggcacaagcttatacacgacctcagggacctaagaactagcccaccaagcttgctaccactggagtccccaacacatccagtggtagtactgccacacacaggagagctggccagcccaatatctttctctccagcaaggcctcaccacagtctctacaaacaactgtagtctatgctaccaagacactcacccataccactgatgttaattgaagtcagagaaatcacatggagactatactaatgtgcccaccagaacccaagccaaagcactctaccaaaccaacactctaggacacatctacaggaaaaaaagtcttttcctataaaagctactccataaaattggaagaagaaactattccaccagttgcacagatatcaatggagggatacaaaacaggtaaatgcaaggaaacgtgacactttcaaaggaacaaaataattttccagtaagagaacccatctctaaaaggaaatctatggaatgcttgaaaaagaataataataattaacaaagaaacagatacaagaaaacacagaaaaaatgtttaaataataagaaaaataatttatgatctgaatgagaaattcaacaaaaagataggtatcatgagaaaaaatcgagcagaaactctggaactggaaaattcagtgactgaaatgataaatactactgagggctttaaccataaagtaggaattttttacttgaagacatcttttgaaataacctcatcaaataaggagaaagaaacaaggaaagaaagaatgatgaaaaggaaaaaagaaagcaaagtaaacatagtaaagaaagcctgtgagacatatggaacatcattcagcaaataaatatttgcattatgaagtttctgatgaagataagaattcatagaaaacgtgcttaataaagtaagagctgaaaaattcccaagtcttcagagagatatggacttccagagtcagaaagattaaagatttcctagtagattcaacccagagggttttcttatcgatacttatagtaaaactatcaaaagtaaaagacaaagagaattatggatactggagtctccaaagtggggaggctgggaggggaataagagagacaaaaagccacatattgggtacaatcttcaccactcaagtgatgggtgcactataatctcagactttaccaattgtattaatctgttttcataatgctataaagaactgcccaagactgggcaatttacaaagaagagttttaattgactcagagttcagcctggctagggaggcatcaggaaacttacaatcatggcagaaggcaaaggggaaacaaggcacctttttcacacggcggcaggaaggagaagtgtcaagtgaagggagaagaacttattacaccatgaggtcctatgggaactcactcactatcatgagaacagcatgcaagaaattgcccccaggatttaattagctccacctagcctcttccttgatacatgagggttatagggattatgagggttacagttcaagattagatttggttgaggacacacggcctaaccatatctccactatacaatttatccatgtaatcaaagaccacttgtacacctaaagctactgaaattttaaaaaataaaaaaataaataaaaagatcttagaataataataataaaaaaaaaaaagcaagagaaaagtgttgtcacatgtaggggaatttttaccagactaagagcagatttcgcggtagaaatgtaacaagccaggaataatgggataatagattcaaagtgctgaaagaaaaaaataaaagttggtcaaaaatactatgtccagcaaagctactgtttagccatgaagaagaagtaaagtctttcctatatggacaaaaactaagagaatcaattcatcaccactagattggcctgaaaataaatgcttaagggagtccaacatctggaagcaaacagatgatatctaacatcatgaaatcatgcaaaagtagaattactgatggagaaaaatgtaatccaaggaaaattgtggtgctatgatcagaaggcaaaaataaatactgggaaaaaggcaatatatatttgtataactctgcataatcatataatatattactgctttttgttttgtttatatctttatacatgctggttttggtcttgaataatctgaagatgaatctatgtgaatgaattaatttttatatattttattttttctacctctgacttcacccagctcccaacccccatcgcatactgaacccattaatggcttcatttccatcatgtcagtcatcagtccttctctaagccccaagacatccctgaccaagacaggaagtgtgcctgcatttcagaacggaacacagagttcatctacccgatatgacccaaatatcagatcagaagaagatacagagcaggcaaaacacaaaaaggaaaggcagcataaagtcagttccattttataaaaatgcctttcttttttactcttcttggaaaataacttcttgttctcaaacttttggtgatcagaaaaaaaaaataactttatttttttctttctgatacataggagcctggagcctgcctcaacatttttttctcttattgttctacctagctgcatacctcagtattaatactagaataaaatgtattttgcttttctttcacaatcccctcctcctttcttaagcttcatattttagctctctaattaactcccaagtagggtaatacctaataagcattatgtatacaattcctgagagactatttaagaaacaacccatagagttatcccttgcatacctttgatgagtttcctggatccccttttgatctggattaattaatgttcctgagggagtgctgattttctagcattcttccacctttgatgcagaatctcaaaattcccttgtacaataactttgggtagcaacatgaacgcaaatggctgttcagatttcaagaccttctatactaattctttgtaaacttaggctgagacaagggggaaaaaagcatgtagcaccctggataaatcttaaattctgccatcagagctaagatttaccgtcatctgtttctgcagagacagacatttttttttaaaaggcatcctatgcttgactctaaatcctcacttatatcttcatcaccatctagagatggagcacctcagggaagttccagggattgccatcagcacccccttctctctgatacgttgttaaaggtttcctttctaataaataatttattgagttcctagagctatagactgaagtgtttattttggattctacattttttcattcaataaatgtattgagtgtccacacttatgatataatatgcacttatacttctccaggtaaagtaatataagaaattgtactgattggtgcaattactgaaagtgaaagtcccataatcaccgtcagttataattctgtgcttttagaatatatgacacaaaaccggcagcttgatgagagcatagcagtcatgcattcatctgtatatcaatgctaggataatatcatctgaggagtccatagttaaagtctcgaatgtagcttttgaatgaatcatatatgacatacataatcagcaagaacagacacatgattctactacttcactctattccaccagttaaagtttgagctcctaggagaagatctttcatatacaagacttttccaaaataacagataaaaacatagacacaatagtcccaaaaatattttcagagaattcaggcaagttatttttcaagtatccatgataatgctctgtttatagaagtcaaagacataaagtacagattattcacaagaaacagctgtcttgagaaacaaatctgatttattcatttaataaacatttgttggcaccatgcaggtcagtactgttgggaatatagtcataagaaagatacgtttttattaaagcagaattttaaatgaagggtatgctttgtggaataggattttatagatctttgaatttatgtcaatacaatgaaatgacaaaccgtagtttcttatcatttagtcttcaatatatgactttaggttttcttcttatcaatctgttcctgttactaagaaaacaatttatagtattttataataatgagaataaaatcaaatagggtatggcaggtcttcatattattattacaattgttcttttataacttgtatccattgcaattttctttgctaatttcctcaaaagttaactatgtaaagatattatatttctatataatatctctagatttgtttgttctaggttttacttgtctaacctagaagattatcctacaaagtccatggcctttaattatctaactttgaaggtatcatctttagatagaatgccaattttgattctaaaaaacttgatcttgctgtacatgtgaatcacataatgcagttaattggttcattaattatctataaaaatgtggaaaaagtcctaaatggttgacaaatatatgctaaaagcagggtataaatataggccaacatttaaaaggtttccaaaatattctacataaagataaaaaggaaaaaaaaacaatttttacaaaaatcatcttaatgtatgctttgtgacagttacacaaatatataaagtgtatgatacaatcctttatctaaaagcatttatttttcaagttttgaacttgactttttagaaaatatgtctaagtttttacatatcattatgtgatagtcaacaatagtgtcaaaattctaaacaatttgattcaatgtgagaggctactgcaatgtttctcacttcagttactcttaagtattctcttctgcaaggcaagttacactacctctatattatctaaaagtgactcttctccaggcatcaagagtgcagaacatgacaggatgagccagtatggacttttcaccttcccttcatggggcagaaaaacattcaggaaatcagagattttcagtttaatcatcagggcatgaacctcagggctcaaagctgctgagagccaacatacggattttgaggacagattcaactagcaaagccaatggagagatgcatcccaaattcatgtttgagccttaagttcagcgaagcttgtagcaagccagttatatatcactaggttttcaattagttagaacaataaatttatttatcttctcttttgaataaacttatttaggcagaaagagagtatccgagagagcgtgaataaacagcatgagaaaacttggaatatcttagcaacgcaatgacaccataagactggcagcactgtagagaaaacagagtaagaaagaagagaggcacaggaaggggagaaacaaaaaataggaagggtgaccatcaggtgaaaaataatgagaactttcaggaacatatgggaggaaggtttgactctaaagctattaaggggatagaattaacaggaaaaaatatagcatttgaaatacgagcagaaacaaacagggataaaacagggctgatatatgggtttcaagcttgtaatatgatattagatgttattagtagacgaaataagattataatgaagaaaaattagaggttaggaagcagggatggagaagagatcatgaacttagttttacaccttatgaatctgaaataatcatgggatatccaaatgaaagttccaagagacagttggttatgcaggtctgagctatggaataaaatttggagatgtcagagatacaattttagctgccatctatagacagaaattagttaagaatttaacggtagataaaataaatcagaagtaatatggaaggctggaggggaaaaaaataagaaagtatatctgagaacattaacgtgtgagatatacatagagtaagaagagcttgaaagtaaacctaaaatctgtcttcagtaataagatttaaaatgtaaataattataaacaaaaaataaacaaaaggtgaaagttatgctatgtaaaagtaggcagaggagagattctaagatgggggaaaagtcagcaatagcaagtaatgcagatgggtcaaatcttccattgagtttagcaagtcattggtgacaactggtatggggcatctcagaaaaatagtaaaggtggaagtaagattgcagtagagaaagtggaattgcattaataattcactcaatgggtcatcgagtttgaagttgaattcaaacttatgaatctaattctttatagaatcaaggtcctctagaaacttggtcatttcctatatgaaactttcaaagaagatatttatattccccatgagaataatactaactacatggaatatggggtcacattgaatgtctcaggaattgttgctgattttttttctatgagaaagcataagtacgtctaatatagtgaatggctcccaaaacattcatatttaaaattcatttgacaaccaatatataacataacatttataagaatgtctttggtatgaccaacaccaaagcaaatacaaaaacaaaaatccttaaagacatactatgtgtgaatgttataagttatccaaaaatcttgtttctattttgtcccttgttaaatttttaccctatgacttgctgagaagctgcaggagagagaatttcctgatgagttgtctaacagcttattctttcctcctgctatgtcctcaacatctatgttcaatattaaattgcactgcagcggagatgactgtgtgtgtgtgtatgtgtgtgtgtgctttaagcaaaagacagaggcttgagtgatttagtagctacaaatataaatcactgacaagcaattaacatatactttggttcaaaaccaaatatttccttagcaacaatcataatcactattttacagtgaaaattggcatatttatgatatgttgacattaagatattcagtaagcatattgatgtttaaattccatgtttaaatgcaactatttataaatcaatcatcccacaatcaccttttcttaattttgaagtgcaaatatgtgagtttaagattttagattgaccaaagtgcttatttgttttcttccacatagctcagtttaaaatttgtaaaaagtattaaaccacaggaaagaaaagtgataaaagcaaatatgtgattcagcaagtttcttaatgtttgaaagtaaatggaaggtcataattatttaaagcagaatacaaaaatatcacattgaaaatggcaaaattgggtgagtatggataacatacactatcaaattgactggagaaaatacgacaaacttaacaaataagggtagcatgaaaatcaagaaagattagtggtgtcagttaaaatattaaataaaagtataggtaaattagggggatccttccccaagttctgagcaattttcccataagacttctccttccccataactaagattttattttctgaagaaattgtcagagagccaccagacttttaagtcaaagaaagtaaggccaattctttgcttgagtacaggaatgtctacctgctgacaagctctgctcatacacagaagatttccaaagagcatctcagtgcccagccactagtgacagtgacaactatctattaaaaatccacacacacatttttacatatgtatatatttacatatatatatatacctatatatgtaaaaaatatatatatgtatttccctcatcttttagaacacaacaagagtatttatctcaacttcccaatagttaaacttggccttgtgactgagttctagacaaaggcaggtgagaagtcccatgtgccacatcccatcctatcttgatttatgaaaccttctttgcaggctgcttatttttttcccgcagaaagttgtctggggtaacaaatcctctgagcgagcttggaagccatgtgttgcagatcattcccctggccccaaggtcctgttgacttaaaatccacccacacagagatacatgaaaaataataaacactgaacaattacacgtgaagatatatatgtttccattgcctacatactcatctaataatttaatgtgaatggagaagcaggattaatcagcctctttgaataaaacctgaaaccctaaaaatggaaaataaaacagaataaaaaataaaaggtgggaatagggagaggaaataatagagaggtagctaaataaaactgctttaaaataaacatcctcacaaagataagaaaatataattttaaaaaagcaaatgacttagaggataagaatgagatcttgagagaaaaatattaagacccacaaacaaaaataacaataacaacaaaaatactcaaaatactcctagaccaattatctttcaatcctaacacagcacctgaactgcttttcatgtttactaataacctccatttttgaaaccagtaattatttatcagttcctgtctttttggaatcattaatggtatttgaaacaattgatccttataagggcccagagctcttcttttcttaaaataaaagaaatatgaggtagtactcagcaatcaagtagtccagataggtcaaatcttccattgaatttagcaagtcattggtgacaacaggtatggggcatctcagaaaaatagcaaaggtggaagcaagattgcagtagagagagtggaattgcattaataattcactcaatgggtcactgagtttgaagttgaattcaaactggagaatctaatcctttatagaatcacagtcccttagaaaccttgacctcttcttttcttaaaatttaaggtccacagaccttttcttttcttaaaatttatatccagcccaacttctcttctaagctctaaacttgcagggttatctaatttgtatgcattatactcatctcaaacgtaacatgtttaaaaatgagatcttaatttgcctttctaagctcatgctaatcttcccatctcagtgacaattttaaaaatcctgaagtcatccaatctctctctctacttcatatctcacatttaagccatcaatacattatggtgattctatctttaaaatgtattcagaatcaaaaccacttctgaccaccgcactgctaataccttaggctgagccaccatttctttgtgcctaaattattgcttgggctccttaatttctcatttctgctctcatctacctgttgactatttccacagagcagggagagtagcacctttacaatgtgcattaggaagacttctgatttcattaagaagcccctcttgttacaacacaaaagccctgtacacaacacaattaatgagcatagaatgaccctgagaagtagaaagaacaaggtgaactggctagagacctaagggccaacaacaacatggcagtgagccctctgggtttccttattctggcccataatctggggcagggctccaaaatggactggaatatagatgcaggtccaaaaagctccaagaaaaatatctttactctaaacaaaggaccagaaaaatggtggtctaaaaacagaaaaagttttgggaaatacttgcctactccagccaaataccaaggacaaaaattgcaccatctctaccccactagtgacttcagcaatgtcaagtagggagcagatttttcacaaatgacaaccttgcttctgagaaagcaggtagctgccactaaattcatctactcaaggagctgtgatgaatggttttgtgtgtcaacttgactgggcgataagatacccgaatacttggttaaacattattctgggtgtgcctgtaaaggtgtttctgaatgacattaacatttgaattggtaaactgagtaaagcagactgacaacccaagtgtggatgcgctttatctaaaccactgaagtcccgaacagaacaaaagttgctctccctacctgtcttcaagctgggacgtgagtcctttaccatcagacttgaactcagactggatcaataccatcagtattcctggatctccagcttgctgactgcagatctagggacttctcattctctgtgattacttgggacaatttcttgtctatctatctacagatagacagacaaataggtaacctatttgtcacctatctaatttcctattcattctgtatctccagagaaccctgacaaatacagtaatatagccaggttgagcactggcagggtgggatcttatatctcattcactaccagaaagaaggaaatgtactgagtcccccattcccaactcctacccatatcatgctgttagcagagtcctccacctggaccaccaggtgagctaggtgagcctctattcctacccagtaccaagctgacttaattaaggaggcaatatgaggatgatcttgtcaattgtaggctccactccactactccatgtcaccaccagcacccaatatcagtaggctcaggggaactgaaccttcatccccacctgggcatcaatgagattgaaactgtgttgcaagtctaggctagttagcactgcgctttatccccacccttggtgtcagggatattgagtagctgagcctccacacccattctgcagcaaaaaagtattgcaagtcaattctctattttcaatatctctggtggctctgggatacaggagggaagctgagattttatacacccacccagaggcaatgaggcagtataagtctgggtcttaaaactgctgaaaggaggactgccattctgaaaaatcatggaatttagtggccagcatttttgaagacttagaaaaatttatttttctaagtcaatttatctattgactatcatgatctgtggaatgtctcaaaaaaatttaaagatacaggttcagcaaagtaagctgaaaaaggcatgaattaatgatagaaaaataaaaaattagaaaagaatcacaatctatttttgcatattgtagtaaagtagccataatttatatatgtatatatatgcttatatatacatatatacacacatatatatacatatataaacatatatatacatatatatacacttgtgtatatatatgtaaaactgtgcttagaacttggggtaggataaaaaatgagctgatggtataaaataaccaaatgttaaatagcgtaataggaagaaaacaatatcttgaatcagtaaatcaaaagataacatcataatcatgttatttaaaaatatgtgaataaataaaataagaaacatcacaaaaaagggtttacaaagttgtataggaaaacttgactaaggggcaggaatgtgttcttttttttttcattatactcacaatttaatgttcttttttgaaaacaatgcacagctatttctttgattaaaataatcatgaattctaagaaactgctttgagatatatatatatttcctttaagatatatatttctttcctttaagatatatataagatatatatatatcttatatatatcttaaaggaaatataatctacatcaaaatggcaactatttactaaacatgcattttattacataaacacacagcaatgctctttgctttggcattttctcaattacacaatatcttccattcaagttaccatctcctaaaaagttatttgagaaaatcttatttctcacaatgaaaccttattatctgaagctcagctgaatattgttctatccttagccctaatttacaaatacaaaataataattaatataatgtatgctattgaaagctcagtatatcctgagtggaaatttttcaataaaccttataaatatgcctgaaatgtttgctgtcatttttttgaaaaatattagcacaccaatgcaactatagctaatgttccaaatggagtattttatttcatgcttaccgtatcagatggaatgtaaggttaacagactttcaacacctcttaaatgaagggcttcatgcacacacattcagaagtaaaattaatcagaggggcaaaatctgtacctacctggtagaggttaaatggatggcatatttaaaatcaccattcatagctcctggcacacagtagactctaaatattttttccttctatcatttataagataaattcaacaacacatcaaagaaagtaggaaaataaacattcaaaccaaactcttgcattcattcctagattgctttttttaaaacatagtcaaacagtagtaataacaaatttagtaaaaagttctgaattgtaaaattcaaaaattgtttaagttcaaatttttaacataaaattgaaaatcaaaatttgagtactttactttctggcaaatctctttatttatcataatctgccttatagctagggatagccttagtactttcatattatacattttcacttacaaaccatacacattctttatgatgatatttctcccatcttttcttgaaattcagaaaaagaagtatatgtgtgtctcatttaaaattctccacacttcttagttttatactttttttctaacttaatggtccacttttccttgtccttggtcgatcttcactcatcttactataaacattcacttactttttaaaaattcctaccgcctctctcttccaaaaccagtccttatattaagtaattaaataaaaatgaccaagtcaccaccaggacaaaataaatgtccattctcaaaactattacttcagttggccttaagaaagtaggatggacagtagggagatatcttttctagtaattctgcaaatcaataccaccattctctgcaaagcagacaggaggaaattgattgtttcattgcaatgtttcatattaaaaaaccaaaacatcatttcagcttttccatactctatggaaactaatattcagagcaaatatgtattctttcatcaaatatttattgagtacttaccaaattttggacactgagctagttagtggaattactaaaatacaacgtgcaaggccacaaatgaaatatgctttttcatttaattgagagcaagactatgagatagaaaataatacctgagttttccaggtgatgcaactatagcttatcaatattaaattactcactatattctgtgcagaataagggttgaaacaaggatttaacttgacctctgatgccttgacctctgatgacaatgcttttgctttcaagaattatacctaaataattatgttgatgtcaaggatgatgatgatgataagtatcaatctccatttactgaaatataccttggtttcaggtcctgtgcttgcatgctttatgtatgtgaattacatccttttatcaccctttacagagagaaaccaaggctcagagaagttaaacaacttgatccttgctggtaagggagtggaatagaattaaagctcaattccatctggttctgtattcttttctttaccatcaattctctatagcaacagttattgaaacttgaagacccatctcacagcctctctcttacatacacacatttaatttcattctccatgcttggatcacaggctctcttctctgtctttctacattatctatctatctatctatctatctatctatctatctatctatctatctatgtatctatgtatctatctatctatctatctatctatctatctatctatcatcatcatctaggtatctatatctatatatcaaccttcctattatctgtatgtatgcctgtctcagtctccctttctgtctctatctctcagactttctgtctctatatccctttccctatctctttacatttttttgtttcattttgattattatttgtctttctggcaatctgtctatttctgtctttcttgaccctgtgttttcccggcctgtctgtcactctgcttctacctttctgtctcaacctatctccacttctctctctttctgttcttttctaagtgtatatctcagtttctctttctgttccctttctctttttcttatatttgactgtctctaacttttattatgtttttccctgtgagtctctctcattttctttgtgtgactatccctgtatctctctttgagtttgtatctctgtgaatatctttctgtgacttatctgtgtctgtctctgtctctcggacagagatgtaagattctaaagtaataaaaacctctcatccagttttaatgacccttttctggattccagtgatgtgctgcaaagttgaagaaataagtcccttaaatgataaagcaaaaagaaaagtcactgtccttggataaacaatttgcatttccataaggattcagtgatgcagaatcagaaaaggctcattctgacacctccatgaaaacaacagggagagcattcattagctgggcttccttttgaatgatgcacttcattgcacacaccgctgtcctcccccggtcaggaaacagtgcttaattctatcggaagtttgccctttcactaggcatgagaatgaatgacttttcaaagtaataggaactacacatctgccatggcctgagaatgcttacactctaaaagccatacagaaagttacacctcctatcaatttcttatccatcaaggaacacaataaacaagctttgaacttttccatttaccaacttgaaggaaagaaatgcttcattttctttagttttttgaaataatgactgcttttgcctcttacatttatagcttcaatagccatgatctaattttaagggtgaatgcaacctttaaacaaggtttatgatataaaaggaaatttgtccattacagtgctcagaaacttttactctttaggtgaaaattattttgttgctgttattgttgaaacacacacacacacacacacacacacacacacacacacacacacgatcatcttaggaagtaattggacaagattaaaacaattaattgtatttaaaattatttagcaatttacaggtttcttattcattttgctggcttcatttataagttatgtattttaaatgtggacactgaggaacaaatgtttagagggtgtgctgaggttctcaaggaaaataattgttgtccttcggacagaatatgatgtttctatgctccttatattaataaatagcacacatgtgtatgtgtgggcagggggggagcggggtgtgtccatcttactcagcgtgactgacttttaggctgagattaagtcatactcgtctacatattcttccaagtctctcacttcagtttatacaccacagttgaaaattgtattttaaggtcaagctagtcgctctcacattcaaaactacctcccatcctgcccctgccatccatacatgcaacgaattaacatgtgcatttggaatttctgggtgtattctcggttcttgtcaccatttcaacctaagtgcttccagtattcaatttaaataaacgttacagtttctgggtgatttacacctctggaatttctatggcgactctatcaagagaaaataatctggccataaattactcacattagctttttttttttcctcactcaaaattgactatgagcactaatgagtcaccacacttccttccaatacccttggatgcaactcagtcatatttgagtctgaaactaataaatgaagccccacaggtcactgttagttttgaatccacattctctcatgctatagtgttaacgacaacaacaaaatcccattacaaaagaaaatatatcaaacctcaaacaaagttttagttgagagtaacaaaaatagtttttggatgccatccctgacaagtaaaacaatcttttcaatattataattgtatagtcttattttgcatgtgaaaaccacagatacatagaatgacaaaatgattctagttcacaagtggtcccgatactaagaactcttttaaaaaatggaaaaatacaaacaaaatgactatgaccaaaacccactcttaaaatagagtctgaagtaaaattaaacttttagataataaatatgatcattttatgaagtagtgtggtctctttgtttagattattatttctgctaacttttccttgtgttcaaatcctgagtgaaacttaaaaccatgtatttctcccagcattagggctacaataaaatgtaaatgtatatggggggcttctgtgttaggaagaagttaatataacagctcgtttatgaaaagctattgttttacaccatttaagtaggaaaaaaagttcctacagtctgaaattgtatctgcacatttacagaaagggggagtacactcatctacccaataaagtagtcacatttatgaaattactttataatttttggttttacattttactattttgagaaggttcataatttgtctaaggagtaaaagtcctcatgataaagtgataacacaaaggaatcattaattcctcaacatgtatttgcttgacgtacgttttgtgatcaaataattatagtgatttcctttgataaaaataataattaccttttgcctttaatttcaaacataagctatgaaccaaatactggagaatttttgcaagtggcataaaaacaatttatgtctgcctatctgctgtgaaagttgtataataaaaagatacaacacataccatgcaaaatttaaatgtgaacaaattaagagcaaagttgtaatggacatttatttttcactgggtttttttaaagcataattattagtgttttttaaaactatagttcagatacttatcaaatattatcagtgggtataccatatttttaaacatttcctagaaaatgaaatgttttatttaaatctttttgtgaataatattcaaaacttcatgccataattttccagagaagttgctgacacttaggtagcacaaactctgacctgttcaggtcacttaatgattatgtttaagggtaatttggggggcaaagttgtagggattcacatttcctgctcagcacataattgcaacagctgaggggttaggaggtcgccactcagtggaattgggcacccattaaatggcacttttatttcataggagaatgagtccacagtcaaggggatcaagttgctgaaacttgaagacacacatgtacagatacattcactcattcacacttagccacaacttaagcaaactaaagaaactaatagtaaaaccaattttctgtgaaaagaaaacaaaaaaacagttcacatgagcatatacaacaaagcttcatacctgctgtgcaaaccacagcaagcattttgcgctcaaaatatgcctcttttacagattatttgtttctctaatgttaagcaacataataacttaagtatttggttactagatttgacaattggctcttttgtgaaagcaaatgagtatgacttggagttaaccttacaggaggccatcatattatactctagttaacaatggctttctgcatacgtgctacaagtccatcaaatcgatggccatctgtgtgtactagagacacagagtatcaacacactgaacctgaaacttgttattcagggcccacccactctatagctaccaaagtatattttttaaagtaaaggccacatcacaaagtgggaaagctgttaatactatctagcattaattctgtattagaaggatacagttgacctagattcaaattctaaatggttaatgcttccagatacgcacaaaggaagtaaatattctaataaactaaaacatccacagtaaaaatatcagtatactcacaaaagacaaaaaatactgttcattgtgaggcagaattagctactttaactcaactgccaactataacctccagcaacaaccactcataaaacaaatcatcaatatttgcacacagaaaaacaaaaagtcaattctgatgccatttttctgtattttttcaggttggaggaagtagaagaagtggttgaggactaaaaattcttttaaataacaaaccagagttataattcaaaagcttgtgtctttgtaaagattacattgtcatctaaacaaaattacaataccagacagtaatcaggaagaatgaaaggacaggcagttgtgttcactcttccagcaaataatcacttgcaatcattactactctattctttcaacaagcatgacagaaagtagcatcatgacagagatcattgtactgaaagaacatcttaactttctctgtggttcactgctgccttaaatttgaaaaaaataagagaagggcgggggaagaacttacttgcggtttaaagtttcatctttagtccatgtaagattatgcagcaagttttcttgccaaggctgcctcttgcacatccctttaaaaagaaccagtgctcataatctagttccaagacgattcattcacatgttccacctcttgtttctgtgaggcattgatatccactctcatatcatcaagaaaatgttactaggaaaatttttagaaaagcaaaacagttcaacatgttaactcagaaagcataccatcattctccacgttctgagatgtatgccacctgccttagttaccacaagcaactaacactaagctgctagcaggaatctgtctgccctctatctgtcgctattagctcagcacgttgatttcactggcactgaagcaacagcaattagctatcttgcttctcgcagcacatacaggagacagctgagtgcgctaaaccacgcactgactggtgagcgctttgcaccaattagtagcaggtgctacagcccaaaagacaaattgatgtccactgatcatcggtactggctgctttattgtactgtgttcgtcagcctgtctgatgattctctgttctgttttgtgtgtttgtttttactgttttactttatctaagaagtttagcagcttacattcaataacaatgtcgttgacaagataaaataatctcttaagcttcttttatcattctctctgtctctccctctctctctcattaaatctaccctcttatatgaagccctccacatctttggggcataaaaacaaaacaaaacaaaacaaaaaaacaatttcacaacttcacacattctgtaggagccaaaagtactctttagatttttacaaacacgtgtgactggtagtatataaggttatcacgaagaaatatactatacaaaacattatagcatatttcttaaacattgtaatatatgaaatctccaaaacaaagttttacagatggacaggtaaactagtaaaatacaattatgtcatataaatcagagaaacatttcttaaggaatctatcttgcatagtacatatttcaattccatattaaatttcacccatgtgttcacctgagcatatgagaaggaaggatctagaaacaagcaatttaggaacatattttagtagtgattgtgacagagcagataggctgaggctggttgaaaatgacaggtgaagactatcacagacaaaagccccagaacacatgttttcttaatgaaccatgtggattatttactaggatgatacattaactctaagaagaaaaagaaaaccatgcctccagaaatgttgccgtatttatgcacaagcatttgcagaaaataacatctcatttaaaacaaaatggacttatcttgcaggctcagttttccagagggagggaaaaatctttaagaatatggaaataatctgaggcaagccaaatgtgttatacattttaaacattaacacgtgtagaagtaaatcagataattatagatgaaccccttgagcctcaagtggaacccatttgtttttattttatgtaccactgaaacaaactaaattacttgcttccttaaaaccacagatcagtgggagtcaatgaggacttgtaataagtgaatacattatacacttgttagaactgatatttttagattttaaaattgatgtgttaataaagataactttattgatacatgtttaaataatgagcatattttgtgtgagaagtttttctgttcatttcactaaatgtctcacctgtggagcaatccatatattgatatttgttgaatagagcagctggtattttaagattgtttcagtaaccataagaattattaagtgtagttatttttctaatgacaattcagcctcattcgtggtaatgttcaatgataactctgatgacacatcagaaatatagctagaaaacagaaaattttatcccttcctcatcttctcagagcaattcaattattactaattgaacacttgtcaatgacaacagctgattttcattttcaaaagtaaattacaatatctagttttcagaacaacatatttaatgaaatgtgaaaatgcaatatttacttcgggatgaataaaggttaagttttaaccagtttgaaaacacagtaagcaaaatggagtcactgtaatatttactactagagatgatattttctttgaaaaaagtgttgcataatattctgtcacctcccctgcattgtaaagtccacttgaatcctactctgaatatgacatttaacttccttttttctcttaaaatatatcgtgaacattcacttctataaacacatataggtttaaattatcatctatgtttcattgcatgtatatgtatattttctttaacaaaatacctattttttgacagatagtttctaattttaatatatttgtagaatcctggtttaagacgcttaactttctgaacttgcattttaccacccttaatcaaggtcttgagttaaggtggctggggaggagtgggataaagtgccatgtaaccaaatgacaaaagcttgtgagcctttgtgctctggcttaggggtgggtctgaggaagaggcaccgttttttttctttccacaaaggcaacaccatgctatccactattcatttgtctaaagatgctttctctaaaattcacagaggtgcatgtggactagacacactgctcatacagagtggtctgttacatgagagaggaaatgtaaactgtctaccacaaagtctgatacacaggagttgctctttaaatcatagctgtcaatcatagatacatgaaattaggtttagtttactttacgacggaaagagattgtattaggtgctttagaaagattttgaacattgaaaacattaacatttaaaacatttaaacattgatgattagaattttattaaaaaattttaaaagtcacataatacagtttaaaaatgaatcattaaatctatcaactatagaaaaatggatatataaatttcattacataattttaaggatagttatatagctcttgaagtactaattatgaaacatattaaaaagtggtaataaacaaaataagctgtcaaaaaaattttcttttttttttttgagatggagtcttgctctttcgcccaggcgggagtgcagcggcgctgtctgggctcactgcaagctccgcctcctgggttcacgccattctcctgcctcagcctccggagtagctgggactacaggcgcccaccaccacgcccagctaattttttgcatttttagtagagacggggtttcaccatgttagccaggatggtctcgatctcctgacctcgtgatcctcccgcctcggcctcccaaagtgctgggattacaggcgtgagccaccgcgcctgccagctgtcaaaattttaaagttgaagacaaatagtatacattccctgttaataactgcattcaaacatgtccatattcataaatactggcaatgccatgatgaatataaagtgatgattattgtagagaccatgctgaatctttcccttatgtctgttttcatggatttttatttcttaaattcctttttgcaccatcttcttgtcattcacctccccttccaaaaaaaaagaaaatgaatatgtttagcagatttttgcttcttcatgttggttcacaaatatatattctgtgttttattctaaatcttcatctaattgtattagaattttgtgagtatttttcataaaaaagtattttttacattccacaaagcaatgatatagaaacacataatgctctactgtatgccaaaaattagctacatcctacacacagctgtgaagattaccataaacatttgtgttcatgccagttcatctgtgcactggtatttaatgaacaatgaaaagcaaatatctagtcaaagatacaaactttctttttctgtatttaatttttttggaatcttgacttgttttcatagtagattatatatatatatatatatatacagagtttgctacagtgcaaagctagttctctcaccagcaagagaattaaaatactgtttatgccattgacttactctggcaaatgtatatattaactaaatataatatttcttataatatttccagtgttttggtagggaacatttcaaagtatcgggttaaatatagcaaaccaatactaactcatatattattctcaaatatatgtctttgagaaaggaagacataagaggattttgtctatcctcaggatgagggctgagtcctggagtcaataggaactgcaaagtaaagagaggtagagaaggcatttttttaaaacccaggttaaagttttactgaatgaaggcctctgcagtattatcaaaatagccttgctcattacaagcagtgtctcaccaaattgcctgggatcgagtcattctagacgacttattgtcagcagtcatttagagttgagattcaaagctgttggttataatcacaaaaagaccttaaccagggacttggcaactggagggtcatctgtattcacaccaataagtctttgtcatgatttcatgttgcatagctttgttttttattctgacacccttttattgtcagaattcaaggtagacatagttaatttagtttcttgccagcaatatctactttcactttttttaaccctagcacttacctgttttatagtgacaacttgagggataaggaacagtataatctttatttaatacttgtctctgctgagtttccaacaggcagactgttatttgagaaaagcaatttgggatataatacagtagcttaagggcaatgctccaagaaataactaatttcataaaattataggtgtataataaatatacaatgtgatttagtaaaatatgtaaagatgttgaactgttcacatcatcttttaaaatataattcttaaagagtattaaatttagagcaagaaacttatttctaagcatttctgttgggctttcaaatagggactatttttatgcttgagtgagattaggtattataaagtcaaattatttgaatatttcatataatctaaaattatttgaaacctggaaaataaaactaaagagaagtgcagataatatttgtaaaatacttttttaatttaacagatttattatttagagctatcttatactttccttaggaatacttctggtattttcctaaggagaagaatttagactttacaaaatagtttaattggtttaaacagaaaaaaagaattacatacgctacctcttcacaattccagtttttatatgctggatgtattagtattgtattgttgtataacaaattatcccaattttagtagcttgaagcaacacacatttattatttcagtgtgagtcagaggtccagatcagggtctcacaggctctaatcaaggtattggctggtctgagttctcttctcaaggctcagctggggaagaattcaggttgtttggaaaaaaaaatcatttggttatgactatatgactgaaggttctggcttgattttttttttttttctgagacggagtcttgctctgtcacccaggctggagtgcagtggtgtgatctcggctcattgcaacttttgcctcccgggttcgagcaattctcctgcctcagcctcctgagtagctgggattacaggcacccgccactatacctggctaatttttttgtatttttagtacagacgaggtttcaccatgttggccaggaaggtcttgaactcctcacctcgtgatccacccgccttggcctcaaagaattctgggattacaggtctgagccgcctcgcctggcctgagccaccacgccaggcttaaggactcttggctgaagcttgcttcaggcattagcggctcctcttagttccttatgccacatgacctcttaataagcagtttaaaacatggctgattgctttttcaaggccaccaggagaagctatgtatactagcaagataaaatcttacatctgtattgcaacgtaatcgcaggactgatatcctatcacctttgccttagtctattggttataagcaagttatgatttcctcctgcactcagagggaaaggatttatacaagacataatgctagtggcccagataaagggaccatcttagaattctgtctgctatgctgaattatttcctaaagtatttagcatattcagttagacagcaaattatatctaaatgtgtagaaatagtaatttagtaaagttgttgaaaattctgaacaatcaaacatactttcaataggtttaaaaatcgtatagaacattttatatgtaaaattatacataattgtatcagagaaaaaagaataatatgagccccatcaaactacaagcactttgatcacttagttgacatatttggaactggaatagttgtgaaaaatatttccaaaaataaaccaaaataagtattaaaagaatctcagtataaccttaagctacatgcaacagaggtacaacacaaactgtaggatagtggctactatacattgtactttttgtataacttgctaggaacttgggaactttttttttctctttagtgagtaaaataaaaggtcaagccagccttatgttgtctgtctttaatagaaaattccagagaagattaccaagctagcctcttagatttcttgagtctaaaactattactacatacaaggtttacttatttatatatatatttataagtatataatatattgataatatttatatataaatatggataaagtatgcatatacttataatagtataaaaattcacatgtaaacaaaaacaaagctatttaataggtaatgactgaattattttgatcacataaagcttttatttttaggctgtaaattatagaatgagtatagatttaaaattatcttcatcacttttctacattgacagcctgtggaaaaattatcagcctaatattttgctgaaatggcctcagttatttctaattacaacattaaaattttaaaatttatataaattttatagttctttggcgttcccagtttcaacaaatattagccgagcaccttcttataccagacacaacattagatgcatttatctaaatattatctttagataaaatgagacaaatcactgatgtctgctgtaaccgagactgatattatattactttttatatttatactggtttctctttaactcagtaatcactattttaggccattcaaggaacaaattttgaagcaaattttaaaaataatttattctgtctgtcattctttgtcttttgcattctcctccaaaagcagccttagacaaggttgttgagggaaaactggcatttatgcaaaatcagagagcacatgtgttagacatttccaaatcaagcccacatagagagggaatacagagtctgagttactgctgagcccagcaagctgcttctttgcatggtagagcagattgaaatcagcgaagaggtgttgagtagatgcagtcattttattcacttgccctctatcaagtaaggcaataacccaggcagtctcatcttttagctcctactgccaccttttagagccaccatcaaaatctggatcctaaagaataatggacagctgatttatttcttggcaattattcagctagttccaaaatgtataaaattttcttccttcaaatccatgttctgctggagtgaaggaatttgtaacagctttatagcttcatttaaaggagtttcataatttccatagcaacagataaccatgtcacatattttggaacaaggtcaagttctactccagactcaaaatgctatgacaggataattctgcagttaatggaaacaggtagaaatatagaagcagggataccttccaagacacattatatctttaactaagctcaagttcatttttaggctgatttagctctagagagaatttaagtggctgggaaaagaaaaaaaaaaaaaccaacacagattgtattaagacgctaccctaatgctgacaacctgagaaacagtatttttcgtcctgatcttgacaataaaatctgacctgtgtggccatagtaagagagtataaattacactgagggatactctttgcaaatttttaaggtatgaatattatttgtaaattacttaaccatagggtatcttgctctatcatgttaggaaagctgttggattctaaaattgccattgattcgtacaatcttaatccagcccttagattgtatcaactttctctgttagtaatatcttcctagattttgggtttacttaaatttatagattaaataaaggaaatataaaactcaatctattaggatcactgatttcctctgtaattcctacacaattctgacagtataaatgaaacttaattctggggaagttcaaaaaagacattccggcaaaaaatgagaccgtttaaatgcttcaatttttagcatttttatgttaaatgccaacatagtaagaaattacaagtttggcaaatatatttcaataaaaatataatgagaatccagtctcctgcatagaggaatgcttattacacactatgtatacattgtattattatctccttttcagaaacctcatcttatctcaatccatagaaacactatctgaaatgctgcatgtttatttattcaatattgagtgccaacaatgtgccaggcaaagctgtagggattggtaacacaataataagacaggcatgaacaaagcatgtaaaagagtggatattcctcagaataaatctggatcattgaaagagacaaagaacaaaaaaaaactttgttggacaaggaagttgactatattgtcagtttgctcaagccagaattttcccactttaatacttttgagtaattgaaacaaacatagataatttttcagtcacctttgctattagaatgtgttacgctagccgttagtagttttaagacttaaaagtacattttgggggaaacaacttaaacattcagaggagatgcttctctcagtttcaatttgatcaaacatttaatatattttcttctgaaaagtgatacttttgttcaatgtttctcaatgtgtgcttttaaatagcctcaagatgctccccccaaaaatgaatgctcaggatactgtagtcaattttcaaaaataaataataaacagagtactggattatcttcatcgtcacccttggggcatcttatgataagtgggtctgtgtgcaatgttcaggcataataagtttcggattctcattcttatctcagaagtattgtttttattattgtttatttttcacctcatataccaaagaacaattccacctaccattacagtttgctatgtgacctggaattttccttattacaggagtaggatgcgtggaatatcctggcctagagttctattaaggagtgagtgcctcttgcaatattatgtcttcctggtttgcctactaatgtaccaaatatggatattgtacatctttctagacgtaacatcaacaaattgggaaaaaaacacagatttcatgattcatataataaaatatgtcacaaaaaaataatatactttaataccttgatggtaccccaaatcttttgcattgattctaacattttcactctgtatttcattttaaaacaagtgtcaacccctagagtgtacaatgaatgtgttctgctaaactctattaacaaaggaccctatttgaaaatatgagagctaattttatttttctcctgatagaaaaaaaataattgcaataaaaaaactaaaatttaaatttccaacttagctgaattctgaatcaaatatggttttcttttcaaaacataggctaatttttgagaaaataggtttgattaaagtaagctatggatgaacttctaccttaagaattcttttaaacataatggtaatataaaaatagtattattcttcataatactgtgactttggaggataagtcaacaaggagtagaagagcaaaaagtatctgtagaaattcataagtggagtaatccattatgcatctatagtcgtaagtttgaagactacaacatttttactcatagttatttcatatttttaacaagtagagtttcagaaatacattgggactactcaatattatgtgtatatatatatatgtaaatatatatatgacaagtgcaatgtcatcttgacaacataaacaaatgtgaacattttctttaatgatttgcttctaacagcatgttcacataagcaaataaaatatttttcctgagaaaaatttatggaggataaaaaacacatatagattctccagggcccaagcactgatgcggtgtttgatatagttaatttcatgaaaaattctagttttgagatctttgaactgggccattctctttcaacttttgttaggctgtaaatttttatgaaacagtacaaccatcgctaattcagttatagctaaataattttttttattttatttttattttttgagatgtatttgtgctctgtcaccagactggagtacagtggcaaggtcttggctcactgcaacctctgcctccctagtacaagcgattcccctgcctcagcctcctgagtcgctgggattacagccatgcgccacgacgccccgcaatttttttgtattttagtagagacggggtttcaccatgttggccaggatggtctcgatctcctgaccttgtgatccacccgcctccgcctcccaaactgctgggattacaggcgtgagccaccgcacctggccagttatagctaaataactatattttaataatctatttgtgctcttagaatcatctcagtaaatgtaactaaactgaataattatgagtttaacaacatgaatgcaatcagttattccctaaacggcagttttaaaactcttctaaagtttatttttcattttttaaaacttcatcttaaatcctgtctctcatttataaatatacatcaataaattataatttctaagaaatcttaactgtaagtccttctccaaagaataagtgcatctccataattcttaattaatcaacatattaagctaagtaataaagtaacataaatgatgaaaatatgagaatatcagttataaaacatttttataaaacaatcccaagtatcaagaagaataagtttctatttcagatattcaaaaactctcccaataccagcttaaaaaaacaaaaagtaaacaaacacaaaattgttggttccttccagttgccaccttcttctcttcctcttcctttttttttttttttttgagacagtctcgctctgacactcaggctgaagtgcaatggcaggatctcggctcattgcaacctctgcctcctgggttcaagcgattctcctgcctcagcctcccaagtagctgggattacaagtgcgtgccaccacacccaactaattttttgtttgttggtttgttctgttttgttttgttttttgagacggagtttcactctgtcgccaggttggagtgcagtggcgcgatctcagctcactgcaacttccgcctccccggttcaagtgattctcctgcctcagcttcccgagtagctgggactacagggtcccaccaccatgcccaggtaatttttatatttttagtagagacagggtttcaccatgttggccaggatgatgtcgatctcttgacctcatgatccgcctgcctcggcctcccaaagtgctgggataacaggtgtgagccaccacacccagcctttttaaaatattattatttttcgtagagatggagtttcaccatattggccaggctggtctcgaactcctaacctcaggtgttccacccatctcagcctcccaaagtgcttcctctctttaaatagcaaactcttagatatcaaacttcttccaagaacactatcctcactttgcacttactgttttgacacttaaatgtggattctaacacctacctaaaacatttcactgattgtcatagatgcttcaatttccaatcttccctttctttgcctttggctttttaaaacttttcagaacctccaacaacctagagtttattttcctggattgccgaacaccatgctctcctgttttctcctatgcctgtggctcttccttcttagtcttttggtggttccccttttctatcttttctcaaatttttaaaacatttagattttgtcctaggcacttttctcaatacattcaaccttgtctttctccctagacttttatgcactcagataactgaggtttcccatggagcagatgatgcccaagttttcacctccagtgcagatctccgttctcacataccatctgcttagtagatgtctccatgtggttataccagaaactcaaaacagatttgcaattcccttgaaaccttccactattcactacagtgtacttgtggtctagcattctccctctctgcaaaagatacccccatctatgcagttgctggagtcaaaaatctgagagcagctctttttttgtgtttgcggggtgggggatcactttcattcctaatattctcttatctcttttccaatcaaacacataccaatacagttaatcatacctcataaacatttctcagctctattccttatttattctccaacctctgtgtaccacaatcattgttcttcaagactacagcaatcgtctcttaacccttcttttctaccactgtttctcttcaatctattctgcacatcattatcagaatgacatgtgaaaaagatttctgattaagtcacatctcatttagaatccattactgttttctgaaatttgtttaatgtccacagatctttacataatttcaatatctagttttatctggcctcatacttcttttcaaaatttattttattccactctcctcttgtctacctacattttagtgattctgaacactatttaattaataaagcatgtcacaatcactccagacttatgtcctgttcatatgctaatatttctgctgaaaaaaatgattttaattcccagtctacctcccacacatatattatgccagctaattcatagatgttcctaaaatctcaaatatcataagctcctgacaaattaaactttatattataagcaaatttatgtgtcaccataacattgtgtaatttgtcctttattcctccatttgttttacaatgttgatcttcttaacgggaccatacagttaatgacatcagagactaggtttcccttgcactatattccagaatctggcataatgactggcacagagcaaataatggatacatacatgtttatttaaattcattttaaaaagtttcatttgttaagaaagtacagaaatgacaacacagaaaaaaattaaacgtgtatctaacaggtaaaaattaataaaaaagtatggcaaaaatatttgtgtatgatttctatttagtctttataataacccttcaatgtggtcattataccacattttacagaacagaaagctgagttcagagaagctaaatatcttgcaattccttgtagctaataaataaatgacaagtccttattgtaacataaagggtcttttctgatctggtcaacactttcttcatcagaataaggtctttctgttgttccatttatatcctatatatcagctataagacatgattacagttccccattaacacattaatgcctgaggttgcaattttttgaatttttgcaatcagacctttgtgttgaccttgagcagtaggatataaataattcccacatgcttagcgttccaatcatggaacactaggcataaatggccaaatatgtttgtgcttctgagtctttcatcctgtttccatctgatgtgaggctattttatttcttgaccttcataccacctcccagacattggaaatcttgtttattcccttgaatcttatacttttcagttaaatagttaacattgtgatagtgtctttgtcacccaaatctagtcaaatgcccctcttctgcaccaggagcaccaatgatcacctttattttaacgtacctcactaaagttgacccttggacaataagggtttggactgtgcaggtccacttatatgtggatttttgttcaataaatatgttggtttttttttttatatttgtgacaagttgaaaaaactcacaaactgtgtcacctaaaatattgaaaaaattaagaaaaaagtatggcatgaatacataaaatatatgtagctactagtctattttattatttactaccatgaaatgtacatatatctattataaaaacttaaaatttatcaaaatttgggcacacaaagaccgtacatggcaccattcacagttaagagaaatgtaaacaaatgtaaaaatgtagtattgtaactgcataacatttactgcattatatactgttctacagtcataatttcatagccagctcctgttgctattgcggtgagctcaagtgttgtgagtatcctcttaaaacacaatgtgaggtggatcatctctgcatcagcagttcatctctccagtaaattgcatatcacagtaaaaagtaatctcttcaggttctcatgtatttttgtcatgtttaatgcaatacccaaaccgtgaataacaccatgggacccatacaaagtggcactagtgatgccgacagtactcccaggcaacaaagtcatgccattacaagaaaaagtggaattgcttaatatatgctatatagattgaggtctgcagctgaggtggaccatcatttcagacagatgattcatcttgcaaacagatgataaacacagtacactactctaaatgtattttttctcccttattattttcttaataacattttcttttctctagcttgctttattggaaaaatacactctataatacatataacatgcaaagtatgtatgttaatcaactgttattttatcagtatgtcttctgatcaacagtaggctattagtaattaagtttggggaaagtcaaaagttttatgcagatttttggtggtgtaggtgttggcacctctaacccctgtgttgttaagagtcaaccatacattgcaaatatttacatgtctcctccataaattataagctcctagagatcagatactatgtaattctcaacattatattccaggtacctatgaaagtgcctgacatattggagatgttgactatatatttatgtagtattaaataaatggatgcaagagccagggtttaagctcagatctgtctcttaagaagctcatgacttttcagtatatgcagaaaattggtaatggatataactaaaatctagtagattatttgagagtctacaaatgctgagtgaggaagaaagacacagttacaaagttagaagcatttcaaggcactttattagttatttaggaaacgactatttcatagcacaagaaagccaacataaatcacaatgtcaaaccagccatgcttgttgccatgatgccttttccaaaggaaaatgagaaactaagatatttttcatgccctttgatttgtgtgggcagaaaagtaaaggggagtgtttcaacacaataatctgttcattttcagaagaataaacaaaagctaaaggaattcacttttattagttccaaaattaatgttaaataaatttgaatgtttcacaatagagtagactttagcagacctgctgtaggcccaatgctacaaaaataaattgaattataaatatgcaactgtggtccacaaatattttttatatagttacaggatgaattcttaagtaatgatgtccctacccaagtcactatctaatggtatgaaatacaacagttttgagctacattgaccttacaggtccctcctcttacttcatgaacttcagtgcccactccagaaaaacttacatatttacttttatcttaagaaagataagtgtaccctttcatatatttttgaataaattgtaggatgttctgtatttaattgaaaggcaggcaacctaaaccttagttataatttatgccagtctttcaaccaggaccaagttttgttgtggtttactcattaaaataatatttaatgcacaagaaataatatttaatctaacattatatatgtaaaatacattaagagaaattttcagtaaaatcagtcttagaatgtattgtcatactttctttgtgaaaatgtgcatgccatactacatttgaataatagtcttagaagctgtaataataatagcagagctgtcttgtatagaaaacttgccatgaatccttaaaaataaatatatgttattttagaaatgaggaaattaaggttgaattattctaagttaattttctattatcacacaactactaaaaggtagagcaagataatcagtcagcctgtctctaaaacccacattcttactcatctctatcaattgtttcaatgccgtagaagctgaaatgaattcttgttcatcaaaaaatgaaagagaattcctgtgacctcgcccatcacctcaacattgctgcctggatctttgccactgagatgattctattagtaaaattgtaagtgagatagttctatgatgagaaattcacagtaatttcaatcaagtcatttgcattaaaataatcttacaaagaattatacactgtattttgggggttactatgagacccatgtatatcatctatacaatgtgttctcataaaacatgttcattatttcttttcatacatgtcaatgctaaatttactaagagaattacaatatgtgctgacattaacatctgaaagttattttcattttaatagctgtagctatatcttattaatattacagtcccccttatatttacacatatgctaaaagcctatatttcattctgtcttgaatcataattaattacttatgtgcctaaatacctcagagggcagtattagggaagggacaatgtttaattcttctttataacctccctgatcttagcataaagcttagtacttagtaacaaccctaaagtttggagtattaaaatccataattcacatctcatcttttttttcctctcctctgtctatctatccatgtagtttagattatttttgtttaaactacctatttatcacaattcattgattaacatatagtttagaatgttcatgtgacaagtgttcatttagatttaaaaatttttaaggaaaaggcctaaagacctttacttaagaagagaataaaatgattgagtaattattagggcatattcagtaaaattacttaatgattgcaaattgtggcaaatcgtgctttccagactagatggccacatccgtagtccccctcacaaatgttcttctttcaacatactttttttctgtcacttttcttattaagaggcagagtgtataacctctttccttgaatctatgctggtttgttattctgaatccagaggaagtgactgtaatttctgaaagtagctggtaaaggccatatatcttccatctggttctcttgaaatgctcacttagaatcctgaactgccatataagcagtctgactactgccatgctgtgaggaagtccaaattatgccaggccgacagaataaatgaagagtttctgagattacatgaagacaatgatatgcctggatatctctttccgttattctaaccccctccccgagtgtttttgttccatctactatctgactgaaatggaattagagaccctatgaaagaacttctagtcatgaaaacacacagaatatgagatataatacaatttgattgttgctttaagccactaattttttagatgatctgttatacagccagaataaatgaggcaccgatttttcttataatagaatataaattctttttacatgttttatttttatttatttattttagagacagggcgtcattttgttgtgcagactgaagagctgtggggtgatcatagttcactgtaaacttgaactctggggctcaagaaattctcctgtcttagcttcccaaactgctggaattacaggtatgagccactgcacctgacctagaatataaattatttcagaacagcatctagggataattatgtgcctacagttaatacataaatatttgctgaagacttgattagatatacctcattttggacatgcaggtcccatattacattttaaacattcatggtaactgatagaataaggaaataccaactctgcaaatattatatgcaaataatatttaattagtgtatctaatatctcttgctcatatttggggtctttaattcacaatgttcatatttaatcattttcaattggtttaaattttaaaaactgaaattactttttctgtttttacaaataatagttgactttcattttacattatttgttttaaaaaacagagcttattttttctaattttctctagttttaaaaaccttctagatattactaatgtttatgattttgacaacttttcttattgatatcttattatcaagggttaatgtcaatattgcattcattaggaaggtgtatgaataaagattctttaaaattattattttcacgaatgtttctctgtaatttttactgttagtgtggcattcaataatatgtaataaaaggagactatctcagcctatacattattaaaaaattacattaagccattactccaaagactgggaatcacttctttttgttttatgtcttgtatgtgcctttggaaagtggtaagttcaatacatttttaagcacttgtgagtagatcatgtagatcatgactagattatcttcattacttccttctctgtgaagaagaagtgtagtcacataattattctaaaatgctttttctctttcttgtagtttattcctttgtaataaaaatacatatcatttagccttataactaaagcattacttgattaaagtagtatcaactgctgtcaaaataagtttctggaaaaaaaaaatcaagcaatggtcaagaaatcattatcaaagtgtattattatgtgatatatgtgaaagttttgttatctttcccatagaaaccattccaacaatgacaaggaaagtaatcttagtaggacagggaaacttaccacacccatctgatggaatgagatgtgtaacaatccaatggagatgtgtaactacctttgctttcagtctctgtaactcagctttttgggctccatcgagatacttcttccagtcgctatgttctacatgaaatgaatcactcatcaggataaagaaagtttcgttttttagagtacattgacattccttttgctgccagcatcactccatattgatgatctcatttagtcttgtaggatgcaagaatattgcattcttttattttatttgaatcttttcttttaaagttgttctcaaagttgacagaaatcatgttgatcaaagttggccctgcctggtttaatcatatttaaaagctttcaagataataaataaattttaaattctgccttattgactttataagctttttattacaagatttttaaaggaaactatcatttacgttaaatgttgcttaaatatcctgatttgtgatgttcaactttgttttagagttcctacgagcaccataaagcaatgcgtagttaaagaaactatagtttgctaaatctgacatctacagaggatcagtaacttacactattttaagacctaggaaaatccacatttgtctttaaagccacatattatcaagtattactctcttccagccaccaccattaatgaattatattaattccattatggcaaaaattactcaaaataaagaaaggaaaatcttaagaattttatgaccctcaaagaacttttaaaggtattttgcttatgtatcttagctattttaagagaaatagctaaatacttgcatggaaaatgaaacatataatacaaaacacacatgatggatacagtacctcttttgcctcttaatacgactatcaattctttgcacttctacttacccagtcttgattatttccagaaaaaaaatttttaacaattaaatataatgtaactagcccatgctttccagttgaggaaataaaatgacacatacgtctttttcatgctaatgcaaccgtgcataatgaaatccatatcagcattttcaagttccatgtttgtgtgtatatttacaacacagttctagactatgcatcctagctaatgttaaatacctaagtatagtgttttgagcacaaccttatgtcaaaccctgacccaactatgtacattagaacctcaagatgttaggcacagtgagtcccattgttgtaggggctaacatttacacaattttctaaccctttttaataaaaaaaaaattacaaatgtaaaattagaagtaaaagtgaatatttaaaataagaaaacaaatcatgacaagctacgtttttaaaagttggcacataccaagaaaatcacaatatatagaaaaaatattttttacaaataagggaccacacatgacacagatatataaaacacatttttcttatatttatggtagtattatctttgactacctcttcacaagactgcaattttgtgatattaatatctctagtgagaatgtaaaagtaatccggtcttctggctactatgaattatctttttgttgttgttatcaacagctcagaattgtacttagcttcacaactataaattgtgagcattgtcatttttggtagattctccaccaagtttcattttgtaggaactctaagattttggaggaatttttttttatgcctgtttgtttcttttggtatggtgattaatcttaaacacgctttgaatttttagtattcatcaattactttgctacagtccctcccaggggtttagaagggcacaggagatcaggggcactgttaacttaagcaagtgagacactcattttaataacctttttatgttttaatttataaggatacataatagttgtttagatttatgaggtccatgtgatattttaatgcaagcatacaatgtgcaacaatcaataagggtaattgggatattcatcatctaaaacatttattatttatttgtgttggtaacatctcaaatcttctctgctagttattttgaaatatgcaataaattattatcaaccacaattgcccttctgtgtcactgtcctattccttttaactgtatttctgtgcctatttaccaaagcttttatagctctccctctcagcctctggtaaccaccactctactctctgcctccatgaggtcaatttttttagctcccacatatgagtgaaaccatgtgctatttgtcttcatgagtctcgcttatttcacttagcataatgttttctagttccatcatgttagtgcaaatgacaggagttcattctttttatgggttaatcatattccactgtgtgtacataccataatttatttatctattcatcttttgatgaaaacttaggttgactccacatgtttgctgtttgtgagtagtgctgtaataagcataggggtgcaagtatcttttcaatatactgatttcctttctttggatatataccaagcttctggattgctggatcacatggtaattctatttttatttttttgaggaacctccatactcctttccatagcagcagtactactttacattcctgcgaacaggaatacttcccttcctttacatcattgccagcatccattgttacttgtctttttgttaaaagtcatataactgggatgaaaaaaatctcataaataataagataaaacgcattttaatataatatatttatttattttattttttagatggattcttgctatgttgcccaggctggagtgcagtggcaaaatctcggctcactgcaacctctgcctccaggattcaagaaatactcctgcctcagcctcccgagtagctggaattatgggtgggtgccacgacgtccagctaatttttgaatttttactagagacggggtttcaccatgttggccaggttggtctcaaactcctgaccttaagtgatctgcccacctcagcctcctaaaatgctgggattacaggcgtgagcctgtaatgggttaatatattttttaaaacaccagcataaacacacacacacacacacacgcacacgcacacgcacacgcatatacatttaattttcactttgctcaggctccagtatggtcttacatggcactgcatggcagtaaactgctcctcaacttcaacttgggtagctgtatgttaagcttccctccaagagataacattaccattattattctacagcaagaaagacttacagttgttatgtaatggtaaaagcttgtaacactggtaacattccaacactgttctgagcaattcatagttgtttcacacttactccacactacaaccctgtgaaataagcatttttatatatttttatgttaaattaaatgaagggtagagggtcctgagtaatcataagtaggaagtatcagacttgaatctaatttcctctgatcctaaagtcagagctattaatggctatactgtattgctgtctaataataatgtatcttgtcagtgaaaaataagccaagtgataacaaatcttgtacccattggtgctattctacttcatttttctgcaatgaaggcttactccagcatgtaattttaaaattagaaaaaataatggaaattgtttatgactcaaaaaaaagactaaaaataattgttcttgaaatcatacaacccaagaaataatacttgatttagatttttgcaaaaagcttatttgaacagtatatgcaatttttctttcctgcactcccaaggttataacagaaaagacaaacaaatttattttaaatgtttataaatccacaacttgtcaagcatattatcaagccctggcattttcctgctatcaaagcatattagcacaatctctttattgttccaaagtttctaaggcaaaccttacatcttctgtctgaatgccagtggaagagtttccacaggagtgctctcataaaactcaagagattttatttcctttctttagctctctcactacctgtataaattcaccatgtgtttatggattccaaagtactgcctcaggatttaaacatgtgtataataaatacatgtattgaagcccactattacaggggttattaaattttataatttatataatgagcaggaagccagaagtaaaagtccttgtttgacccaagttactgtcggtttcacaactcatcagagaagaaaaaagaacaactgtggaaaagatgtcaggcatcttagatggctactctggttagactgaggctttttcccatatgctaccttgaagaaagagcacagaacagtcaggatgcatgagtaggcaggaggcgctctccagcctttgctgtcatttctgttctaaagaacaagttcccagaggcctctactatgtgatatttgtcagccaattatttgtggaataggaagaaatgggaggcaaaaacatggtagatgaagttctgcctcattcccctgacctggtaaaaatgacagagcattccccagaagcctggatttgctcttatttgtttccatggaagacaaatgatagaactttatttaaccccaaagctcagaggaaatgcatagggaggaaatagacagatggaaataataccaccacttttaccctcaagatgggaaaatgttatgttatctttctttattatcaaattgaataaataaataaaaagcctacttcttttattttttattattattatactttaagttttagggtacatgtgcacaatgtgcaggttagttacatatgtatacatgtggcatgttggtgtgctgcacccattaactcctcatttagcattaggtatatctcccaatgctatccctcccccctcctcccaccccacaacagtctcctgtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccatggtgtatatgtgccacagtttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacgctgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccatttttgatggggttgtttgtttaaaaagcctacttttacaatttaaatgttcttcattttggataggtttctaaacacagtcatcttgactaattagcacttaatatgttcctttttcatgccaggatatgtacttaattagtgatgttattaacacgatccatagtgcacttaaacatgtaaaacatcaggaagtagcatattctcaataatatatttattatgcatacagcctctaatactgagtgattccttgaatatgtaagtccattatgccattaatttaaaatttttcagtcagtattccaaactttctgataaaaattttaattccattgtagaatgaaacattgcctcatgccttcagatagacttagtagttagtgcttctttctgttatactataagttattgtttaatatctttatgccttacactgtagataccttgtcttttttatatttacaccacaggaacttggtaaaaagcctaattttcttatgagggagtcaataaatgtttgttaattgaaaaaaaatccaatcagtctgtaggtctgatatctggaaattttcaatcagctatattgctttgtggaaattcttcctgacataaagatagtttaataaaagtatggttaatcatatcaaagaaaattatgttcaaaatggatttaaaatggtagatgtgtgaggagaatataagatggcaagatacaactgaaacaaaaaaaaattgaaatgagattagcacacccaacagaaataatttatggttctattaaagcaatatgtcatattgtggggaatacatacatatatatgtatgtgtgtgtgtgtgtatatgtatatatatgtatgtaatatgagggaaaaggagttggaaaatctaattcgacttataattaaaagcaaaattgctgtgttgtggtaaaaatttcaggtaaacagtgggtcataattttctgttgtaccatacaaataacctgtaagatttcaagcatgccaagactcattatttttacatctacactaaaaatatgaggatgggacgttaaaagtttcccatttcctaaattaccaaagatgggctaatatataccagaaaaggcaaatataaagctattgtattactaactactattccctccctagaaggtatcaaaaattgttcctaacatacttttctagtgaacttatatgcagacttagaatttgggacatggcactttgaacaaccacaagcaatcactaggagttgtctattgagatgagacatatttgtttttcctaccaaaaacacacaaaaacatcctggttgaacttctgtgcatgccaggaacctggttccaagtgcacatatgggaatacatgtgttgtagggaatggaggccaggaaatgtcttatgatagcagatggccagatagccagttcacctctggatgacagtggctgctctaacaggacagtgatgtcaacactagcaatgacattgatatgtctcaagtgctctctcaaagaaatgccactcagtatgaagtctctcctgagtccactagccagaatacaaatatatataatggtttcaaatgcttgctcaagtaatactgcagtgaacactttattttttatacattgtcaaacaaacagcagatgataacattcaataatcctaaactgggcagtgtacgaactagtgactacaacatgatccattgaaaaaatatttttattagcctcctgagccttggtcttaaaagtgtcttcattctgctaattttcaatattgtactttttaattttaattattttcatcaagtctgcaagatagacagtgagagaaaaagcaattttcagtacacagtcttttaaatcaactaaatttcattcctttttctctcctttgggagcagagtcctgattttcaacatagaagatctggcagaaaacaactgcatcttattaaattgcctgctgggcttactgaaactttaaaaattattgtagagctaatcaccactttcatttagctggcaaagacaacagatatttagtatatctaccatgttccaagttctctgaacatgatgcccaacaatgtataagaaagcaaattttcaatatgagtaatttggaatggggatttaaaaaactttttgcgcaggtgatgaaataagtttttatatgaatcaacaatattttccccactaaacttctttttaaacattatataccaacatatatgtaatcttacattatatacatagatatgcaatcttatgctatatacaaacacatatttatacaactgaatagcttatttggaaggctttcttttgctcttggatatttcataaatgctgtggcttatcaactaccattggtactgataccttgaattaattatcaactaggttacagggaagcaaatgttttggatataatttcagtaaaattttcagtatgctcgaagcattaatataccttggcttggacccatactacccattcatagagtgcaggagagatcataagtcctgagataacattctagagttgaagagacagacagagaaagaggaaataaacttctctgggtactaaaaggaaataaatggtggatccaaaatgaaaattgaggatgttgataatttgtaaaatcaagcttttttattgtaattcaatttataacttcaatttatgacctttagccatagacttgacttctgcttaactacttccctaaatcctgctcattgatgttgtacaagatatatgtatgtgtatgtgtatgtgtatgtgtgtgtatattttttctcccaggaaaaaatatagttatagatagaaataatggtaataatgcattttctatcctcttaatttgtttaaacagagcttttattaagtacattcatacattcaattatttcattcattactttcatgaattcactaaatatttattttaagtagctcctatatgtcaggcatggctctatgtgctgggatacaacactgaaacatgacaacatattcaaatttgcattctaatggtagagacaaaaataaacagtcacataatatgggtagtggcatgtttataaagagaaataaagcagggtaaagaaacagatagccagaagtgttattttagataaggaggttagggagtcctttctcagatgagactattagcagagacctgaatgtactacacattttgggaatctgatgaagaaagtccctgtttgacacaccctcaagtggaaagattctgaaagacgtgagaacatagcatattaaaaaactgctggaaaacagagtattaaagtgcagagttgagaaatgacaagagggagaggaaattaggtttccaaggttagtttttgtacacagcccttgtagataaagactaaagacttggattttacctcaagtgtgatgaataggcattgcaatgttttaaaagaattactctgcctcttctgtagtgaagagaagtcgtaatgaataatagtggtatagtaatggttgtgaagtggaagcagagagactagatgagaggtcagttagtaacctagattctcattctaaagctgtaattgcagaactgtaaccaatgctgctactactactactactaccaataataataatatcaacaaaaaggccatactggtggaagtaagtattttatgattgcatcattgatgccttgcactgttctaagggctcaatatgtaaaatcttaagaaaccacccctacaatactagcagataatactacacttatcctggttattcagtgaatagtttgaaactcaaaaaagttaaataacttgccaaagtcgaacatctagtaaatggtacagccagaaatttagtgagcccaaattaattttttgtgctcaactccaaaggcattgagtactcactctgtgtttcaaaatgttgtctgtgcatttcctcactaggcttccatgtatccatgtgtttcctagttgtctaactcaaaaaagacaatatggaccacctggacagttgtaatttattcctgttgttttcatgtcattatgaataacccctgcttttattctcaaaagcatgaaatgtgattctaaatgatatgcacactatagctaaggctccaagatgcttttttgttgttatgcactatcacatcaatgaatggagtacacctataaatattattccgaatgtggagaaatctccccatctatttgcaaggatatctttgttcctttgctccattatttgtagggtctcatggaaagaggcttgcaggaagagagttctcattttcattcagattatccaattctattacctcaacattgaaacatcaaagtctattttgcttctaaattataataacacttattaacatagaaaaaatgtaactgttggtgggactgtaaactagttcaaccattgtggaagtcaatgtggcgattcctcagggatctagaactagaaataccatttgacccagccatcccattactgggtatatacctaaaggattataaatcatgctgctataaagacacatgcacacgtatgtttattgtggcactgttcacaatagcaaagacttggaaccaacccaaatgtccaacaatgatagactggattaacaaaatgtggcacatatacaccatggaatactatgccgccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacaatctggggactgttgtggggtgggggtaggggggagggatagcattaggagacatacctaatgctaaatgacgagttaatgggtgcagcacaacaacatggcacatgtatacatatgtaacaaacctgcacattatgtacatgtaccctaaaacttaaagtataataataattaaaaaaaaaggaaacctcatattccaaaaagcaaaaaaaagaagaaaaaatgttaaaagcaaacagcaagacatgccatacatgtcaacacagagacaaaaaatattctgtaatgatgaaaaaagaactccagcaaatcacttgtctgctttcctcaacttctagtacctcacaaaattaacaagcaagaacttcataatggaacagttaacaacaaaatcaatacaattatgcaataagaaaccttttcacaaataatttgtataccttagcaaagggtgattatccttatggaaagttaatttactcttggaagaactaggtcatcactatgcatttgtacctagtgcttaatttaataaattctaataaatataatcattcagcgtagaacatctatttaacttcctgaaaatagagatttggataaaagatacatgtaagataatttttttattcctgatctaacaaaaaattaggtttagcattttttcatgctcttaatattttattttttgtgatattcatgggaacatgaaataaaataataaggttttggtgtgacagaaaaaacttattgtcaacatttgaaataattcatgcaagtgagatattaaatacatttcaaaagacacattaatatattggtaattaaagtaaggtataggattgaatgatttctaaacagtcacattatttttttctattttaccagtttttaacattgtgatgtctgctaacttataataatacatttctaacttattccaagtgtggatctgttctacacacaacacaaattttcaatgtttgtgtgaactatatactgtagctttgggaaatacaatgactagttaagaaacaaactggcatttggtgaacaaaacaccataaccaaaagctaaatcacacaagaggaaaattatcttgaattccacatgccaatcagtatattttcatttccaggcatatttttacatttttaaaaagataaatttaattttatattgtttagatagtatagagattttactaccaaaaaaacacatttattacatgatcaattggccaccgtacttcactagcccattaataaataaaagacaaagtataaagactttactaaacagcctcaaatttaagacagacacgttaacttataatagctcagggaaaaaataaaaataaaataataaatcataactaaactagtaacctgatgcacaacctaaatgataaatatttgtatgtctattttggtgtattttccttggtatttaaataccttgaattcagaaaatataaacttgtttacagtttttctattgcctttgaagtatctacatttctaaaggttcttttatgttccaattctctatcttgatgccaagatgggctcatgaaaaacctagttgcacagctgatgtccctgtcggctgttaacataaagagactgatttggaacaggatgaggaaccccaggagaagccttggcaataatattccgatactgcccatccgaatcagtcacagcagactggtcagacctgatttaactctgagtgagtacaaataatcaatggaatatataaattgagaatatttaatattttataacatgtctactttaattaccaatttaattagatatataaacatgcagagattttgttgatatgttttaaacagcaaaatgaaaacactagatgtagtaaacaattgcctttgcaatataactgtattatgaaaggttaaggttacttttctgccattcactcatttccatgcccacgtgcataccatagtgaagatctaacatgctatttagtcctaatctggccagtacatttgtatggaaataaaaattgtgttttctgattatctactttatttcccacaaagatatgactttggtcaccagggcaaccacacaatacaatatggatggttcagtttgaaaatattaccactaatggaaaaatgaggacccttttattactggataattagtgcaatatgacaaaaaacattatctctgttaacagataaaaatagagttctgttaggagtgttatgaatgatgaggtaaacaaatatcacagaagtggtgacactataggtcattcaacatcatagatgaaagagagctcaagaacttctagattttatgtaacattttgcaggtaaggaaactaagacttttttgcaaggagaaactaccaggtttgtacagttaataagtggcagttctatatttatgcaagaaaaagggactaagaaaaaagcaaaatatattatttatttacttatttacaatataccaggaacatcacgtatgttatctaatttaattccatcacatacgttatctcatttgattcacctaacaataccatgatgcatttatcattggtcatgtgttactgatgagaaatagactttcaagaagagtttggaacagttaaactactctctcatgattgcatcattattaaggtgtagatgttacaaagtatgataattaattttgtttattaacttgtctaggcaatgctgtccatttgtttagttaaacattagatgtttctgtgaaggcattttttagatgtgaatgacatttataattagtaactttgagtaaagcagattaccctccacaaagtgggtggatcaccctccatggcatggattcaaacagttgaagttcttaagaacaaagactaaggttactgaagagggagaaattctgcctcaaaacttcaacaatgaaacctttcctgaatttccagcatgctggcttgcaccatggatttcagatttaacttttgtctgaattttcagccctacagacctcccctactgatattggacttgacagccctcacagtcatgtaagccagttcctaaaatcagtctctctcattcttgttcttgctcttgctctcccctgttagtctctctatctactttattggctctgttgctatggagaaacttggataatacacaatgtgatataaaattattcacagtcaatatattgtgagtaccaactaattagagtgaatgctagtcttagttcgtgggagcctgaaaggctgccttttatgttggggctttcctcttcagtgtttgatcatgggtagatcgggtgttttgggagttagggggaattgaccaattatgaatgaggactaaaatattttaatatttttaacaataatatgatcaaattattaggctcctgggctatagaatgggagaaatcttctttggttatgttaatgatacttattggacaagttaccacaactgcttagtcttaatttcttcatctataaaatggagatgttaataatatccatgctaaatactggaatggacatccagtgcctaacacattgcctactacctatcaaatagtaaaatatatctaatattgtttttactacctttttttttttttgagatggagtctcaccctgctgcccagactggagtgcagtggcacaatcttggctcactgcaacctccgcctcccaggttcaagtgattctcctgccttagcttcccaagtagctggtgaaccaccacacccagctaatttttgtatttttagtagagacggggttttgccacgttggtcaggctggtctcgaactcctgacctcaggtgattcgcccgcctcagcctcccaaagtgctgggttatagatgtgagccactgcgcccagcttattactagaatttaaactcagatctgtaataatttgcaaaactcacattcttacaatatgtatgatagctgtgaaaaaaacagaataagaaagaaagagacaaggaaaaaaaagaaagaaacaagagagtgacaagaaaaaataattctctctattagaatatttaggattttaaggtataatattgaaacaaacactctatactatagattttatgttcatttaagatgtcttagtttatgtgatccatttagacaggatttaatgacccacaattattgaaacattgaaagtatgttacttttgcacttgtcctgcctatttgtgaaaatgaattttttttaaagtggcaatgttgtttctaaaagtgtctgcctttctaccctagcatgcactgtgttaatctctgaccatcttaggctcatgctgatacagcacccattgtatttttaacttttaaaaaatctgctgaggatctctatttcatgcagcacatggattgagagttaaaggtcaattaactgcattgttcatgccctgtggtttcttactgaagaatgtgaagatacaattggtagtgaaaacctatactgatgaagctcagtgctcttatagtctaaagagcaagaaaatgatagtttggtcacccactcaataataatattatgttgaaaagagacaatagcgaaataagaatttcaaagaacaccatcagtagacttcagcaggagaaggaatagaagcatatcttcatggtcgcaatgaattaattctagaattaatattaatattttttaagcatcagcattcatctataaacccacaaatttgtcatttattatataaaatgtgtctatcgacttcctgttggttttgccaagttcagaagtttccattcacataaaaattatttctctctctccttctccatctctctttctcatacatgcacacacagtattttttatgtacatccctatacatatccatatataatttccataagtatacacatattctcctacagtcatagacacagttccccagtacatatccctactaagacaaacaccaccaacatacacatccccaccttgatgcacatggaaaccaacatgcacattccaaacaccaggcatttccttaaaatacacactgccatgcacacacaccctcattcacatagctcctgtccaattacatatcaaaaatatttatgaaaaaaccaatattacagcattcagaggaaattcatcaatattcagaaaaatatataaaattgtaaaatttaaaatcacatagcaggaaattttgagctatgtgtctgtagatagattatagattctttctctcaaatacctgatgaaataaactgtcacttataaaagaaagaaagatacggtatttttttaaaactcccaaaatataaacaaacagacatcacaaaattaaatgcaaacattctcaatctctttaaaagataccagcgatagcacaaagacaaggtggaaaactattgtcatacgttttaaagaaatagaataactcattgctataaaaaactgaaggttttattgcaacacaaaaaagttcctaattctattctcactttgcagaaataattataataagttaaaaaacatttgagattcatcaccaatgtctaaacgtctgcagagaagataaagagttagtggagagggatgattaaaaaattagaattgaagaacagagtctaactctatctgacagattaaaaattccaaggctttaaactcagtagactgaatgatcagaaatggagagcattcctgactggagtaaaataaatgtcaaggttgagtgaaacttgtttttagtacatttaataaaatctcgatcttgttacaaacacacatacgcatacacacccacacccacactcatagctgtacagtctccactgagcatcatcttcaaaatagagaaaaatatattttatatttgttgaggagaagtaatccaccctatactgcaattgttacacagttgtaataactaagcaataaattcaaaccttgaaaatggtgtgattttatgtgtgtgtctctgtgtgcatttgtgtgtatttttttgaaaaagatataaataatctagttcacaaaaaattagctgagaaaaaagatataatctcactagcatttttcacactaataactactttaatatgaataaactaaatcaattcaaaaaagataacaatagattgagatgaagaaaaaattacagtgttaataaatggtttaaaattataccattgcagaactaataagtaacaaatagaatgacaagctgaaaattaaactactgacaaaggggaaaagtttgaaaaataatcaaagtgagtgcaaaacagaaaagatcaaacaactattgagaagatctccacataaaattattgttattatttaggtaaaaattctaacaaatggatcagaaacctgttgaaatacttcaagaacaattttctgaaaagaacaaaacgaagaatatttttgggaaaagaaaaccatattttagaaatgttagatataaatgacaatacaacacatttacattaaaatattgaataacaagtataaataagtttttattattcaggaaaaaactaaatttcattaaaaagaaagatttaaaccatcttgaaagtttttcaaagttagaatcaaaactaaaagttagtagacaatgtctacgaatttgtagaggaatgaaataatactctaaatatgttacacccagtcaggacattgtttttgtataaagtaaacaaaagaaaataaaaacaataaaaactaatgtaattcccatgagttttagggacacatgtccccatatacacccctaaacacacacactgcgccaattgcaaaactaggatgaataataaactcaagtagtattagaaaaaccatggttaaaagatgaaaagtaaatttgaatccaactaaataagaataaaacctggaaattatgatcacaaaattgaacttaattgttgtaaactgttacttttttaaaaaaataaagtgatttataaaattggaaagtgggaaaaagtaatcaattattattacaatattcctttgaacgagtcaatctaaactatgtaaattaaaatgtagtcaaaaatataatagagtgatgatgtcagcaaaatggaagaataggagatcccctgctcatacgccactacagcaataattcggcagccattcatgaatgaaaatgcctttgtggaagctttggaatcgagatacaaggctgcaaaactttggtgatatacaaaatagaggagggtcactttgagaaagcaagtcgataccctggctaccaactgtagtcctggctacagacccaaaacagtcccatctcattgtggagggccaatgaatgagttacttacacacatgctctgggaaaccgtcgtgttaaactcagccctggctccaacccctttcaatcataacctaggaacagcctttcccacctaggaacatgctagaatacatacttgtccaagtattctacatacttgtgcaagtatgtagaatacatacttgaaggaggttcacctaacttagtcgaacgacagtacttgacgaggtcctgtaacccagttccagcccctgccagctagagtctaggtctgggatcagtcctgtccacctagtgatatggtttgactctatgtccccacccaaatatcaccttgaattgtaatcaccataatccccatgtgtcaaaggagagactagatggagataattgaatcatgggtgcagtttcccacatgtggttctcgtgatagtaagtgagtctcatgagatctgatggttttagaaaaggcagttcccctgcactcgcttacatgctttcccacctgccattatgcaagaggtgcctttgcttctccttcatcttctgccatgattgtaaattttctgaagcctccccagcaatggagaactgtgagtccattaaacctcttttctttataaattacccagtctcgagtatttcttcatagcagtatgagaacagactaataagcctagaaacacaccaggagacatgcttatttgtgtcactagaggcagacccacctaactgggtaccacagcagattctcaaatggccatgtaacccagatacaaacctacgcagctgcagtctaggagtacatcttcccaccctctaggaggtatgtcgctttgtgtacctagaggcaggcctgtcaatcttgatcttagtgcagatcctgaagcagccctgtaacttggcgccagcccctctcagctgcaatctggaagcagttctgcctggccagaaatctatccactgactcaataggaaacctcatagggaccagacaggattcatgcccactctggtaatatgtctggcaactatggattccattgcagactacacagaggccctgtgactcagctctaatcccactcaactgggattgtagaggcactcctgtcaccctgagaatccaacaagaagtggtctttaactgctaaaaccagtctgtaaaggctaaaagaggtttacttcttcaaatgcacaaacatcaatacaaggctgtaagaattacaaaaatacaggcaaacatgataccaccaatagaaactaataaaactcctataattgaccacaaatatatagagatctatgaactttccaacaaagagttccaaataattactttaaggacacagataaatagttaaacaaaatctgaagaaaaaacaatccataagaaatagaagtttaataaagaaatagaaaccataaaaagagattcaaatagaaatcttgaatatctgaagctgaagaatacaataaaagaattgaaaacaagtaatgaagatctcaaatagattttattatgcaaaataaagaatttgtaatcttgaaaactggtcatttaaaattagccagttgaagaaataaaggaaaaactgtaaagaaaatttagaggatccatggacagcatcaagcacacaaagtatgcattatgaaagttccagaaaaaggagagagagaagggtagaaagcatattttaagaaataatgactgataacatcccaaattttgggaaagatatagacattaagattcattaagctcaaaagactctaggcaagataaacccaagaaagatcatcaagagacacattacaatcaaattgccaaatgttagaccaaacagtgaatttagaaagcagcaaataaataagcaactcatcacatacaagggaaacagcataaggttatcagcgtatttctcagcagaagccttgcaggtcatgaaagagtggaattacatattcaaagtgctgaaggaaaaaaaaaatcttgccaaccaacattatacctagcaaagatgtccttcagaaataaaaggaagataaaaacatcctcagaccaaacacactatcaaacaaacaaaaaaaacacacatgaacacacacacaattaaaggagtttattactattgtacttgccttataataaatgccaaaagaattctcaagttggaataaatggacactaagtaacaacacgaaaatatatgaaagtttcaaactcactggtatagttaaatagacaggcaaattcagaatactctaatactataatgaccgagcatgaatcagttttacctctagttgaaaatttaaaaatcaagagtgttaaaaataactacaactacaatcattttttaatggatgcacaaatataaaaagaggtaaagtgtaacattgatagcacgaagtctgggtgggagatgtaaaagtgtagagtttttatagcaatttagttaagttgctatcagcttagaatacatacctataactataaaatattttatataaggtttgttgtaaccacaaagaagtttctagtaggcacacaaaatataaatagagaaaaatcaaaagaaagtagtggagaaaaatcatcaaatcacaaagacaggaggagaaaaagaaaggaacaaaggaagtataaaacagtcaaaatattaacagaatggcaaaactaagtccttacttattaatatttaagtttaaatgaattaaattttctaacgaaaaagtaaagagtggccaaatgaatttcaaacctctaacaatatgatacatacaacagactcaccttgactttaagaatatatatagtctaaaatggaaggaatataaaggatagtctataaaatagtaaccaagagagagcagagtaggaatacttcgttcagacaaaatagacttgtagtcaaaatctgtcatgtgacaaagaaaatcaatatataacaacaaaagtattgattcatcgagaggatataatgattgtaaatatatatgcacccaacaatagatctaagtatataaaggaaatgttaacagaactgaagggagaagtagacagcagtacaataatagtaagagacttcaccaccccaatttccatactggatagatcatccagaaagtcaataaggaaacagcagactttaataatactaccaaattgagctaacacacatgcacagaacattccacccataaacagcagtatataagttcctctcaactgtacatgaaacattcttcagggtataccatatattggaccataaaacaagtctcaacaaattttaaaagacagaaattatatgaagtatgtttctgaccgcatgatatgaaactaaaaatcaacaaaaggaggaaaactggaaaattcgcaaacgtgggaattaaacaacacactcaaaaacaaccaatgagcaaaagaagaaataaagagagaaataaaaaagcatcttaaaattttaaaaacacaacatgtccaaacctcttggacacagcaaaagctgtcctaagaaggtagtttatagtgataaatgcttacattaaggaaaagaattccaaataaatacctaactttacatatcaaagaactagggaaaaaaaatcttttcaggcctaagttagcagatgggcagaaataataaaaattagagcaacaaataatataaagacaaaaaaggaactatagaaaattttattgttaaatatatttcaataaagctggtaaaaatgcataaaagttttaaaaataatggctttaagctaatattttctccaatttacattaattttaactgaaaaaaatttaaagttcaccaattacttcaatttgcattcagtttgttttctaaaataaaaatagaaaaaattaacatttcaattaaatatataatgcatattattacaatcattttttgaagacatttgtcattttaaacagatagatctgtagcactctcttattcttcctgcatatgtgcctatagtgatgtctagactgataattacctgatataaacaatgtttatttttatatgatgccatattagttctgtattgcttaagttcatttcaataagcacatatgctattttccagggggaagagggtcaaattaagagaataaatcacatcataggaaataaagatctttagttatatcgaggaacttgaaattggacttattctcttatgtaactacaaaattcataaacgttcatgataatttcaaatctgtcaagctactgaaaagagaaaggaaaagtgtgtgtatgtgtgcgtgtgtgtgtgtgtgtgtgtgagacagagagagagagaatatgaataaatgagacagatttaattggtagagtcttcgtaattttattttttctccatccagacctattgttaaaattattaactattagcaccctttcttctacaacatatcttttgttaatgtctccctcaaatcatttcctctgattctagtaactcacacttagtaatttgtgacctgcccgtctgcatccatttcttagagcaatgaatctttgctactccatcaaggttcaaaactcaggaggaaaccttgtcattaaattctataaggaaatcatctaaggttctaattttaaaatatgttttgaaattctactaagatattctgtagatgtgtgaggtaagcatagattaggaataatgtaaattgctacaactatatataaagtcaaagaatcttaatgtatttgtggactttgtagttagtctgcttacatccttgctccaatttatgtaactacaacagcgattatcttatttattttgtatacagtcagtaaaattcaactttattttgtatggtattacctcatataaaaaaatctctaggacacagactgaagcatcttttggataatgaaagtcttatgttttctagtacaggtgtttaatagcaagcagctttcatatggaaattccagggtaaataggtttgctgttgccaaaggaaaaggaaggcaggcattattgggaggaaaataaaaagaaataagtgtcatcgtatgttaatgtaatgaaaactgactatcggaaagaacaaagatatcagagctgaaatatagtccatctccagcttatacgatcctttaagggtcaaggagctctgacacacatttcaaatagttttcaaaatgtaatactgagagcataccctcagcagtatctcagcagtatccagaaagcccttaaaagtcaatcttaataaagcattcttttcattgttgttgtatcgtttggcttcatgaactttagggagaactgaacaagtaaagctgtgccctggcagttgaaaaattggcatggaaaataattggcatcctgctcaagggagagggatttgagccaaacaaaggtacctcctatattaatatgtaagcttaacaatcaggcaaatctaatgccgccagacttctgggtcagaatattaacatttccttctgacatgctcgagctggagtttaatgccaagaaatgcatttataattagaaaacatcttaattgtgatttatgtgtgtctgacaggctgacacttgatctttacttactctcttactgacttaacgttatttttatgtcctgagagacataactcaaattgaagattttgcttgtcgactttatattctgatagttatttagcttttctacacacacatcatacatttgctcaattcttatattttaacattttataacatagagtgaatttcattaagatgatttcattaagataatttgacgattgttaacatgacaaaactagtcaaaagagtttgcttcaataaacgtagtaaataaagttaaaaagtagtaaaagtgctagacaagcaattgaaatttctgaacagttccctgatacatcttacggggatcagtgttttgagtccccagttggaaaatacatgacaaatggcaatgaacaattggacaaatggcaattggaaaatacatgacaaatggcaatgaacacaaaaatacgatttaacatgtcttgtgactgtttatcaaaataggaaaatagttttagcatagaatctcatttcaaaatataacacagagcatggctgaaataacttttcttatatatttcagtgttatcctactgagttaagaaaggcatgatttaaaagaggtaaaagtatgtccacatcattcaaccacaggatgaaggctaattatatctacacagccagttccatttggcaaatacaaatagataagaggtgctagtgatgattcagatgccttggaaagctacagtaatactttcacaaatcttattttttatgaaatataaatgtgtgtgttagtgaggggagagacagagacagagaaaaagaacaaactatttgttaaaatcaagatacagtacattttgaggagatgctagaactcaagaacaacttaccttgttaactggagccctgctatttatataatatcactctccctactttttaaacagaaatttaggcatatgccttcatagtgctgacacatatatgctttccctcactcttgctttgatggattcacatatatgctttccctcactcctgctttgatgggatggattcacatatatgctttccctcactcctgctttggtggatttatgatggattttcttcactcgtgatttggtgcatcctgagtaaaggcaagttttcttttgctttttttttgaatattaataatttttcagaaatatgtatccacatgcagcagtcactgaaaacactgttaacactaagaagttcagaaataaaattcaatctcactgcctcaatgttaactattaaaataataaagtttatgaactttgggagaacttttcaataaatttccactatgaatttgatgacggccattatgcatgcacttgatgttttttcagaaattttgtttcaataatgacttttaaaaaaacgtagccttaatttaaatgtttcagagcaattacttttattttagcctcaaaaagcagaattaagagcaggctttttaaaattaccactactttcatttacttttcttctgctttcctgagttctttttaatgaaaaatcatgttgaaattaagatttataattttaatttaaaattacgtttaataagggattttaaaataattcttagaatcaaatcttttagaaaaggaaaagcctttttttcttttttcttttttcttttttttgcaatgtgcttaattacttacctgaatgttcattatgttaattttataattttaagtgatgtttaactcattatggcaagaaaatagcacagaaaacaatggaatagctattcctgaattgccacataatacctgggagaaaactaagggttttctggcttgaggaagacattagtgtacttcacaaaagactttggttgacagggaagtgaatactgaaatccaaaaggagatccacttcccattacttgcttcctcgatcaaggttgggtcaaactagagaatgaaacatgttttggatttttctctacagagaaagttgccattccgtaatttgaccaaaaatgccagtgatactagttaatttactgaaggatgtggtctaaattctgcatgtaattgggcagggaatagccaaagccttatacaggcttttattatctattatattaatattctttatgaagtcttaagagaattgaagttttctgatgcttcccaggataaaattttgaatagacagagaaaggctcttgctgtgagaaagtttacattcagttggacatagcaaagtgtaatacgaatggtaagaagagtgaaaagtaacccatgagaaaaatgagacagctcggggaatgaatgtaaagatgttcactgtctttaacatgcaatttttttggaagtcaaaatgactggatattgactgaaataattaacttcctaaatactagattgtcaccacatccaatgcctatgaaccaggtaaataatttgaaatacagttttccctgaccagaaatgtattttttaatctaatgactgtgtaatatttccacttaaaaagcgcataatttattttctaaaaaccatttaatatggttttatattcttatactaattacttacctttactgcatattaaatatgacaccaaagaaaatctagtaatgtctgaaaatgttattttccccaatttgcttgttgatattgctgctatgtaactgcatcactaataccacctgcacttcacctggacatattggaaaataatgtttcaatgtaataaaacacacagtatcacaagtgttatcaacatgtttttgtatatttttgctcattattctaaagtttaaaagaatggataatcttctagaaaaaaattttttaggtcaactattaaacacccatgtgtgtggccacttcaatggcaggtccctcggggtttgttaaatcattgccgaatgaatgaatgatgaataaaataatttttctgtcccaacttgaagctattcatgtgtctcttttatattagggcctgattcttctacatttttgaaggttttttgagggaggtaaggtctttgaggcagggtggggaaatgcatccggcaatctaccattcggccatcataccaaactcaacatcctttttaacgtatgaaaaaaatctaccttttcttctcatttgtttaacagtgcagcttttcttcttctttttttaaaataggaattgcgaggaaaggagagctgtgcaaggatatattgtcactgctaatgaatagaacttggcatgactttccttccacctgtaaccaattattaagccaaaaccatttcctgccaatacactaattgttttaggtgacaggtctgtgaattcattgctgcccaacctgactaacccttaaggaaaaaaaataaaattctataaaactaagagatagcagaatagatgcggatgttacactgcatttgagtacgatataaggtacatataatgcacgtgttgtacattacttcatttacattatcacccatatcatttatcctacgccacatcaaagtttactgttggaaagataattttgtgaaaagttaattgcttagaattcttggcctcagcttcaaatgagtgaatatctctgaaaggtttgtcactgatccaccttttgaggattttactaactgctccctactggttctttttaaatatgtgaaaaatgcatagactttgtctgaccttcatgattcataatcatgaagactaaatcaatttgcttgctttctgctatcttttaatctaagtagcactgtcctaataaaacaaaacccaaacttcacatgttttaaatgaagtgctataaaaatagacttgcagtatcgcattttagaatgttactttgaggtatttttctcatgtatactgtagccttaatatgtacttaattgtcttatattttaatatattttgtacaattatattgttcttttattaatattttatcttatttttcccattaagactaatcctcctttttaagtatagttttactcttcaactacactcagagtaactctgtcctccaaatacacatattccacctagaatctcaggaatcaattataatttacctggaattaaattgaataatttaggtgttgtaacactgtacaccacacaatacacttcaggacattgttttatctgctctgtgataactagcatactgaaattgtattaatttttactctacttacaaattaaatttgatttaagccaatggtggaaagggatatgagaagggtgtggttgaataaatgtgtattgagcacccacatatatgtctactattttaagcctcattaaattcactagtatttttctccattacaaatgagaatactgatgttcagaattttcaagaacattgctcaaactgaggactgctaacccatggcaggcacaggacttgaatatactgcagtctgatggccaagcccatatactttgtatgatacagtactgaatgttatgaatgttccctccaaaactcatgttgagacttgatttctaatgtggcagtgttaagtgaagtatttgggaggtgactgaatcatgagggatctgcctagtgacttcatgggttaatggattaaaaggttaataaattagtccagtgcattggctcatgcctgtaatcccagcactttgggaggccaaggtgggcaggtcacctgaggtcaggagtttgagaccagcctggccaacatggtgaaacttcatctctatctaccaaaaatagaaaaattagctgggcatggtggcagacgcctgtaatcccagctacttgggaggctgaggcaggagaatccttgaacctggaaggcagaagttgcagtgagccgagattgcgcctctgcactccagcctgggcaacaagagcaaaactccatctcaaaaaaaaaaaaaaaaaaaaagctaattaattaatcagttattacgggcatagaactggtggcttttcaagaagagagagacttgagcatgctaacatgtagcacactcagcccgcttaccaagtgatatgctgcactgccttgagactttgcaagagaccccaccagcaagaaggctttcaccaatgatgcctcctccatcttggacttctcaacctccacaactatagaaaatgaatttatttatttataaattactcagtttcagttatgctgctatatgcaatagaaaacagactagtacattgaccctgatcacaccactgttaataaaatatttttagtgcttttctgtgcctccattattttagaaacttcacatatatttatttcattcaatcttcaagaatttgttgtaaacctgaggcattaggactaatttcagcagagaggctagatgaggtcttgctgaaaatgcagtatgtaagctgaatcatacaacattattaggatttagccaagtgaagactaaagaaaattgaaaggcattccagggagaaaatgctatataaaattatttatgatccatatgccattgatatggccgaacataaactttattgccctgcatatcttaatttgttatctataaaatttaaaaaaaattacgttgaataattttgcttttgctaaattacgtgtttccctttcttattaatacatatgctaaagattgctttgtttctaataacatgttcagttaaatttgtagtaaagcttagtaaatttcaccttcttctttcttcaatgaaaaaaaaactacgctttctgaatttcagcccatttttgtctttagcatgctgttaaatcctcacaaaacctttctgtgtcttcttctgcttactactgagccctgggatctgagctctttgagtcaagcctttgtaagaaatgatggcttaattatcttatctgctttctttttatcttcccgacctttttccaaatctcttggctgtttccctctgttcctttgtgaataaatgcgaagctttaatttaggccatttttcataacccatgcacctactgctaagtcggcactcatctccaggttgttctgccctttgtcactcggctcgactactttccagaatgacctatttccgctggggcttttgattcactggccatccatataatactaaaagtaaaaatgactttctaattattgttatgatgatgggtgcattagtttttatttaaagtcatacaacacccacccaatcatattattatgttggtgcaaataattgtggtttttgccaatcatttcaaaggaaagaaccgcaattacttttgcaccaacctaaatagattggaatcaaaatgaagttgactataaatacttccagagtggaagtcttgattgatatatctttgaatctttaatatttatcaaatatttacaatgtggttgaaccgatttgtggttttcagttaatatcacttaatattcataattaggattctatgactatttgaagggtatatcatgacctgatctgtgttaggataaaataaatggtgggattgggagaggtatcagatactgagacagaatttaacatgttcacagagattctgagacaattgtctaacaatctatggataataaattctttaaattttgaaaatttaccaaattttcaaaaatgtactttagttgcttaaacatataaagcaatatatatggcataaaacgatttttagtgacttttaataatatctaccaattttttgctaagaagatttttcttagttctctcagcagcatttacatcaatactcgatttgtgaaatgataaaaatcataagatggtttggttttcttaggcatatatatttttattttttatttccatagaatttgtgggaacaggtggtattttgttacacgagtaagtttcttagtggtgatttgtgagattttggtgtacccatcacccaagcagtatacaatgggcccaatttggagtcttttatccctcacccacttcccaacctttcccctggagtctgcaaagtccattgtatccttcttatgcttttgcatccttatagcttagctcctacttgtgagtgagaacatataatgcttggtttttccattcattcttaggcatatatttaatatttgggaatgtttgtttcataatgtatgtgtaacccaaatttcagcagaagactgacaccacaaccctgctatattcattatgaatataaaattgaagagaaaggttccaacacagctacataaaattgaaatgccaaagttttggttattattgctagaagtacaaaattaaatcacatatgctacttgagagtttgccaaattataatgtaagtaattacatttacattccaggaaaataatatataaaacatctgaaaaattcagaagttgctgaaacaaccctatatcagatgaaacactaaaatgttgatttctaacaaggagcaattggaatatatcaatgtggcagttgactgtagagggctttagcatggaagagtaagatgatcaatgcagaaataaggaaatgtgaaatcttagaaagtatcatataacacaaactgtgactagcgttttagtttatatgctgatcataaatatgatcttttgatttttcagagctttttcaatatttggaaggcaaataaggtattttgaccataaatatggaaaaaggatcaaaaattaagtaggccagatggataccccattctccacaacgtaatcattacacattgcatgcctgtatcaaaacatctcatatatccccataaatgtatatagctactatgtacccacaaaaattaaaaaaggaagttttaaaaaaattagtcaaaaatgctaaaaagactaaaaaacaagtatggaagatacatttttaaaatgacaaaataaatattatagtaaattttgactactaattactataaattattaataaatatggtgtttgagatattgacaaagtaattcttgagataacagacaaaagcataaaaatagaactatggaaactgtcttcagagattatttaacaccagtcaatataaactaacacaagcccttatggtatgctgaaacttttattactggttaaaatatattgtctgagtattttatgtgtgtgtgtgtatagttgttattgtcattttgaaatggagtctccctttgtcacccaggctggagtgcagtggcatgacctcggctcactgcaacctctgcatcctgacttcaagcaattctcctgccttagcctcccaaactacgcctggctaatatttgtatttttagtagaggcggggttttaccatgttggtcaggttgatctcaaacttctgacctcaagtgttctgccggcctcagcctaccaaattgctgggattacaagtgtgagccaccacgactggcctgattattatataatttaatacaaattttggtaataaaaataaagttttaaaataacacattttatagaaaactggtaaattggccactttttgaattggcctattcttatactgagctaatcccctatttggttgaagcatataacaagagtttaaatttaatacatacattgctgctaatcagaaaggtagtaatacagcgtttattattttccaaagctctgttatattggcagatgtagaaaaatgagcatccaaggtctgcagacataagtgacaaagagaaatgatcacaaaattatttttggtatctagggagatcacaatgtatgaatgaaaaagcataatatgtatattgagtaaattgtttctaatggttttattcttgctgagttcttagaaggaaatttccatcagctgattaaaatggcaatagctcatctccaccctggatactgtccctttcagtaatatataacctggagagacacaaacataaagtgattactgcaatagaaggtggaaaatgcctcttaaagaggatatgagattatggaggatgtgacattaggccagggtacacactgatgttatagaaaaggtttcccagagaaaatatctgagctttctgccaaaagagaactcctacaaaaaatataaaaagaaactgtggtaaagtgtttgaaataagtttattttaggccgggtgcagtggctcatgcctataatcctagcactttgggaggccgaggcaggtggatcatgaggtcaggagttcaagaccaacttggctaagatggtgaaaccccgtttctactagaaatacaaaaaaattagcagggtgtggtggtaggcgcctgtaatcccagctactcaggaggctgaggcaggagaatcgcttgaacctgggcaacagaggttgcagtgagctgagatcacgccactgcactccagcctgggcaacagactgagactctgtctcaaaaaaataaaataaaataaaataaaataaaataaattaaaataaaagtttattttattttagttaatttggtatacagacagatacataaaaatcttaaaatgccacactatcaatagtattacaggcctggtgcaatggctcacgcctgtaatcccagcactttgggaggccgaggcaggcagatcacccgaggttgggagttagagaccagcctgaccaatgtggagaaaccccatctctactaaaaatacaaaagtagctgggcatggtggcgcatgcctgtaatccccgctacttgggaggctgaggcaggagaatcacttaaacctggttggcggaggttgtagtgagccgagattacaccattgcactccagcctgggcaacaagagctaaactctgtctcaaatatatatatatgtgtatgtatgtgtgtatatatatatatatatatatatatatatacatacacacacatatacatatatatacatatatatatacacacacacatatatatatacacatacatacatatatatacacacacatatatatacacatacatatatatatacacatacacatatatatatatacacatacatatatatatatatatagtattacaaataactgctcccattgttgaataaaaatgccatgttgagtttgtagaagaaatctcataaatctcaccagcccacttcatgtgtgtatttaccaaatataaatcaaaaataccttccttgtattcctaaaattaaaaaagctctggaaaaaaaaagatttttttttcactaaaattgtttttaaatgcatttggcagcaaaacttgaactgaatagacaggttttctagaaaaatattaatgggtatgatgtgtaatatctgtcaggaacccatcaggaggattacataatttattggatatgcatcatattacatttacaaaacgttcttttcaagttttaattttgaaacataactggcagcaaatgtttatgccacaagatctttggggtgttgtttttatggccagaaacctctgtggctggatgtgcttttgcccaagttttgctcaggcccgctgggttcgttttgcccacttggcctggcaggctgtgctaggcttatgctaccagcctgggtcccatgcctgccaaaggcgagtcaggcatagaatggcgaggggtgtgtgagcaagcatgggatctggccactgcacacagtcagtcatgagagctgctgcagcgggacgggcagctcctgatgctaacataggcactgactctctgcaaggctgtggccaaaccaggcacaccacaagcagcttccatggctggcaccagggaacatggttgctcctggaagcttagagatgccagaaactccagggccccaaagagggagtcacagccctgactcagggggctcccagagggctgcaactcttctttccttctcttcacccacaatatggtgagcaaggggcatgtttcagccctatttgtgttacagttattttagcctcctttgctccttccacggtaaccaagttattgtcctgtgcccaggaagaatgaggtacatagacaactggagagtgagcaagacaaaaaggagctttgttgagtgataaaacagttgagaggaaacccgcagggggagctcctttctgcagccagagtgtcccaatgagtgttcagctcctaggagagtggagaccctggagtggacagctcctctctgcagctgatcatcctgacatctgctgctctctgcagagaggaggccatggtgtgggtagctcctctctgcagctgatcatcaggacatctgcccagctctggctgatcccagggcttttatgggcctcagagtggaggtagtgcatgctgattggtccattagtggccacgggcaggccagagaaggcacaacaagcccccactctggtctgcagaactggagcccagcccccagccttcaggcactccctggcctgaaggtggggcattactggggacccacccccttccacccaggaaacctgtctaccttctgctgcctccatggtgcctatgctgtagatgccaaggggcacctgcaggccagttccaagctatgttaaaaccccatccacgtttctcttaggcttgtcactggccaaagtttggaaggggctgaggctgcagggggctggcatgtcagcactgacccagtgtgtacacacacacccgggctcgggcctgactttactccaagaacaaagcaagtaccaacagcagggagaagccaggcagtggtagcaggcattttcaagcttgcaagggcaggggaggccttcccaggcctctaaaggtgcagggatgcctggttctgcaggtgcaggagcaggagacccaggtctgcagctatgatgtgggtatctgcagctgcatccaggaggatgggactcctgcttgctcttggctctgagagcacagggaagccagggtccacagccatggcttgggcagctgcagaggcacctggggagctcccatcccaactcagaagagatggggccactcctgatggttagccactgtcatcatttagagtaaaagattatggacttgtatgatttcatagcatcctgcatcaaaaatattttctccaatgttctgaagcatgataggctcaaataagcttccactccacagaattcttaaattgctctcagatgaattctagtgaatatcacaaatatagtatctgaggatctttatattgcaaatcattagtcctgaattgtgattattgaagtaagagtttaaaaaagaatttaaaatgttattctaggaattaattttttactcagagaaatatgatcatcctgcaaggcccagaacattaatgtgaatttttaaccaaggcttcctggtgctttccctgtgttcactgagtagcattgacataggctatgttccttttcacacttgtcaatagcagaagtcatttgtggctcctgaaagcaagaatgtatactctggatatgcttggtttagatacattaaaatcaactaatggcaatttatagggaaaaatagattccttcctacaaagagggtgttttttcataggcaaataaactgtttgaggaatagaaacagtatcaattgcacatctttcttcttttccaattgcgatagttaagattcatgcacaatgattaatacatatgattgtatttaaatagtatgattgtaagaaatatttttataatagtttgtcatttatcaactatctgcttatttgacagatgctaatgtaagtgatagggatgcagaggtaaactcagtggccactaaacttcacagtacagaggaaagaggtgtgtgacaaacacgaaacagaaaatgcacacttcagatatgagggtatggggcaggaggaactggggcagaggcttcagacatcaacatttttattgtaaaaagcacaatatcactttctaactcaggaagcagtactggacagccatctctagagaatagaatacaagatagtctgtgtagaatgtaatcaaagacttcatactctaaagctgttggagaaatatcccagagattgaaaccaaaatgagcttttcatagctccaaaatgtgttagatataatatggtcataagtgccacttatataaacatttgcccctattttatagcttccctaatattcaagccacaaagtttatgccctgatatttactgatctctatgtattgacttttgatcactcaccctggcttgttaattaattttatccttaacatatttatattgtttgggttccagtatttcagtctctacctctagacctgacatgtgcttcattgaatgtgcgtctgatgatcctgtgcatattcttacaaatactgtagtctacggatgtgacatttttggacctttggactatgttaccacctctaggtatctatatcatgtgaataatcaaacatcacaagaaatccagtgataagaactgttgtggcagatcctggaccttattctaacagctttcaattacatattctctttaattttgtgctgttttgtttttgttttttttacagtgaatatttccttcttatccttaaatctgaaaaatgctgacacaaccctctgaggactttactagaggaggaatgtcagaactaatctgcaggtcgtaagtgtgcactttctgttcagtgcttgttacatacccattgcctcaatactgtgggtttagtggacattgaattcacctctgcatctatatcacttatgttagaatctggaaaataagcactcagatatttgctaaataacagaagagtcataaaaccggtttatagaatcatatactattgacattaaatgaactcataaatataaactaattctaacagtgaatttcatagagataaaaatctcaaaaatgtgacaggatttgcacaaggtctcccatttcatttaataatggctgaatcagaaataaaatataaaatacttaaatcttaatttagtgattcctcacaacatattattcgttattttatttgatttaaatacttttttttgacatacaaggtctaaccctgtcactcaggctgaagtgatgtggtatgaatcatagctcactgcaacctcgaattcctgggaaaaagagattctgtgcttcagcctcccgagtacataggattacaggcacgtgccgccatgcctggctaatttttttttctttttttttttttagagatagggtcttgctatgttcccaggatagttgcaaacttctggcatcaagcaattctcccaccttagcctcccaaactgctgggattacaggcaagagccaatgtgcctgactgaataacttttaaagttgaatttcaacaataattatttcactcttagtgcatgcttgctattccttattcatttttacatttttaattcacaaataaaaattatataaatgtatgggttacaatacaatgttttgatacatgtttacactgtggaatgattacataagctaattaacatatattttatgttgtgagacatttgaaattcattctcagcaatttcgaaatgtacaacgcattattactaactagggttatgttgcctgtgcaatagatcttgaaaacgtgtatgtcctgtctaattgaaaccttataccttctgactagcatctcccataagcacaattctactctctagttccaggaattaaagtattttcaaattcaaagtatagatgtgctcattcattatttgcctttctgtgcctagcttgtttcactaagaataaagacctccaggttcattcatttttttgtaaatgacaatttccttctttttgaaggctacataatattccgttgtgtatacatactacgatatctttgttgattcattcattgatagacacttcagttgattccacgtcgctgctattgtgaaaggtgctgcaatgaacatggttgctactccttgtttgtatagctgttaggaaactattttaaatccattatctgtcccttcatatagtgccctaatttgcaaatctgggattaggccctgataatggtgatgttcagtgaatcgcaatcacatgtcttagctccagtatatttttaaagtttaaattttggtgttctgtagaattcctcctcccatattgcatgggagtgcttctttgttagtcagaatgctaccaggatggcaacattatgtaaccaccagatgcatatataatcttcacattgatagcttttaataaactatatagttatctatatttaagtaataataattttatcctacctaggtttgttttataaatattttgataaaataattatatatacatatgcatgcataactatataatttataatgggtaacgtctgtgtggtgaatggcatgacattattccatgtattttaatttcagattagagtagcttatttgaaaacaataactactgaagaattttatatacactgaataagaaaagaaaatgatagggccacaatgatataattcctttttatagaattttgctcctaggtttaaaggagacatatacacatagctttatgtatcctgtgatattaatatggtagttaaatcagcatggcccaggttagtagtgtatcattattcctcagggtaaagtgctctttgtattatcttcttctagctatgtctcaactgaattcatatcaccacatttgctttttatggctctcccttgccttcacatttttcttgtgtgagaagaaatatgaagctgattccgtttgtaaagacactttaataactctcatttatatgtcttactttctctcaaattaatattcataaatcccaaatctaactagtaatagttcatttccattacaatgagcaaaatcctttcatatttgtccttctcacccacaatttttatatcttctttttccctctcactccctgtgtatgcttgtccgtagaaacagagtgtaaattacttcttataggacttcgttttctttctgaaaactcttcttcaaacatttgtctttttcctataaaactttttagttaaaattcatctcattttgtacatgaacataactaaaaaataattgcctaactccagagtactgctttatagctcatctccttccccgagctttttctagttctgtcaggcagtttcatttgttcagtcaaatatagagaaaccaacatttattgatcaacagcagtgttctccatgtacttttgatataagtgtatctgttttacaaagaaaggttaagtaatttgaaacctcagaaaggttaactaatttgtttcaggttcacataatcaataaatttgctatgctgattatggtacatttattgattatgtgaacctgaacaaattacttaataatctgtaatataaagtcgtagtgctacttgtatatctccttttcatgtaaagatctcaggatttttttctgttccaaataatgtaattctccaaccttttttctaaactgctcatactcttaagcatctattcccattaatgaatgcatgtaataaactatgacaactcagacttaccatgcaactccagctatgatctggtcagtgctaagcaaaaatggtttgtttctttcatagtttggaataatatatatctacatgtttgtatgcatgtgtgtgggggtgtgtttaaaattattcttttctttccttgttctactgagttttttaaaaatgcaacttttattttagattcagggtacatgtgcagatttgtttcatgggtgtattgtgcattgctgaggattgtggtacaactgattctatcacccaggtagtgagcataatacacagtaggtagtttttcagcccttgccccttccccctcctcccactctagttgtccccagtgtctattgttcccatctttatgttcatgtggtatacccaatgcttagctcagacttataagtaaggacatgaagtatttattttctgttcctgcattcgttagcttatgacaatggcctccagctccatccatgttactgcaaagcacatgctttcattctttttttatggctgcatagtattccatggtatagatgtacaacattttctttttccaatccacctctgatgggcacctggattgcttcaatatctttgctattgcaaacagcgctatgatgaacatatgattgcatatatttttggtagaacaatttatttttcttggggtgtatacccagtaatggaatgtctgggtcatgtggtagttctgttttaggttctttgagaaatcttcaaactgctttccacaatggctgaactaatttttattcacacaaactctactgaaaatttgaagtggatgttaccaactttgtctaatatattggttatttgtgggcagattgaaaacactgtttggatgaagcttagaggtaactgagtgtcctaggcgatcattaaggcaatttctcctactatttttcttacagaatttatttattaagcacaatagggaatcttctttttaatggtatgttttaatttaagtgctctgtcccaataatttaatttagtattaaccaatctgattcatttattttataatactcattgagaactctgtttctcttctctttaatctagagaaatgaaatcatgaaaataactgtccttatactatcattctcctttaaagattttgaaattcagtctcccttgtaatgtccatctcctggtcttctggagtaacatatctacagaatcaaagtaaaggcagatgcattgatagactgctagctagattaaccaagaaaaaaagaagattcaaataagcacaatcagaaatgataaaagtaacattacatctgatccccagaaacataaaagatcatcaggcactactatgagtatggcacatggacaaactagaatacctagaggaaataaataaattcctggaaagatacaacctcccaagtttgaaccgggaagaaatagaaatcctgaacagaccaatagtgagtagtaaaattaaatctgtaacaaaagatttcctaagaaaaaagacacaggaccagatggattcacagccatatcaggcatcaaaggaacatacttcataataataaaggccatatatgacaaatccacaaccaacatcatagagaatggagaaaagtttaaagtattccctcaaagaactgaacaacacaaagattcccacttttaccattcctattgaacattgcactggaagtgcaagccagagcattcaggcaagagaaagaaataaaagacatccaaatttgaaaagagtaagttaaattatttctgttcactgattatatgattttatacataaaaaccctaaagattcctccaaaagactcctacatctatcacaactttaaaaatacataaacaaatactctttgtagttgcttctctcaggaaatgacattttagtgtgcatctttcagggaagtgcatagagctgctaggtaaatacaccttcagttaactttaggagtatccttgacaagactggctacaatgatgttaagttatataaatttcaagtagttttggactcaatttgttcaaaaagaactaaatatataataacttctaaagaatcttcagagatggaatatgaataataattacatcatagttatatgtctatatacatcatagtaatacatctatatacaatgcatacctttttgtaggaatataagatttaaacaatgcacacagataattacagacaaattcagtaaaaatgcaatctctttaccataaatgtttctaggaaacatttgactcatttactttttctcatgtagatgaaattgtaaaaaattaaaataatttgaaagtttagagcatatgttggtaaaagtctgaaaataacatataaagtacaacaatataaaacctcatgttcattaaaattatttgtcaatatagaggaggagaggatttgtgggaaaacaattttattttagctgagaaggtgtgaatagtttttatgcccatttgatcatagttagctgctacagcttatatgcggcttgtccctcccaaaactcaggttaaaatttgatccccaacgcagcattgttgggaggtagggtctagtgggagctgttttcgtcctggtgtctggtccctcatgaatagattcaggccctcccaaggggttgagtagattctgactctttcaggaatgaattagttcccttaaaagtaggtcatttaaaacagcctggcttcattggtttctctttcttgctttctctctcatcatatgtgccagtgggacatgctcactgtcctttcactttctgataggagctgaagcagtatgaggccatcgccagatggagttgcccagtcttgaactttccagccatctgaattatgaaccaaataaacctcttttctttatacattatgcagcctcagatattatgttatagtaacacaaaattaacagagacatcagccatttttgaaaggatacaaataaaattttatctattatagtaactataaacatattgtagtagaaacacctaaagtataccactttatttattttctaacatcccatattattatcatcaatgttcctcaaactatgcttaagctgtatttttcattaaatgtgttatcctgttttaaccttttatagatagtttaagttataatgatgttctatgattaattttacgatggtagcattttcctataaatgattaacagctagctttgaaagagggctctaatttttaagatttattctataaaaatatatttgactgaggcagggcacggtggctcacgcctgtaatcccagcactttgggagaccaaggcgggcagatcacaaggtcaggagatcgagaccatcctggctaacaaggtgaaaccccgtctctactaaaaatacaaaaaattagccgggcatggtggcgggtccctgtagtcccatctactcgggaggctgaggcaggagaatggcgtgaacccaggaggcggagcttgcagcgagccgagatcgtgccactgcgctccagcctgggtgccagagcgagactccgtctcaaaataatatatatatttgactgaatgttgttctacaaaacttgcaagtaagccattaatttttcttaattgtaaaataagagccagaagagataatagctgctgtttatgtttagaaatgatccaagtgttggaaatgcaaatactgtgggagaagaaaaggaaaatttaaagctttatttgtcaaacttcattatttttgatgggctatgtcagagtcagggttaaagttgatattaaacctccagtggaaccgccagtcataaggaaagcagtgaagttgtttagggagactggattgcaggatgtaactaagtttcaagtgataattccttagctatagtaagtttaattatatcaaaaatgtagcagtaatgtttgaatacttgcctaattggacttattctgttaaataactgatcatatttaaagctcttcttgaaaaagtccctttaaaaatccatcatgccatgtagatcagtgcaaatctacagataaattttcaaaggagttggtagctcccagaaaatctaaaaaatgaaggttttataaatttcttaatataacagaggatatttggccatatataaatggcttatctgtgatattttcatacacttgacatctttggcatatatggtgtaaacacatcagaaagaaaagcctgatattccacagaatcagtgaccataataataagagcagatataggtgacagcaaagagcgtgaagtggaaagcaggataaagtagagaagagacaattaagagaaaaagtctaaattggttgacctcttttttcattatgtttcataaattatattcataaaaaagtcatatataagattgttgaataccataatatggtatgctttattttcaataaagcaaaataaaataaatgggctaaaatatggagatgctacagaaaaatacagggaaacttatatcaaggatagatgtacggtttattgttatataacaaattatcctgaaacttagtggcaaagacaaacatttattatataatattgtctatgggtcagaagtccaatgttgtgtgaatctgcatcaaggtttttgggaggttgcagtcaagctgttggctatggctgcagtctcatctgaagacttgactggtggcagtggtgggtaggatgcttccaaactcattcaaatgattggtcttagtctctggccatgtgcatttctccactgcactacttcccatgccagctggcttcccctagagcaatctgagaaaaagcaagagagacagagaccaaaacatatgccacggttcttttataaacaaatatcagaaggaacaccccattatttcaaatacatttttttagaatcaattcaataagtttagctcatatccaaagagaggtaattaaagaaggatgtgaataccagaacatagagatcataggcagccatcatagaggctgtgtttcatgatagacattattaaatatctctgaatgtgtgatggttaatattatgtatcaacttgattggattgaaggatacctagatagctggtaaagtattgtttctgggtatgtctgcgagggtgttgccataggagattaacacttgagtcagtaaagtgggagaggaagacctagcctcactctgggtaggcaccatccaatcagctgccagtgtggctagaacaaagcaggcagaagaaggtgtgataagctggcttgctgagtcttctggctgtcatctttctcttgtgctggatgctggttacactttaacatcagactctctggtctttggagtcttggacttacatcagtggcttgtgggggacgctcaagactttgaccacacactgaaggctgtgctgacagcttttgtacttttgaggatttggaactcagactgagccactactagcttccttgctcctcagcttgcagatggcctattgtgagactttgctttttaatcatatgagttaagtattcttaataaactccctcactatcagcagaacagcatggggaaaaccacccccgggatccaatcacctgccaccagatcacttcctcaacaggtggggattacaattcaagatgaaatttggatgcggtgcagagccaaaccatatcacaatgtgatcatttagactaagacaaaaatcaaagctagacaaaggaaaataacatgttaatgtggatagcatatgagagaacaataaatgttaaattagaaaaaaaaacagaacacaaagtaaagtcaatctaatgatgtaatgtttggagaacttagcttaaggggagaagaaaattcagagttattctgaaataatcaattaggaataatctcatgtatacttcagtgatcaaggataaagaatttgggcagaacaataatatatatctctaatgaaacaaggtttgaaattggaagacagtgaattagaaactagagtagtacaaagtgaatatgatcaagatttttgtgaggactttgatagatgagaaacttttctttaaaaaagtaagtcaataaaacatggaattagacctggaaaaatgtttgagtgatcatagtctacttcagctatgcactcagtactgatgatgttccaggaatagttttgaatagtttagttcatgcgttaaattagaactttaattcaaaggaatgttattattgaaggtattgctttttttcatcctaacacccattgttaccacagtaaatttaatttatgccaactattaaaagtctaacccttttgctaatgaacagttcaggattgtaaatatggcccatttttggagaatgatttgtgagaagtctactgtaggcatctggaacagacagagagtggtgggaaagacaagatgtctctttttccttggattttgtcatgtttgcagacaattctttagaacggctataagcaccttgttgttagcacaagaatgaagtaaaaaatcaaagatagcaattgttttctaattatcaatgatacaggaatactttcagaatactcatcctaggattaaaatgtctcatgagttctcaattttgtcaaaatccagaatttttatttaatagttattaatttcttttctttttaaaattatttgaatgaagaacactgaatggcatccagatgtataagcagtttttctctttccttataagacagaaaagttatgttacatccctttaacctctaaatagaataaaaaatgcaaagatagacagtaggttggtggtatgaaattaacaacttggcatctgtaacagatatctacttactgtcaaatatttacacagagaaaaacattctttgctgtcaaattttattagagcttgcactgaacaaggaaaaggtctcttaggaatatttcttgtttgatgagaaatgaacacagtgtcattttgctttttctttggggaaagatgaaaataaacacttatttaagtaattgtgagatgtttaaagtttagactttctgcttatcaaaaatgaattgtgggatataacatagcatcaaataacaactgcggctacccaccaatatttccttggtattactacaataggcagaagactgggctgggggaatatcaggcagctaattttgattgcagtgtggtttgggaatgagaataaacagtgtgctttcagagcttccgtggtatagtgttgtgcattgggattcagcacctggaaagtttgaactgtgatctctccaaatactagtggaccctatgtttgttgttctgttggtgattatttacttttggctttctttaaaccattgaatcaaattgctatttgatgtttactgggtaaaaattgttgcaataaatgcatcctaattctaggcatttcacatttttctgttctatatttcacattattttacattatcttgacattatcaacatcattcttatttgacattatctaatagagacactcattattttttacaatgacattgcacatatatacataggacgtggcaaggggagttagaatttaacttcaaatcttttattttcaagaagatatgggttcttgcacataccctctaactaataaggataaatgtcatggtctttaataatattatgccagatatttttatatattacaatattgcaattaattcactctttctactccttcttgaccaaacatactagactgaaaaacaaggtaccaaaacatcgagtttatttctgaagttggccctccaatatctatatacaaatacctagtccaatactttgtcctctagctcagcagtgtgatggaggttccaaagtttgagttagacaggtaactgaagatctactgcacagcatagtgactaactataattaataataattcttgtatacctgaaaattgctaagaaaaatagacctttaatgttctcaccacacatacaaaaatatgtatatgaggtgatatgtgtgttaattagcttgtcttaattatttcacaatgtacacttatataaaaacatcaagttatacaatgtaagtatatacaaattttatttgtcaattatatcttaataaagctgagggggaaacggttatagcaaatattaataaagtgaaattgaaacaaacaaaaaatagtatgacacacaccgcaaatggctgtcttcatccatgttccacaaagctcatgtatcccaaattatagatgtagattattctattgtatgcttttgaattatacctgtctatatggcatctgtggtctatctgcagacatcagttgttgatgactacgcataagcaccttctctaagacacctagactactttttgttgagtaagtagcatgtttggagaaattacctcattccacattccttgaatggcttccttcttctcttcctcctccctcaccctcacagctatcctctcctacagatggcctgtgaccttttcactcctgagaaagttaaaactctaggtgcttcatcagatcacattccacatctttgaccacctttaatcccattttcatcccatttttaccacaccatctctctgttcaccattcaaaatttcaaatcaggctacttctcttctttgtacagcaaacatgccactcttctccaaacctctactcagcaaaactgttctttatattttgatcaccatcagtgtatcacagagtcaatatagattagtagaaagaacttaaacttagattttggaaacagctatgtagcaatcaatgttattatctgtactactaatcatgatcattagcaaaagtctgccatgcagaagtctgttgtcttggtggacatataagatacaaaagaagacaaacatgctaatgtatggtgagtgttcccaactcccttcctctccaaaaggttacacaaatcacagaagccatagcatggaataaaatagtaatattttagtggaaacattaaattgaagctaagggtgaatcgaagaaatgaaagcccactcaccaagataacctcaaagtgtgttgttgggtggcttcagagtttccacaaggcatttatgaatgctctactgagttgaatagtggattcatgtgaaaccacaccaatgactgaggttcttataataagagggaaaatttgacacagagacacaggggaatgccatgtgacaaagaaggcagggattggagttatgcagctacaagccaaagaatgccaaagatagctaccataccacaagtatctggaagaaactaagaaggaccttatcctagaggcttcagagttcagcacagctttgccaacattatgatttcaaacttctagcctccagataaataagggaataaatttctgtagtttaaagctacttggtcattacagcagccctggaaaagtaatatttgttaataataataagtattgtgagtcattatatattaaagagtacacagtgtatgtagagaataggggttaacactctgaaatttaaaaagtaggcttatatctcagaaccaccacttagtactttctcttggagcaagttgtttatccaattcaaatcttaatttcctcatgtaaaatgagaataagaattgtattttcttcatatgattttagcaagaagaaataagataatggacataaataaatgtcacagtgcctggcatattataagagctctatatatgtattcaaaagataatgactctacaagagtgatcccaaagttcaaggtgacacttataaaacaagcatttgatctttctcccccttcacagaaccactagcacatctcacataagcacactgctttaaatactgacacattttcacatggggtcaagccaacagccagcaatgcctagatgtctacaattccctagcaatactccatccgcttgaaaattggaactgacataaaatatcacttatgaatgggcttggaaggtaagtgaaaaacaactttttaaactgtttttcccctgtgcagtaactcgccaccaatgaagtcaagagacttatattttcctgacctgtttgtctatttcatgagcacactgtcttgcaaatagttgatttccattaagttgtcaaacaggcaagaagatctaaggaaaatcagaaagagctcttcagtgaccatcagagctctggctgacacaagtagttgttaacatgcctagtaatcaattggaaattttgtattaaaggaagattattcagctaccatgctcatgagattatgatttattgggtgagaaatctgagattttaacaggtccctcatgtaatgctgttgcaggtggcctgggagttacattttgagaaacactggccatataaatagggagcagcaagagtctgatagttttgttttagtgttcttgatacttatttgagaatataaacacctaaagtcactgagttagtttgcaagtacttggatcaaaattccacataaaaagaccgggcgcggtggctcacgcctgtaatcctagcacttcaggaggccgaggtgggcggatcacgaggtcaggagatcgagcccatcctggctaacacggtgaaaacccgtctctactaaaaatacaaaaaaattagccgggcgtggtggcgggcgcctgtagtcccagctactccggaggctgaggcagaagaatggcgtgaacccgggaggcggagcttgcagtgagccgagatcgcaccactgcactctagcctgggcgacagagagagactccctctcaaaaaaataaaaaaataaaaaaataaaaaaaaaatccacggaaaaatatctaacatcccattctctcgctggtatctcctatccactcaactaggatgtaaggacaaaaagaaaagcccctcaaactgttatctacgtagtaacttagctaaagtataattttgaaaataagccctttgaactcaggtttttacttatagcccccgggcaatctcaggatctgctctagcttctgaagtgctattttaaggatgactctcaaccagtgctgcattagaattctgtgtggaactttaaaaatccacatctgtcaccaactacattgtaatttttggttgcattcacagagcatagggattcctgaattaaatctaatgtgcagacaagattgagaaccactacttgatctgaacagatttatcaaaggctatatgaccaaggtctctgcctgacaataaggaaaaaactgctatttctgaatactctggaactctcagacaagacaaccccaagatgtgtcacagaatatttgtatatatatgagactgtagataatgaggttctcatatattatgtattccaagtctcagaaataagctacttgaaaaaaaaatgtggtctagtacagacgaagtctgagaggaaaaaaaaaaaacactgtaactcacgttaccagcttaacatcccaaaaagaatggaatcttatggagaatatgataaattttaatagaactctagtctgcctgagactacatctctaaaagagtaaagttcacaaatgggaaaattccatacaaaagtcatattccatatgtttaggtttagatacatatgtttaggtttatttttaatagattgattattaatcaatctattaggttaggttgatttttaataaaaaatcaacattacactaatcagtgggacccaggctcataaattatttttgttcataatttttactaaatattgtcatccttagaaagattaaacagttaagcctatcatgattacaaactaccccaatacattctactccaactcacatacatccatgaatatttttccctgagaggatctctatagaacgtaagttaattataaataaactactgtgagtgtaatactttccagataaaaaggatgagatgataatttattttgtccccataaataagattaaacaaggtgtggagcagctgtgtgtcaggcataactattaaaaatctgagccctagtaaactcaatccagtgaaatataataaaaacaagtggttatatttaagaaggtttgaaataaagtgtctttaagtcctttatctattttagaagttgctcttttcacataactttactcttcacctgaaatatgtatatatgtatttattatttttaataaataaggagaaaaaagataaattataaatgtttgcttcatatggcaaaaaagtgaatgcctgaggtgttcatttatttcttttagttataaatgaaaaagagacctagtcacctatttaatttatctcagaaaatactagagctgaatagctgcatagaaacattctgaaaataaaggtcaaaagcaaaattttcaaataaaacctaggtatgtatttcatgtactttaagccaatatatatctacttaaaataataaacctaccaaataataaattatttaggaatactgatacatttttatatggaatgttttggcatagtgaaagattatctttcaatacctctccatatatttgctcaggattatttctgaccgatagtgatgctttgactcatcattgattattttactacaaataacttcctgaaaacctttaatggtcatcatttttggctttatggtaaagagggtacaaaccatgatttcctcatcaacagccttgcatcatgctcgatatacttagattatgagatttttgtcactgggagccacgaagtgtctgtagctatcaggattaaagaacaatcgcaggagcaagtaatcaatctctgataggccagatgtaccaaagaaatacagtctataaaacataatctttgacatctcatttcaaaaaaactgcatgaaagagaaacaatttaccattcattcctaggcaagcagaggtcacagtgttgaggcaccaaaccaaggtctcaaaggacatacttgtcactttgaaaatgttctaagacccctctacaaattgtaaaagctaccaaccatccaggaaaaaaaacgaaacaattttctacaggtgacgaattccataagttacaccaattttctgggcagttatgtctcaaacaaatagtaaatttgacctttttggtgttataagtgctgcaaactctgaaatgaattgatacactttctaaaaaggggatatgttttttatatatcgtaggttctcacttcagacattttagtagtgtctaaaattatggtataggtatattatccctaacaaggtcacagtatttgtcagcttataatggggaaaaccaatcgatgaagtctacctaaataaggattaccttgtgaaatatagttgggtaaattgttaaaaggactaaatgtgattgggttaagtagcttctacaaagtggataatcttcccatatgtcctccgcaaattaccttgagctgatagttttgtgataaaaaatctaaagaaactgctgtattttatatatatataatatatatacgtgtatgtatatatataatgtatatacgtgtatgtatagatatatgtatgtgtatacatatacgtatgtgtgtgtgtgtatatatatatatgttggctctagttgcttctacaaggtgtgtaatcttcccgtatgttctctccaaattaccttgaggtgatagttttgtgataaaaaatctgaagaaactgctgtattttatatatatatatatatatataatatatgtgtatgtatatatgtatgtatgtgtatacatatacgtgtgtgtgtgtgttgtgtgtgtgtgtatatatatatgttggctctactgatataagaaaaataataatttaatcaagtgggcattctgcctattagctgagtggtcatctgttcatttcaggcaataaatagattttgaaactgtatagtaatgaataaattaaaataccattactttcagttttcttttttttcttttatttatttatttatttattattattattatactttaagttttagggtacatgtgcacaatgtgcaggttagttacatatgtatacatgtgccatactggtgcgctgcacccactaactcgtcatctagcattaggtatatctcccaatgctatacctcccccctcccccaaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaagggcatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatacctaggcattaccattcaggacataggcgtgggcaaggacttcatgtctaaaacaccaaaagcaatggcaacaaaagccaaaattgacaaatggggtctaattaaactaaagagcttctgcacagcgaaagaaactaccatcagagttaacagttttctttaaataaaatgacttgagaaaaaaacactaaaaaaagaaaatgttactgaaaattttatagaagatatagaatgccaagtaaattattttaggagataaaatcattatataatagaaatcatgatcatcttaaattttaaatgtatttttattacttaaacaaatcatttacaaccctagccccttatcaagtaatgttttacactttaatttattcatatgatacatgttttattgtcctaatgaaatcacagccatgagaaatctcattgtttattggaggaggcttagaaattcccagatatatgcttgattttatattgtagttagatttgcaaatagcaaattgattaaaaggctggtttacagcctatatacaagcacgcttcattttattgtggttcacagattttcattttttacaaattgaaggtttgtggcaaccccgtgtgagcaactctatcagtgctatttttcgaacagcacgtgctcatttcatgtcattgtgtcacactgtggtagttctcacaatatttcaaactttgatcattgtgattacatgtgttatggttatctgtgatcactgatctttgatgttactattgtaattgttttgggggcatcgcaaaccatatccatataagacagtaaacttaattgataaatattgtgtatgttctcactgctccagggactggctgttcctccttctctcttcttccccatttactgagacataataatattgagactgggccagttaattaccttacagtgacccccaagcattcaagtatctcactttaatttcaaacctagaaataactaagcttagtgaagaatacatatttaaagacaaaataggacaaaatctaggtctcttgtgtcaaatagttagctaacctgtaaatactaaagaagttcttaaaggaaattcaaagtgttactctagtaaacacataaattataagaaagtgaaacagtcatattgctgatatggaagaagtttgaaagatctggatggaagatcaaaccaggtgcaacattcctttaagtcaaagcctcatccagaataaaagccctaattctcttcaattccataaaaactgaaagaggtaaggaagctgcagaagaaaaggttgaagctagtaggggttagttcttgcggcttaaagaaagaaaccatgttcataacatgaaagtgcaaggtgaagcagcaagtgctgatgtggagctgcagcaggttatccagaaaaatctagctaagataattgatgaaggtagatacactaaacaaattttcaatgtagatgaaagaaccttccattgaaagaaattatcatctaggacttatagataagaggagaagtcaatgcttgacttcaaaccttcaaaaaataggctaactcccttgttagaagctaatatagcttgtgactttaagttgaagccagtgttcacttaccattcagaaaatcctagggcccttaaaaactggttaaatctactctgcctgtgctctataaacataacaatgaagcctggatgacaacacatccttccacagcatggtttactgaatactttcagcccactattgagatctacttcacagaaaaaaaaatttttaatattcctgcttactcacaatgttcctagtaactcaagacctctgatgtggatgtacaaagaaggaaatgttattttcatgaatgccaatgcaatatccattctgcagcccataaatcaaggagtaatgtcggtgttcaagatttattactaaaaaatacattttatcagaccatagctgccatagatagtgattcttacaaggaatccgggcaaagtacgttgaaaaccttctggaatcaccattctagatgccattaagaacattcatgatttatgggaagaggtcaaaatgtcaacaccaactggaattaggaagaacttgattccaacttcatgaatgacattgaacagttcaaaacgtcaatggaggaagtaactgcagatgtggtagaaatagcaagggaactagaattagaagcagagctcgaagaggtgacttaattgctgccatcttatataaaacttgaacagatgacgagttgcttctaatggatgaacaaagaaagtagtttcctgagatggaaaatactcttggtgaaggtgctgtgaacatctttaaaattataagaaaggattgagaatattacatgtatttagttgataaagcaatagcagagtttgagaggattgactaattttgaaagaagtcctgttttggttaaaatgctatcaaacagcattgcatgctaccaagaaatattttttgaaaggaagaatcaatcaatgcaggaaactttattttcccttgaatatatgaaattaccacagtcaccccagcttttagcaactacactcatcagtgggcagccatcaacatcaaggtaataccttccaatgacaaaaagattacaaatcgctgaagtctcagatgatcattaacatttttaactataaggtattttctaaattaaagaagctttctagatatatgttgtgacacagttaatagactaaattttagtataagcataatttttatatgcactggggaaaattgtgcgtaacctctttattgcaatattgactttatttggtctggaaccctacacacaatatcttcacagtatactttttcccccaaatattttaccacctaatgaaaatagctacctacagaataaaatgacaattatctaattttcacaatacaaatgaaaaatacaagttctgtggtattggaccatggatatgatgcatgttatttttaaccaatttacttgctaaagaaaacctctctgatgaattatttccctgaggtaaatgtatcattgaaattttcaataatacaatgtcttgcactattaaagagtgaatatctaaaagaaacaaataacatattagtacttattaattatatgagcatatatgcacatacaaactagtttgagtaaaatataaatattttaaaaattcaatcacttagtttgggagagaagtattgaagagggcatctgtattttgcccaatagccaaaacagtttatatagtttatatcccttccattaccagcccttcctcaatggcattcaatattaatagtttcctgtgaattatactaacaattttctaagcattatataagaagcagagcatattgacagcatttatttgttctgtgagagataaaacaatgaaataagatttagaaattctcttattctctttctctctctctctctttttttttttttttttttttttttttttttttttttttgttgaagtggagtctcgctctgttgcctaggctggagtgcagtggcatgatctcggctcactgcaacctctgcctcccaggttgaagccatcctccttcctcagtccccctcgtagctgggattacaggcatgtgccatcatgactagctaatttttgtgtttttagtagagacggggtttcgccatgttgtccaggctggtctcaaactcctgacctcaggtgatccacctgcctcgccctcccaaagtgctgggattacaggcatgagccactgcaccccgccagaagttctctcttaaagatctagcaatcaagcaactttagggaaaattatttacaatgtgtttactatctagaaatactttgtttccttgtcatgtgtacatagtactttttcctgttgttatttacaaatacaaatatgcagatattccacaagaagacagccagagtgtatacgagttaatcagcctagaactgtcctccatttctatttaccctagaagcctcattccattgtttcgactttgaggagattcaagagatcttcgagactttgaaaccacagttatgaaaatattcaaactttctctttttttttgtattcttctctaaaatggatatgataatggcacttacatcatagccatgctgtgagcatagatgaaattatgtatttatttatattttttctttaatttttaagttctgggacacatgtgcaggatgtgcaggtttgttacataggtaaatgtgtgccatggtggtatgctgcacagattaacccatcacccaggtattaagcccagcatccattagatattctccttgatgctctccctccccctaccccactcagcaggcaccagtgtgtattgttcccctccaagtgtctatgtgtctcatagttcagctctcacttatatgtgagatcatgcagtgtttggttgaaattatttatttataatgcttcgccgaattattattttatttggaattaatataaatactgctttgattataaaactacatcctagcatcaaaacaccaaatgatgattatgaaaagtaaaattaaaaaatgttaacatttgacaattgcaataagtgggtttgtgattgaaaactttagattcaaatgtagctagtttaaacaactttacgtatgttagaatacaacgtaaagagcagaccacgtgctgtttgtgtgtgtgtgtgtgtgtgtgcttgtatgtgtgtgtgtgcttgtatgtgtgtgtgtttagtctttatttaggtataatgttggcattccttagagatagtagtaataattcatcattttctcaatgtatattttatgtatgctctaggcattttacttgtaatatctcaaacatatttttacaaaagtttctggtaaatattactaactcaagcttacacatgagggagctgaagcttacccagtttaactgactttttaaatgatacttagaaattagaaagattttattcaaactaagagctatctggttcttaaagacattcattattcaataaacttgaaatcagacaataataacacatttattgtaataaaatgatgttattggagtagagaagcaggcattcttaatataaaatgataataaaaatctttcttaaaagccctaaaactgaatattggtttattttcttaaggtaaaatatttaatgtatattaaatatattaatattttagtataagatatagttcataatgaaattcacattcctacattattatatataaccaacatgaaaactaacatatatttctataaatccattaacaaatattaacatattgatcttaattttatagctatagaatgttagtagtgaatattataatgtcttggagaaaagtttgcagataactgtgatcatcatgattccttaatgttaacatttttccatattagcttcaaatctcattaaaagtaaaagaaaaaaaattagagattcggctaaagtttcagttcttccctatctacactgtgatcactacctcactaaagttaaatgtgtgaagtagatctatgtatgtttagaacaaattaaaatcctgattcaatatttttacacccagatcccttatgaaataccttgcatactacacccatcattatcatcatcaactacagctaaaataaaatgtgcactgtgaatatttccctgaactacgatttccttggcttccttaagtctcagagttaaagtcgctaacttgctaatcaaaactcctatggagatgagagccagctttaacttctacagcccttatggctctaacatgatgattcacaaatctgtctgcataaaagatttttcagaggagtttttaagcaattttgatgcctccccactccattcctataagcagatcagttaaattaggtggtctaattaaatgtgcctgccagaaaactacagcaaataccattcctgatggagaaatttagaagcattcttctaacaattgagaaaagcaaaatgcttactattgccactttgtttaaaaccctaaagttggttctaaccaaagtagtaagaaaagcagtaaagtgtaggaaagaaggaacaaactttaattttcactaaggttaaaaaaaaacttgttcaaaataatatatttttagttggaatgaaaactgacttcttatctcacagattaaaattggatacaataatcaaaatttgtaatgatggacctaaatcaaaagaaaatatattaaattatacatttccacataaggaatgagagaagtgcatactagattctagaaatatgtatgttaagtggcatatataaaggaaaattctcagtctttaatgggataaagcataggattttttaaaacttgtatatgtaacatttgattgacttcctgttgatgccaaacaaattacattatgccatcaatactttaagcgagttgtatctaaaggaacaaaagaatactcctgtaggttctctccaataatattttacatctgagataaaatttcctcggagatttcagatggatatacataggaaggcttgaatttaagctcagcattgacttccagcatcttttctgacttttaaagggcacttacaaaatgaggaagtaaggtctctatgatctgtgatggtttcatatggctttgatacttttggtttttctccagggtaaaaggagaacatagttcggcagcttcatagcaggggcgctttgaggaattactcagcggggccagtaggaattaaagaggagtgacaggcagacctattctcccctctgaaagaatgaatgtaaggaaatgcttttgcctcttctctgctttaaggcatatgaacaaggtctctatagagtttttcagaagcgatatttagttcattttctatttgagttccaagctgtgaacattgggtaaatagtttagtctgtgcttttctttttttaattaataatttgagagctttgcacatattagggtgtagaaatagcatgaagttcctcactcatgatttaacaaaaagaccttttgttttttgctcttctatatgttgcctcctaaatttggattcctgatgcaaagacttcaaagttaatttgctaagtgggacatcacaattaacactgtgaatcatccgtagttatagatgatactgtctacctcaaaaaacagtgtacctggtatctattcaatatcataagcggattaggctctacctcaatttttaaagattacattgaattagataataaattgaaatcatagtcaatagactggtggggctttttcacatatctctgtcttaaagccaaagttttaagtattaaaaatatatttttgtttataagtgttttctcaaaagtgttttgaagtaatgggcaggaatattcccatttaaagtttaaatattatatacagcgcagtagtaatatatatttgaaaatatcagtattgcctaaatataagtgccatgagggcaaatttcttttctgttttgttcccatctatattgtcagagtccagaagagtgcctggttcctaagactgttcatttgatgaatgcctacatctgcattatttaataccgaattcatatgatagtattttattttagcatgaaacaatagcttaaaaataataagaaaagagaagaatctcatctgttattagtaatatatttaagaaatggacttttaagaatatcacatttccagtgttgtgaatagatacagtaagcaattgttttcatctttgagctaaaataaagtttgcttcatatagcctgttagagtttcccattgttaccttttaaagtaatattaaaggagccactttttaaaggattttcccccatagtctcataaagtcggaaaatgtctacttccccacagttttattcttactgttttcaaggagccagaaagggattttgaaaactccttatttaaaaacagatgcaaaacctaattatatttttctttaaggcttcaaaggacaatgaataaaagtaaattttatcactcctggcccccacaaatcactagacatccacataaacatctattaaatgaggaatctcattctttctaataatatgttatatttatatttcaaaaactttccttataatgttttacttaaaatgaataatggatataaaatagattaagattaagaatctgctattcagtgattatacttagttttccatttcattactttacagtccacaaaaaataccattcaaaatagacatgtcttcttgctaattaaaaatatagcaacccaaagatctcttggtacagtcttggcagttagttccataagaagacgaagacattgcaaagtgaattagtatgatgtactgtcgccatagccataaacagtcggtttttatgtttaaccagattatgaggttgagagcattgctgtccacagagtgcatatagtacatgctaagttgactttatttgtaatctagctcaattagatacaaggaaaaccatagcaaccaagctgcagtgatgctgtcagaggaattccctctgatatattttgtcttcccaagttggagttgcagacctcagagaaagtggtttttctctggaccaaaccttatcttcctatatgtaatcatccagggaaaactgaagctaacagctactctcttgaatttattctggcttatattcaaaaactaaactattgccctaaaaagcagttaagcttcacttgatgaaaagcttttggatggttaaaataaacatgtgtttcaaaatattacctccaaaaaaagtaaaacctatttcagaacttctataagtatacattgtatggctttccaaagaaaaggaattttataatacatttttactggatcctttgaatgaatgattattctggatgcatattcttagaacataccctacgtatcctaaaatctaatttagttcagtttggagaatttcctccaggtgacatgaaagagataaataatatctccaattcaagctttatacttaggtaggaagtatcttgaagtaaatatgactaagaacaattcaccttcatatttatatatctcaccaataaaaaatacttctaggtaaaaggaaagagtaatgtataccatatagattccagcagttttatgtgctatcaaacttcattacactatagaaattcattattatttacaatctggaaaggaaatgattttaaaatacaatggtacatataataacaaacatatcactttcagagtatttttcagtcatgattttcttcagctatcagttaataaaattgattgccagtttttcatattcacaaattctaaaaggaaaccacaaacattaaattggttttgttgtgtgataattttatataatttatataagtggataatgtgtaagttgtagtccttattggtgggaaattattttatgtttcagcttaatttattgtttggagataacatatttataaataaaaagaaaatgtaacatggggaatttagttaactcattatgtggactacagtgaggtaatatcatgagatttatgtttttatgtggctcaaaacggtacaactgcacactcaaatcagttttagtacagccgggtatcagagtaacaagaaaacagtgggaaagggtgttccagtaccctttttatgtatttatttttggtaggtagtaatcttatatctataaaattacctttgttagataagtagtttatataggagataaatttagtgcctggggataatttcaaaagaaaaggctatcaatgctaattgcaaagagagacacattaaatcaaataatcacacaaattcactttctactttataataagatttgaaggaaagccaaacttaaagtaacactgacttttccaacttcacttaaaataaaaaatcaaatgaagacaaaaacatagattcatcatgagcagaatactaagataggtgtgtgtgtgtgtgtgtgtgtgtgtgtgtgcacctgtgtgcatgttcctgactttcatcaatagttcttagacatatttaagccctcaggaccagattctcaagagtataaatcttttccatgctgcaaatcagtgttgggacagtgtttaaaatctcccaacagtttcaagagagaaacaggctttaatgagaatatgtgggactacaaagagacacactgaagtgaatagccaaattgtttgaaatgtcttgaaagtaatagttttctcagtgtaatatgaatttaaaataaatatgattctatgtgctctgagaactaaagccaaattcttatttgcatttcaattgagttattttactattttccatttcaatgttttaaaaaatacattaaattgagtcttcaattagatatgaggcttaaaatgaagtatttctcatgtgattttatgtaaaatatcacctctaattctccatttccttcactttctttgccctaatagttttaataattatacatataacattcatttgttaatttagtctcttctctcaaagattatcagtccctgaaagcacaggttttgtttgtttaactcacagctttattcccagcaaccgatacaataaatgaatgaatgatcttgaaaattaaataattaaatgaccaaaaatcaagttgttttggtcattaccactgttagcaacagtggtaaaatgtactaaactagcagatatcctattcctagaaaaatttcatatttgcaagggcttcaagaagggggaagggaaacaaacaagtttgaatgcttgactgtcatgtgaaatcttgatagaggtcatttgaaaaaaaaataaattttacctcagtataatattgccacatcaaaatcatgctgtatgaaacaagtgatattagcattaaaagactataactactccactgggaagaaggcagaggtttagaattttgctagctttggtcacaaacagattaacaggatgaaaacagaatctagtaaaaagcaaataaaaaaagaaaggaacaaaataaataataatttcaaaaaggtcatccccgatacttcatagcggtatagaacaacaagtagtaaacgtagtaatcaatatgaaaataacataattttaagatgatcgcaaactcatctggacaccaaatatgttcatatttgggtaactataagacagacatagagttatttctggaaattgatttttcttctcactattccatacatactgaagcttgacagtagggttctatgagaaaaaactctgagaacacaataaaggccaagttcctacatataggaagaaagagatcttaaggacatgatagggataaataaaatgtgaatacacttttttctcttcctggcttgcaaggatgcacccagttacgctttccttattaaattttcaacagtttagggtatttgagagagatgcttaacttcacctaaacatacccaacaaaataacaaatagacatacacaatctctctcactgtttttctctctctctctcttcccctgccctcaatttaatttaataagaagctattttcagaataaataattcaatgacttacattctttagcattgtttttgtatatcacaaatatagagacagattattacatcaaaagttaatggcagtaggttcaaagatctacggaaatgagacatttaatttatagttaataataggaaaatatttaatcctctaagagcaggagactgatctctttcattttttaaaaacgaattttccaccatccagagaaacacttcttaaattgacttgtaaacttacagagataaaagactttttggcatttctcattaaatgtctaatatctgaattaagagaaatatcaaactcctgtttttagagtttgcaccagaaaacacacctaagaattattagctattttgcaacaacttagttgccttaagaatgatctagttattgttcaggcgcagtggctcatgcctgtaatcccagcactttgggaggccaaggggcgcagatcacttgaggtcaggagtttgagaccagcctggccaacgtggtaaaaccacatctctaccgaaaatacaaaaactaggcgggtgtggtggcacatgtctgtaatcctagctactcgggaggccttggcaggagaatcgcttgaaccccgaaggaggaggttgcagtgagtggagaaggcgccagcctaggcgacagagccagactccgtctcaataaaagaaagaatgatctagctattatttttgccaggtttcctttctctgtcttcagtttaccttggaaaacagattttgaaaggcaataaataggcttttgccatttctgtccacatttctaacataacaggaaactctgtgtatattaaattgtgagttttgtgtgtacacaaacatacaatcttgaataaggatcttttaaatgtctattcttttaaaaattacagatgttctttttattgcatgtgttagtttgggatagcaaagaactaacaaaattccccaaggactattcaagaaaggatgggacagagctcaaccaagagcactacctgtttttgattgaaaggaagcagataactagagttaagcagaaagtcaattagggcaccacttcctttgcacttctggattgaatccaattctgttgaaacatctaaaattgataaatcaaaagtctctgtgtttgttttactctccttggatctttttagagcacctcacatcaacagatccttgcaattgttaatgaagtcacatgaaaatttccatgatgaagagatgccttttgaaaatttacatatttatagtgtttattttgtatagctgtatataaacaaacttgatatagacacaatgtttaagtgaagtttatgagttgagattctaagtgattatatcccgttctcaccctaaattaactgattcatgttcaaattcattataatcaaattttatcattctattgtcaacatcattttaacaatataggaagaaattattataaagaaaatcataaaaatataaaaccaggtcaaaagagtaatgcaaagtatttttaaattaaatgagaataaattataaactattctctattagatataattaagaagaaatgcatttttttgaaaattaataggtgtttcatttgaatattcacaatgcttaccatgcaatgctattaaaaactggtggatttcatatacaagaataaaaggctgacctttcagtcttagtccttccttcagtgagatagttaattataggaaaagaaaataaaactatacatattccagacaaaatgataacttatttccattcaacaatgaaaaacaaataatttctatcttgtacatcttttacaatttccaactagatgtcatattctgctctcccacaatcaaagtttggtattcaagaattccctttaggaacttttgctgatgtctctgactctaaaggctgtccacaatgagtattttttaaatagctttgttgagtcttaattgttatacagtatatttcacacatgtaaagcatacaatttgacaagcttaacgtatgtaaacatgaaacaaccattacaatcaagataaaggacgtatgtatcacccccagaagtttcctcgggctctgttaaaccttttccttctcctgctcttctctgcttttgccattccagacattcactaatctcctttctgtcacaatagtttgggatttctagacttacatatttgtgggctcatagagcatgtactgttatttttgtctgactttattcactcagcctgattatttttagatttatccgtgtggttaggtatatcaatatttcttttccctgaattatgaatattccaatgcactgatgtactacaatttatatatgtatatacacatctagttcttggtggacattttggttttattattttggtgctattacaaatcaaactagtgtgaacattcatgtgtaaatctttgcatacacatatgctttttattttaggtaaatacttaggatggcttggcaggttcatatggtgggcataagtttaatgattttaagaaactgccaagctgatttccaaaaaaattgtgtaattttagtagttttagaaattctaatagatgtgtggtggtatatcattgtggttttaatttgtatttccttaatgatgttcagcacattttcctgttgttgttttttttcagtacacattttggggttaagtgcttgttcattttttcttttttttttttttaagtgggctattttattacttagttttgagtttttgtacatgctaaatgatatatgtcttttacagatgtgttatttggaaaaaactttctcccagactctggtttgacttgaattcttttaattgtattgtgagaatacaattagaaattgttctatctcgttaaatgttccatgaggtgcatttgacacacacaatgtgttattaatgatgtctccactaggccatatatatgagcataacaatattacaggccaaaaccaagttatgtgtaatatgcatcagtgacctggctcattgaagaattgatgactcccaaaatttaagaacctcctatttttactatttagtacagttaattggtagcaaagtaaaactgcagaataatgaaccttgatgtgagaaagacctttgtgcattattagttctcttaatcatgtataactttgtgtactttcctcacatgcatagaaggggaaatactgttttatggattgttagggggactgaatagtatagtctctgagtaagtaattagcacattctaggtgcttccttattatcaatagcataatgacaaggaaattaaaaattcaacctttccccaaacacgcgcacagaacagaatacttcatataagaaaataaaggtcagaaagatgtaaattgttaagtattttgaatagctaattgtgaagatatatatatatatatatgatctatatatacaaaattaggatagtacagaggctctttaattctctctgcatatgaaaaagaagcctgataaatccacacatgaaaaagtcttcttggtctatactatgactacttgagaaccctcaagaactccacaaattctgagatgatactttatctataataatgtaggtcataaaaatgtttctaatacatttgagaggcagatatgagggacaacaaggtttttaatatattaaatatattgaattaatcattcttacattctttaaagagaatgtgatataaataatcacttttttattgtgcgaataaccctaaaatctcaaacaccatttataaatgagagggcaaagtacttccttaccaaatatcacagcacccatagtatcttgaaataaaattagagacacattagccattgagaaaaagtcacataattgtacctttttatttattaaatgataaagtggaaaaatacagaaatattgggctttgcacactgtttagattgagataatacatttcttagataaatgtgccctatattcccatattgcacatacagagatcaactgtgtctttggcttttgaagtgagaagatcactttaatgaacttagatgatatgataggtgactatgaatccttaataaataacttcaaaataaaataatgttccccatcatcacatgagcgtggataaagatgtagctgtaatggctttgcataaataagtgtaaaagaggaaagctgatacaactctaaacatacatgtttaagaagtatgattaagtccctgggattccaaaaatattctaacattataagatacatcaatgagtttaatgtccattttggcaagcaaaaacaaagcaaaaagataaatgtaaataaaatataaaatgtaataaaaaatataactgtgccgtagtgcttaagtctacagatggcaatttctacttaacacatactatgtgagatttttgctggttattatgagaatggggaaaacattagagaagagaaaggctttgaggtcccatgtgctgcccagcttatttcttttaggctccatgtttgaccttcacagatcctcatgaaggtaaggacagaataacaaaacacaagagatcattagctaggtagagtataacacatcacttgggataccatttgtctttatccatcaaaaatatttattatttttcagcttcctacagaatatgtagtggtaggcctggcacatgtcatcatccaaactgagtataattttcttgactttggtacttgcaaccatctacataaaatatattgcaactcatctagacctaaagttgtcctctttctctgaaaaactacagctgctgtaattcagtcttcaataaaacacataaactcatgcttaattgtacatatacataatataaagatattgcatcacactcaaaaggatgagcaagtcaaggaaagaagggggtcatgttgagaaaaataatatcagaaaagggaacattatctcatgttggaaatgagtggtccttttgacaccgatgcaccataggaaatagaggacatggttgagaaatacattatcaatgttctaaacaaaattcaaaaggcaactgaaaattaggagttttttcatgtcttttgggtgccagaccatcatgtctattctattcagataattagacagtctggaaaagattggaatatctttagaggaaatgctgagagaaaaaataggcaaattctatcttctaacatacattatcctaatatgtgagtcagtagccttgtgagcaaggccactgtattgggagagcattttctggccttcagacctactttagcgcaaaagcaacataggattcagatctagcgatctctcctgagattattacagtttctatgtctgatcaatagtgagaggatggtgaataaaagtgtggtctcttcttctagcctacaacatttgtgagaagaaaacttagatagaaaagtgatatattcagagagaggtgttttggtatgtaagataggtaaatgccaaaggcagagtatggtctcttgccttcacatgcctttgagaattctgaaagcctcatcaaagtaaactttgtagtttattattgtcaaaaagaggggcactctgaattctaagctttattagcagtcattagttcttacgtgttatacacatcatcttagcagagaatttagctaataagtggaccaaaacaggtatttgtagcaaggacaggtggttttgaagaaggctgtagaatatgcctcatttttttttacagccagcaggattcaaattcagacttcatcacagtgcaaagtgctggtcactactgtgccctaatcaaggtcacaaatcatgtagagactctgacttcagatgtaaaggtctgggggaacaaggaatgtcatatcaaagaataaaggaggcagagggcatagttcttaacacatttttatttatatgatcatgaggactttctgagttatacaatacctgacacttcttgttcctcaccccacatacatacacccccagacgctactttagtgagagaatttggaggaaacattggcaacaccaaaagactgagcatttttttcattcaaaagagaccaaataatgcacagctcgatcaattatataattggatttatttatttctcctccctagctaacaagaatatggaggcttctgttgtaggctggattagttacagtttaagtaaaataaattttactttctcagtagatcaaatatttaattttgtcaataaattagtgtgatctaactgtaagaataatgtgaagtcatttccttgaagacaaggaaaaatattttaaaattaaaagctatcaaaaaaagcagtgaataacaggtaaaagaagaaacacagtatctagtaaagtaaaaaaatgcaaaaaaaattctcacaaatcaaaagaaaagagtaaagagtaaccaataattaaacaaaaaacattgagatgcatggagaatttatctggaatattctgtcaccaaattagggaaattaatgaaaaaaagagtgattataaaccaataattaaacaaacaacattgagatgcatggaggattgatctggaatattccatcactgaattagagagattaattgaaaaaaataaatgagaatggaaataataataatttttcttttttttttttttttaagatggagtttcactcttgtcacccaagctggagtgcaatggatcttggctcactgcagcctctgccccccaggttcaagcaattctcttgcctcagctttctgagtagctgagtttacaagtacctgccaccacacctatttctaaaagatatttttcctcaatttaaaggaaatcacatattaaaaatttcatttccaggcaaacttaatgagaaatgtaatataatacatctcctcctggacttttcaaacattcatgacaaggaaatatagaagattgagaaggaaaatcatccaaagatattggaattagattgacacttaaactatctacactattagacactggggtatattaggtggccctcagcttgaaaagtttcagcttaaaattcttattccagcaaatatgttacatgtgttcatagtaaataggaattttgaaatacacaaaaaaggaaatttttaaaaaattctaaaaattacactaaaaaccaaaaatgataattaatacccagatttaaaaaaatatgaaatatgtattataatgcactgaaaatgagaaatttaaccataaatgtttatgtgattaccattgattgaatatactatttattaagcatttgctaagtgccatttagctaaatattttaactaaaataatatatttaatctgtaaattatttgtgtgaggtaagtcctcaccccaactattatctccatattctcactgatgatttaatgatggtaataaagtaaattgtccttgagcagaataacttgcttggttagtgtgtatgtgtttcgggtgtgggggtgcatttccatgagaaagcatataaatattgtttaaaaattaaaacaataaaattttaatctgagattaaattaaattaacaaatactgaaaaagagttgggtatgtaaacattctctattcctcattttacaaaataaagagtaataatttcccagattacataaaatataataattcatacttatgacagataaaactgttatagaatttctgaattatttacacgacagctctaaacaagtgatggaattaaagcttgttcttcacaggttcttagaatgtgactatagggagaagaaaatcagttattaaattctagatgagttacattgtggataggtcaaacatttctctcactgtagccttgcttgtctaatcatctgatcactggaaaagcagcgtttatacagtctgtaatctgtttgcttgctgtttataataatatacatattataatacattatcaattaatttcttgaaacttttgctaagcaggtacatatgacatgatcattttacttatttgaattcagaagtgtttttgttttgtgtctcttgtcccatagaaacatagcccatctcaccagaaacttgtcatctagctggagagacaacactaatacaatgtattgtcaatggacaacaaagtgcattcataaagcaatatattgttcagtgcaattagaagacaaggggtttataatctgtggttacttatagagtatacatgatgagggtaaaacacacttcaggttagcaaggctatataatgtttagggaagaatttagcagtcatgcttgaagaaagccttaagtgatagcataggtagagaggcatacagaaattattttatgaaccacctaagccaaaacaaaagtaatgtgggctagccagacttagaaatagaggatacagcacaggaaagaagagatacaaaattaagaggttattcagattgacctgaaagttgaactccaaattggaaacattttgtagttcaaatatcagttatttgactgtctatacctgtaacaagcacaatgttgaaagtgacttttatttctgtattaaaaattcagttattcctatggccaaccagaaagaaaccaaaggtcataaagaaataaaaatggcatgtgaatgaaggaagtctgtttattatagagcattacaaaaatagaagagagagaattagccaaagcaggcaccttctgcttccttaatgtcctttgggcctgtatataagtagtgaatgttaaatattctaaaacactctggaagcctgccttaccagcactgattaaaagaactgaataccaaatgtaaccaacagatttccttttcatttatctgctactgagaatactaaatattttcttatctccatcactcttagaagttctcttgcaacgtgcctatctatacatattcatcactctgacagcagaatcaagaataaaaattcagataagaaagcatgatgttcattcttttatcttttaaatatgggacacacataaaaatagatatttgaagacagcttcttagaatgaacaataaaaataactacagtgtatcctcattttaccctgttaagagtagaacaatggcacataccaatcatttggattgtggctactcataattcctcttcccctaaaagtcaaccgtgaagggcccatctataagaaatcctagatttactgcctcagggattatacttctacagatcattcctagcctactaccactcaggcagtaggaaggatgatctaaacactcaggttgaagactttggaagtcatagcaattcttgagctgaatgtctgggtgaggcttcattgtactatactcagacaaatacctcaaagacaagagataagtttaatatttgaaaaacttatttcatcattactgtatttttacactttctgttctctgaataacagcttagagaagaggattttgccccctttgcactgttgtctcatttgtcagaggccagaaagattcttttagtaatttaactatatgatgccaactaataatacgcctaaaagaggcaagaaatttcctctgcaaaacattgttttgtttaatttgggatatttttattgcaatttgtctttctgttttggttactgatattttgggaaccaaagaaacaatagttcttattattttgaggtatatatcactaaaaagaacaagctgaatcagtcaaggttttttttagccatacacgttagtctacttttcttttaaaatttatttggctattggtgatactataactgaaaaatagctaagggtatctaagggtattttttttttgagatggagtctcactctgttgcccaggctagagtgcagtggcactatctcggctcaccacaacctccgcctcccgggttcaagcgatcctcctgcctcatcctcccgagtacccaggactagaggtgcgtgtcaccacagccagctaatttttgtatttttaatagagacagggtttcactatgttggccaggctggtctcgaactcctgaccttgtgatccacccacctttgcctcccaaagtgctgggattgcaagggttagccaccacgcccaggagtacttttaaagaaacaaagtaggtaaacataaatgcaaatcagttattttttatttaactttcaattttattttactatagtcaattagaaacatgcattgaaagtataatcataaagcattcacatctaattttgcctccttcaaaaactagagtagaaacagctgagatacacgagtttgaaaagattccaaattctatccagctgttgacttttctgaaagttctggtgagaatataagaatgaaaacatgactgaaataaggaactacaatgcttctttcttgatttattccctagattaaggtgcaactgaatttcccagcggaaaaaaaaaaaatagcttagctccatgaactagatttttacttgtaatatgaatgccaagtcatgccaataagatgtttttttaaaaaatgtttcttctccttaagttttcctaaaatccagggccttgaagattgacatttacttttcagattttaatatttctgcactttcttccttccttttagcaaccactcaggcagaacaacattggttacaagagtctcttcaaagagaaaagagccacaaataagtgaattggcatatccaaatgctttcgttgttaaatgcaatattttcccctaataatatacaaagtaaaaaaaacaatgtttctaatattaaaatctcaggtaataagttaattcaatttaatattaggtgcttttatgtgactccaataagcaattacatattgagaataaagagccatacacatatattttaaaaagaactctttcagggtcttactataacccaaattcagattttaggttttatgtttttccaaatattgattacttcatactttcccatggtcttgctcctgtggctgttggatttggataaatgtttctacatgagttacattctgtgtatgaattgctgcatgacagttgccacataatacgttggcaagaaagtctttgttggatggcaaataaattaagcaaaacaaacatttgcattctgcttcaaacaattaatactgtacttgaataaaccagcaaatagtggacatctctatacaagtgggttttcaataaagggaaagaacaatcacaacgtaattgcaacatatcgatgatagttgtaacttgaattcaaaaatcaacactctacttatgattctcttttgagatacagctcttagtttgtaaaccgttgacatgaaattttaaacatatacttgaatattaaataaaacataacataccttatttgcaggtctttggaatggtatttcgaaacatgacaatgcaaattcctgtaaataaaaagaacttattcagtcaaaggcattttctaatttgaattgaaacaacaattatgtattatttaaaagaaaactatttgttaactactaagtatttctttataacttctggtgtttacatattttgtagcttgttttatatgttcttacagccagaaacaaatgtaatatatgtgtgtaccattagaaatgtgctaattctacttaaattttgtattcacaaaatgttttatctttaagtgcttttagattcagatattagatcattttggaaactaatttttcaaatttcacaagcaatatggaaataatgcataaggcatattgtgtttggatttgatatgctagatattttacctaaaactgagcaataaatataactgaatatatttgatgattacacctgggtattaaaacagcttatgaaaaaatccttctttctgtataatatagtttggatatcccctccaaatctcatgttgagacgtaatctccagtgttagaggtggggcctgatgggaggtatttgagtcatgagggcagatccctcatggcctggtgctgtcctggtgactgtgagttctcacgatgtctggttgtttaaaagtgtgtgaggcctcctcagaagcagatgctggcacaatgcttcctgtacagactgcagaaccatgagccaattaaacctcttttcttaaaaattagccagtctcaggtatttctttatagcaatgcaagaacaacctaacacatagtacatatatttaatatgttcatttatttaaaaatggaagaatgatatatttcacactgtaatattttgaagaatatcataataaagttttggataaaataatacaataataaactagggttattttcatatcttgaaaaaactataatttattatgttggctttgagacaagatatctaagttaatatttaagagaagataattaaggaatattccaggatgataatcacactatattttatttatatttcccagatttttcagcaactctttctctcaataagataaagatataatccattgtatcatttttctagccaataaatacctagttaagtacttactggaatactgaattttctatccaataaatacctagttcagtattgttctaatgagtatttatttactccctggaatgaggcagactcctatgaaagcactttcctttttaaaatgtagtcccaaggaaaacagtacaagaaacattttgaatcctgaatatatagataacatgtagcatgaaagattctagttctaaccatagtttcagtatatcatgtccatttaaaaaatacaaaactggtaaattaaaagagtagatgtatatttgttaatgctaagtgttttactacaaaagcgaaatcatatatggtacaataagagacaaaggtacaaaatcatagaaggggaaggaaacttggagatcatggagactgaactccatttttctgcaagatagagtcttgcttaagtcatgcagcacattcataacaagcctggaattggaagctatcataaaagtaacgattgccatttaaaaaaagtattattacacgaaaagaaattcagctgtatgaagttcctgtaaataattcacttgctggacgtagagtatttatttgtggaaattagatgaatataaagtggatctaagttatatcctaatacatgaagatgatgcaaataactgatgctgaaatagtttatccttaaggtattttttagttctttaatttttatcttaatatttcaaattttattatttatcacaaggatacaaaagcaaatatctatttaaatggtgctagctttctttttcagctgtttctaagagtgagaaaataaatttataaagtttataaattatcacaggaatggttttatttttacttcatgatcatgattaaagataattcccctcccctcccctcccctccccttcccttccgtaattttcttttctgttttttgagacggagtctcaccctgtggcccaggctggagtgcaaaggtgcgatcttggctcactgtaacccccgcctcccgggttcaagcaattctcctgcctcagcctcccaggtagctgggactacaggtgcccaccaccaggcctggctaattttttgtatttttagtagagatgggtttcaccgtattagctaggatggtctcgaacttctgacgttgtgatccgtccacctcggcctcccaaagtgctaggattataagcatgagccaccgtgcccgaccaaagattatatctttctatttgtattactcttataactttctaacaaaggaatgacatatttttcaaatatgtatttcagtagaaaataatttttagagttgcttaaaatttgctgtgcattccaataataaagtgctttaaaaaaaaagacatttaatcaaagcctccctaaaatgtttctcaattgtaacaattagtattctttatctgcctatgcaattaactgtaagaaaaaaaattaaaacatatacacccacaaaagattgactgtgttgttgtcactaattgtttaaatattttacttacttatttaaggcatgttcaaacttattgatcactatataccaggtgtatctgccatcttcctagacaactggaatatatcagtaaacacatttttaaaagtcttttacttcggcacttacttggcagcaatacccaggaaataaacaatgtgcaacacaaataaaacaagtaaattatatataatattcgaacgtgataattttaaggggaaaattgtcagtgtaaaaaaaagaaggttgtgagtaaggtggctgaaacttataatatttaataaacagggcagattgaaggagatttgagcaaagtcttaaataatccttgttgattttatctaaagtttaggataaagtttgttagtatttagttaaggtggtaactgaataaatgataaaagttaaacttgtttgcatttcaaaaggaagaaattaatttcaatccattacttttacaaataaaaattgcattctacagatttattcaggaatgcctttgacattaaaagcattgctatgatttggttttttaacacaaacatcaccaagatatattccaatttgcttaaacaaaaagtttatatatgacaatgtataaatggcaacaataccttgttctagatatgaatttcactactgaataggagcatagtgtggaaattaaccttcagcgacccagtttatgtctcagtttcaatgtagtaaacttgtcacaaaatgtttcagtttcagaataagcaagccaagctaccaaaaagctctcccctttatcttgtaattagagtattatgatagtattggtcaacaggcaatgttcagattgctttaggaattaattattaaaagatgcagcactagattttcacatttagggtatcatttgtgctctagaccttgtgataacaataaccaagtgaatattaaaatagaacaaagcagccaggtgtggtggctcgtgcctgcaatcccaacattttggaaggccgaggcaggtgtatcacttgagctcagaagttaaacagcctgggcaacaaagtaagacccccctccaccatctctacaaaaaattagcctggtgtggtggcgtctgtatgccagatactcaggagcctgaggtggaaggatcacttgagcctgggaagtggaggttgcagtgagctgaatgatagagtgagaccctgtctcaaaaataaataaatgaataaaataaaataggacaaagctagtgcattaaggttacagttttctggaactgcttaattggtacaattttattgcagaacctcatcaaccagtgtcaagtctctatgaaatatatgtaatattgctttcgaatgtagattttggtgtttataagacacagataattttatcatctggtggcaatatacatgctaataatgtgatttattcatgaatttgccttatattttagcaactgacatacacacatatatttatttcatgaccacattattttagagatttactcctaccttaaataaatgtcatttttttctaacatgtagtcaatgtaatttacctggcacctacacagatagtctcatgtagtccttacatgactcatattataatccattacttctatagaaaaacctcactgaaaatgacttgataatgcttgtgaatatatagttaagatccctattgcctcttttaataaatcagtttgagcaaataaaagtgaaatatttgtagtcatttatttcaaaagttctaggaataaatcctatacaatgtatttgggagataacctaattattatggaatgcattaatttcttctcatcagaaaatcataattttataactgtgcatctgaaggtcttctatatatatatttattaagcaaatttaccaaatattcatattgatacattccattcaaatgatttttttttgcaatgttacaggacccgttcttccaaaagctcatgaaatcacagcttcaaattcaccagtagtttaatgtaactgaaacaagcaaacaaacaaatgactgtctcatttatattcaaagaatgaattttattttatatcttgatattaagttgttggacttaatcaataagctctatacctactttcatatattatcatgtcagataaaaaacaaatgtggatgcacgtgtcactatcctatttgaaagagctgatacaccactgatactgtttggttttgtgtccccacccaaatctcatgttgagttgtaatcctcaatgctgggggaggaggctggtgggagatgattggattatggggtcagatttctcccttgtcattctcgtgataatgatttctcaggagatctggttgttggaaagtgtgtagcacatccccctttggtccctctctcttctgtcaccatattaagagatgcttgcttccccttgccattctgccatgactgtaagtttcctgaggcttcctcagccatgctttctgtacagcctgtggaactgtgagtcaattaaacctcttctctttataaattacccagtttcgggtagttctttatagcagtgtgcaaacagactaatataacaacaaaccagaagatatgtcatttctgggcgaaatatcagtgcccttactgaggatgtatatttgctctctcccccaaatggttgtaatctgctctagataaataaattcatggaatgtttgtaccttggttgcatcttctcattagctatttatttcagtcatttgagagggagggaaagagcatgggctttaaagacagccatagataggcagttttgtgctgcaatttcagcagtcactgtacttgggcaagctgcttcatctcctcgggttacaggtttttctttcctaattagggggattatcatcacaatgtatataatatggaacctagcctgtttaacaagtaatggcttttatccttgatttttcaaattagactttgttctttaggtggccaaatatatatgagtattttcattgcccttcctttactcaaatgcagaaaagagtgtccttcataaagatgacggttggaggtatgaaggaggaaacagactaggtacgaaagaaaagaagggataccaagccaataacatcaacactacagtgttcgtttggatgggaagtggctacatcactaaacaattgaatatatggcttttttgaacatacaatttcaaattttattatattctatgtgtttaaaatagtcttagcaaagcattactcattacctttaaagtaagttgaagctatcatttaattcacaggttaagaaagtataccaaattcattttgaagaccattcagacttccaaagtataatagctaagaatatgatgatcactttgttccccattagaatgttcccctgtataggtcacatataatattgtaactacaaaaacaaaatgaaatctgaaaaataaaatagaaataagaaactaaacctattttttgccatgttttttttttgggaaaaagtattttatgaagcattaaagagcagtaagtataattaaactgtaatccagtattagaaacaatctaataatagtccaattcaaaaataaaaattattgtaggtatgaccatgaaatttcctgacacctgatttaatgcattgtgctaattttctaaaacaactcagaggaaccaaatcattttttccacaaacacactattctgtatgtcttcattttattgcagtgtttcaatagttatttaaatggtagagttcatttgtcaagtgaatatgaagagcgtagttccctcccacaacaataaaactacaggctgccaagtcaagatgtataattggtaatgctgagccatttattctgagtgcactctagacaatgacatattattactattatggcacaaataactgcctttttgaagcaaatgttttcactggctttagttaggatgctgtcctattccttttaacataatactgatgccctcagtattattttatatatgtcaatgaaacaatatcatgctgtgaaatttatgataaaagcaaaactaaaaatcattggttgatttttgtttccccctctcttccttttaacttcagctttgcaaaatcactatgtattctgctgtggaagtataattaatgttattttcttcttattactatattttaactttgcatcttaagcctaaattttagcctattcatgtaaggttgtactttaaacaatacctccaatagattttcatactccatctaactatacaaagagaagagactatctagttacaatttatgtatttgattgtggtagcttatgcctaccctaaatattttccctcctaggtcaacctggtttgggttcaattatatgatgattaaaaaaaaaatctcaggttggaacaaaatctatataataagatgacaaaatactttcataactatttcagttatagcttctactaagttgcatttacaatgatatatttacataacagcataatggatagaaatataaagagagagaccttttgtctctctgtgccatcagaatgaaccatgacatttaggtgccttgaggaaagactagaaataaactaccaatcaggcaaatgaacaaacaaaaacagaataatttctttcctagctgccccacactttatcacatcacttcagtatgccccacttccttaactctaatcaatttccatgtgccatttgaggtaccacagctcactctcagaaggtcaagaggtaaagtgtggagaaaagggaagaaggtgggtataaattaaaaaaaacaaaaaggacaaagataaaatacaagataaattaaaattatatttttaaattagcttttgttccttgagcatctgctatgtatcaggcattctctattacctattttcgttctggccacacaactacactatgaagcagatatgactgtaccactttcaaattcatataagaaaaccaatgttcagagaagttgtctgaggtcccacacctaataaataaatgacagagcaaggatttggcctcaaagtccagattctttcctcagttgcacagtgccacattataaatgtgttgatacactgaaatagaagaataatatcaaaagtatttctttttattttctctcaacagggattaataataataattatgtcagaacttgggcacaggctttaatccttaaaattcttttaatcattattttatcatcataagcacatacaagcaacactgtatttatttcgctgaaatgtataaaatcctggcatagccaatgaatttgtttgataaattatgagataaattcagctaatggagtttccaagcatgctgtcaaagaaatagaatcatgcatttatgaatttttccatatttttcttcatttctaatgcaactagttaattatttgatctctttatcactttaaaagctttgtaatagttcagatgatgtgagattatttgcaaacaagataagaaatgccagttcctgggacagttataggaagcctgagaaggtaaggcttttcaaggaaactaggtcgtgaaagagaatattgctataatccttagaaagctggatagagttgtcttttccaatattaatatgaggctcaatagttccatatggacaagaacaggggttgagatctctgagtcatgcagaactcttctgtcaaaacagaacagttgcagatgtgtcatgaatacaaaaatttctccctcttaacatttccttttcaataggataagccacttttaatgcagcagattaaccgatttactttctaaatatgctcagatttactttctaaatatactcagattaagttaaattggttaatctcatttggccttacatctggtaacaatgtacaattcaaaggtttacataaagggaactctttagtaaagacaaaggaggaaaaggcaaaatctttctctcaccctaaggtcagagtgagcttccttcaggcattaaactgctgaagaactgcatctaagcaacaagggagataaatcaaaaggggctggttcagaaatttcctaggtagaaaagaatccaacatccaatttgtaaattgatacttccagaatattatccacatcattgaaagtctgcacaagaatcattagcagtggaggacccagatgactattctctctgaatattctctttcaaatacaacagtctttaaaatacaactcagaaatcgattagattatttttttattttctttctactttaatttaaattgcaacaatttaaatatattttcaatccagaactgttaataattttaccaagctcacattaaaataaaaaataaattccaaaataaatgcattcatatgtacatacaatttgatgattttaaattttattttgttctctctatgtttaatttcataatttaaactccaggatttatttgaggattgtttgaaataatgtaggcagaacaattagctcagtgctaggctcttaactaattgccaggggtaatattcctccaacatctccgtgtcagtttgcttgagaaataacctggaggagagagagtgcccaacattttgcaaattcaaaaggtaagagaggttcatttataaaggtacatcctagtatataagacagcaagtacataggaatccatgactgtatgttgaatattgttatcagatatgctaagaaatgtttaaaatcccaccatcagtgtctccctaggaatttctgttttctcataagattattaggtcttaacatgcaggcatcatgttaacatgcagaaatcacattaccctaataattgctgtctcctcagatcctggcacactgtctggaaaacaggaagtatccagtaaaagtgagtttaattacaatatattggccacaaacctaatggatccatgttttctgctttttgtatgtgcaccatcactctgcattttcttttcttggcagaagtcacagagaaaaggaaagagatgattcctttccatgagtgtatattggtaggtcattgatgactcagctataattcaaatgtatatatttctctggggaaaacaggttgtaattactaaacaagaaagcaaaattaatgacactaataaatatatgacacactaaatatattccaggtatgcttctaacagactaactgaaaaatatctgatttttacccaatataattatgcatgtatttcttcttttttatattctccaaaatgtattgagaagaaactgaatcagaaaacaacccttcctctggatacactataaatcccccctgcaagcactacagcatttttactgttgacaattatttcttccacaatgcagtgtcatgtgatgaagacgtcacatactgaacttagtatttatccagtctttagctgtgttttcactgtatgctctcttggtctctgccctttgattcacgtgaatcctcattattgttctggttgttgctattgtcattgttaaggccccctgggaacactcattcctataaatacaatgttctccaaaaaaatatgaaatttatcctctttgctccccaaattgtcccttaaatagtttatgtctgtaagcacaataataaaccaatgaggtatatgtgtgatattgcaatattgtgatctagggataattattttctgtactgcaacccttttaaattcctaatgatataattgaaaataattttaagaaatttgtatagatacaccataccctatgaaagctggtctttctcaataaaagactggacaaccctaaggtaggcctaagaagtcaagaaccctggcccctctttctgaagaagtatgctgttacattgctgggatattcagacagaatattctgctgggagaaacccaatccagaacttttcagaaacacacaggctacagagacattgttatgggatcctcagggtgtcacttcaccagctggaaacctctgtggccagtggtgcctttgcctgagttttgctctggcccactgggctggttctgataactcagcctggcaggctgtgctcaactctgctacatgcttggatcccatgcctgccgagggtgagcctggcccagagtggcaaggggtgtatgagtgggcatggggttcagttatagtgcatagccaggcacactggctgcggcatggcaggcaactccaggtgctggcacagtcaccagctccctgagagactgtggttggacaaggcgtaccataaccagcttctacaggtgatagtggggtttgcagtgtggtgccagaaacttggagacaccaggaactgcagagccctaaataggctgtcacagccctggcctggggagcttctaggtctggggccccacaaggccacagctcttacctcctctcatccctcctttttgtcacctgcaacatggcaggcaacaggcaagtttccgcccatatcgtgttacagttacagctcttttagctctaacatttgccttgtccagagttcttgtcctgcatccaggaagaaagaggtgtgcagacaagtggagctttattgagcagtagaacagctcagaggagacccgcagtgggcaaatcatttctgtaaacggtgtcctggagagtgttcagctctcagcagagagggtagctcttctccattaggtcatcccaatgggtgttcagctctcagcagagagggtagctcctttccgttaggcaggtcatcccaatatgtgttcagctctcaggggagagggtagctcctccctgttaggcaggtcatcccgatgaatgctcagctctcagcagagagggtagctccttgttgcagctggtcatcctgtcatctcttcagctctcagcagaaagggtaacttctctctgctaggcaggtcatcccgacgagtgtccagctttcagcagagagggtagtttctctctgcagctggttgttccatcatctccttgagcctggctgagcccagggcttttgtgggcttccaaaaggagaaaatgtgtgctgattggtctatgtgctgtcatgggtgggcccagaaaaggcaccacgagttctcactccagtctgcgggacacaaagcccagtccccaggcttcaggccttccctggcttgaaggtggggcttcaccaagaccccatcttcctctgagaagcctgatagcctcctgcctctgttcatggagcccaggttattaatgccaaggggtgcctgcaggccagtgcagagctttccttagcccctgtctcagcctccctcccaggcttgtttgcacccaaagtctcgaggaggccaaggtagcatggggctggtgtatcagcactgcctcgagcatgtgcacccctggacaggttgtgacaacacctaggactggcctcatctttgctccctgattgagcaggcccaactgtggggagaagccagacagtgtgagcagtcacttctgagcctgcggtgacagggaggcattcctgggccctcagagtgcaaagattccctggcccatagctgcagcttgggcagctgcagctgtgcctaggagggtggggctcctgcctgctcccagctcccagagcacaggggtgtctgggtcacagcagctgcttgggcagctgcagttgctcctggggagcagacactggctctgtggagcgcagcaccacctcggacctgctccacttgggggcccttctctgctccagcctttatgctggaacaaactgctccctgatgatcaggtgactcagccaggcccctcacgatggctcccagggaggtggtctccaggggggtctcaggggaaggctctggggactgtccttctcttctccccgttttcctggtggtgccttcagctgggtgctttcaggctaccaaaatacagcggggagcaaagttgaggccatggcaaagaccccaggcctgggagaagtcctgcccatctgtgcgagggtggaggtggcatagttagctgcttcagggatgtgggacacaggggtcccactgccaccactgctgctcccacagttgctcctgctgccatcactgacacctccccactgcagctggctggatggcagcacctgctccagatagcctgtggcggccatcaataccaccaataccttcttctgtcatcaaggtacaatctcccctgcaccaagtggggagagttatatattcctgagcaaaaaactccattcactcttcatttactcaagttctgaaggtaaagataaaccggaattacaagcatatttttttccttatatttgagtgtctatgttatctgtttaatggactgctttgtttaaaaagagatattttcttagtctcaccacagaaaataacaaataacattttgattagattaagatagatgtcatcattggaaatctaggcctaaccctgaggattgagaatggtatatgatccacttcctttctgtgcacaatatattaatccccatcagatcacctaactacaatgaaaatttgcctgactaccccttcattttaccaaaattctattgataatacctactccaacattttcaactgatttttatcctttgtatgcagaataaggtatgcaaaacaataggtttttgttaaattttcattcagaaaatcagtgaactattaactatttgttgaataaataaataaatgaacaaacaagtaacaaaccagtatcagcagagattggatccaatattgtatctcaataaaatgggactgcatcatgtggtcagggttcaccagacttcacagtgcagaggcaattgagatgggacagtggaaaccataattattacagggtgaatcagcgtagtaaaaataaaggaaacaaagacatgttggagatgagattagtgctcaggtatcagggaaagatggttgacaagaatggaatgaaaatagtttcataatctggaaaggatgaagtgaaatatccgccctagtacctaatttttaagactttgagtttcactcttagtttttctggcagccatattctgaggcagataacacaggtcttcagatgcagatcacacaggtcttcagatacagtttcaccggttaagctcagatttcatagaaggagttcatttcttactaggattactttgcaggggaagagacatatttaacaaatctaaacctccattagccttgtatcaattggtacaaatttttgttataagttttagaaatcctaaaattatactgatttaaggaaattaattggtggatataaatgaaaagtttagacatgcttagatatacaggttcaaagaatgataacagacataagacaataaactatttttaataatctatatgatgggtataaaatacaataaatgaatgataaaaagagcacagtacctagagaaacacacactcaactttactctttttaactttttgccaaatgttttcagattttgctctgttaggcattgatatgatttggctttgagtccctacctaaatctcatattgaattgtaatccccaggtgtcaagggagggaccaggtggaaagtgactggatcttggggtcggtttcttccatgctgttctcctgatagtgagagagctctcatgagatctggttggttgataagtgtctggcagtttcccttgcactctgtctctcttgccaccttgttacgatgtgccttgtttcccttcaccttctgtcatgattataagtttcctgaggcctcccagccatgcagaactgtgagtcaattaaacctcttttcttcataaataacccagtctcaagtagtatctttatagcagtgtagaaaagaactaatacaaacatccattggtctttaactgtagcaaaccacattcatcattattattatttctattggtgtagatatggagaaatgacatgatttatgaatagtaggtttgaataacattaactttcttacatttttattctagacttgttgattctgttttgtgtgtcataatacagtgagtaccattccatagtagacaaattttgaatattttcatatatatatttataaataaatgctaattcagttaagtttaataagtatttaccagtaatatgaaattaaaaattttatatggctttaggaagatactagatatagtttggctccttgttcctacccaaatctcatgttaaattgtaatttccagtgttggagggccttggtgcaaggtgactgggtcatggagcagatttgcccttgctgttctcatgacagtgaatgagttcttataccagctgcttgtttaaagggtggcaacttcccctgctctctcctgctccacgaggtgaagatatgcctgcttccacttttgccttccaccatgattgtaagtttcttaagacctcaccatctatgctacctgcacagcctgcaaaattatgagccatttaatcctcttttcttcataaattatccagtggggactcaggaagttcattatagcaatgtgagaacagactagtccagaaattggtaccagagaagtagtacatcactataaggatacctgaaaatatgaaagtgactttggaattgggtaatgggcaaggttgaaacagtttggagggctcagaaaaagacagaaagatgagggaaagtttggaacttcctagagaattgttaaattgttgtgaccaaaatgctgaatggaatatgaaaaatgaagtctcagctgagggggtctcaaatgtaaatgaggaacttactgggaactggagtaaaagtctctcttaccaggcttagaaaagagactgttggcattgtgcctctgctcaagatgtgacctggctgcttctgaaagcctacactcatctgcataaacaaagaaatgacctgaaattggaacttatatgtaaaaagaaagcagagcataaaagttgaaaaatttaccgcctagccatgtgatagaaaagaaaaacccattttctggggatgaaccctttaagctagctgcagaaatttacataagtaaagaggagcctaatggtagtagccaagacaatggggaaaatgcctcaaaagcttttcagagaacttgtggcagcccctcccatcacaggccctgaggtttaagagaaaaccatggttttgtgggccaggcccatgacccttctcctctgggcagcctcacgacatagcaccctgcatcgcagccactccaggtccagccatcagaaggtgcaagccccaagcattggcagcttccatatgtgtgcagagggcaagacttgagtcttgggagcctctgcccaaatttcacaggatgtatgaaaacacctggatgtccaggcagaagaatgtggaaggggcagagccctcatggagaacctctactagggtagtgcaaaggggaaatatgtggttggagccacacacagagttcacattggtgcactgcttggtgaagctgtgagaagagggccatagtcctaaagattccagaatggtagatccgtcaacatcttgcaccaagtgcttggaaaagccgcaggcactcaatgtccacctgtgaaaccagctgtgggtgatctaccctgcagagccacaaggacagagctgcccaattccttgggagcccaccccttgcatcagtgtgtcctggatatgagagatagagtcaaaaaatattattttggagctttgagatttaatgacttccctgctgggttttgcatggggcctgtagcccctttgttttagccaatttctcacttttgaaatgggaacatttacccagtgcctgtacccccactgtatcttagaactaactatcttgtttttgattatacaggctcacaggcagtagggggttgccttgtctcatatgagactttagactgtgaacttttgagtttgtgccaaaaggctttaagattttcagggactgtttgaaaggcataattgtgttttgaaatgtgagaagggtgtgagattttagagaggccagggacagcatgatatgatttggctctgttttcccattcaaatctcatgttgaatttcaattctcagtgtttgaggaggggcatggtgggaagtgattggatcgggagggcagatttctctttgttgttctcatgatagggagtgagttatcatgagatttcattgtttaaaagggtgtggcaccttcctgtttgctctctctttttcctgctccagtgatgtagaatgtgtcagtttccccttcaccttctgcaatgattgtaagttttgcaatgatgggccagtttgaaattatttatgtcaaaatgacataaataaaaattgttttaatccctatttcagtcagtcatggtaaaacttcatctgagattttcctaattgttacatacaatcaagatcaaagttactggttttccatggaaactcaaaacatatggaatagggggccttatgctggaaactttaatcttgcgccttagttttccactctggacactaagcaatgtattaaacctcctctcaaatcctcattcctttgaaaaatgacaataactgagcccacttcataggttcatgctgaaaacagcattagataatctacataaggcttctactaagaaattcatagaatactcagcttttcctaaattagttgggataaccaaaacccttcaaatctcagtggtgtgtggctacaaagatttgcttgacattcatattatttgctcacagatggtaagtgtcgtcctcactcaaggacatgccattatccttatctgggacatgccattctcatggcagagcagaaaaagcaaagatacaatcttatgatgggttacttctttgtggcatatgccactttttaccctgtatcactggtgaaacctagacatttagacatacgatacaggtctaatcatcaaattatacaaaacaaaacagtcatagtatctaccgcaatgatcaattacttattatcattgttattgctaagaagcactatgtacataaaagaacgatcaagatgtttaccattctggaactcatggaatatatggaataaattagagtgctgtcatgaactttgtgtctaagatctgatgatatgtgtgccacatgctacttgaaggttgaccagtacaatctctacaacagaagattgaacccactacaaagcttcattttttagtcaagatattaagtaagtgaatatcagatattaatgatgctaatatgccttagaaaaaaatcctcaaaattatttggaatataggagtccatgagatagaagagggctttcatagctatgaatgttacatgaaactctgaagtgttctcctggggatgaagaaataatgcactctttgattattcatgctctacatataaaattagaattcataacatgtaaaatagaggcctctggaaaaatttccatcttgataggggtgactgataggtgtgcacagtagctagggtttacataaagtgttagtactgaaataatatacagaacatgtgtaatttgaataagttttgaaaatcaagtatatttcaaggacaggccacttccaaattgagcaggaaaccttcctccttaagctgaagttttctgtattaagaatatttcattcccattctgtaagattctaaataattattcaaagtacaagaatttgtatccattaaatatcttgagattacctatttatttatttattttgagatggagtctcactctgttgtccaggctggagtgcagtggcatgatcttggctcactgcaacctccacctcctgggttcaagcgattctcctgcctcagcctcccaagtagctcagctcacaggcacctgcaaccgtgcctggctaatttttgtatttttagtagggatgggtttcaccattttggtcaggctggtctcgaactcctgaccacccacctcagcctcccaaagtgctgggattacaggcaagtagctcagcttacgggcacctgcaaccatgcctggctaatttttctatttttagtagggatgggtttcaccatattggtcaggctggtctcgaactcctgaccacccacctcagcctcccaaagtgctgggattacaggcatgagccatcacacctggctgacattacctaattttatttacctgaaaatatttgttgtctccccaaggtgcatatataggaagtcactacagagttttgacactatcagctttctctttttagtgaaacttaaatgtgttaggtgactagagcaaaaggagagctctagttcatatgtattatatggatatggcataatatcattcctcatctggtatctgtctgaatagccacatctatcaaatctattgtttgctctaagtataaaaccagcttaatggggtgatttgtttaaaacaaaacatttttaaagtttctattttttaaagctgtgtattatgagcagaaaaatcattttccatcctatggcatatatttcagaagaactttcttatattctaaggagcaaaagccatcattacacatctcacaatccgatatcaccttttatatctatctccccacctccaaagatgtaattgatttttaaactccatttataaaaattaagctggtattttccaaattgtaagattaaaattggtaatatttgacttgaatacagagtgccatgaccgctgattcttgctatttctagcaacagggaaaggggaggatttttgggattttttgcaagtgatgagaatggtagatggcttgcatcttggtatgtagtgcttactgtcacataggagagtcccagcagaaagatgaccatgtatgcaggacataatacacagaaaacaagaaagagtacgggtagagtgagctcttttttcatcaggaaattagaaatttagaagacatgctgcagatggaagagtgttgaatagcattggttagaaacaatgcctatggtactggacaagagtaatatattagttggaccataaatacgtaaaatgcatttggctagaacatatgtattgtataatcaaagacttagatttgtgtggtgggtaatattttctgtgtttagtagacatgaaatttatcaatttagaagatttagccaatagcctttttgtcagaaaaataagaagagccctagaggagactctatatccctaaaaccagataacttaattgtgcaaagaacgtagctgatgtctgaacaaacaggcaaacatttctgctaagaacagaatagtgaggacatcctgtcattgctagatgacttcaataagggactccttccttaccaccagtattgtgaagatgacaataaaccatattcaaatacagtacatcataatacaacattgaactcatttattgcctgtgctatgattaccatccctgtactttgcacgtctaacttaagcccatatagagcatacaactcaagtgaaacagcttctgggaaggctagaaactatgctctgtgacttgaatactcaatgcaaccaagcctgcctctaaagaacaagggcatcaaaacctgatgtgaagaatgaagactagaggtggtctccagaaatttttagataatttaaattcaagttccttttggataccataaaaatggggaaggttctctgtgaatgtaactgaatctgtgtttccttgacaaatttgtgcactaaggcatattcaaatggtttaaaaaataaaagaaggagatatatttttactcatatatgttggtggaggatatcaatactaattatctcagtacacatttctatgaggtcagttacatatgtatgactttttttgtaaactgatatttaaaatttctctcacttacgatagtgattttctccctgattttattcaaagcttttctccctctccatactttaagtttctcatgaattccttatttatgttaaacacatcataacccaaacaatagctatgcaaaatgcatttttttcttgcttttctagcttgttaaggcctttattttgagaaattatgaccatacgcttctattaattttgcttcaacttttccagccttttcaactacctttgattggaggatgatgaaattacattactctgaaattaaacagaaaaatcagatatgacaagtcccttcttggataggttgtattatatgaagaacaagaagttatagaaaaaaaaatgagcatagtcaaattataggatttgttttttggtttcttaaaaagcaccttataacggagagtaattctcatttaaaaaaatactgttccgtggaattatagaatgttaaatagactaaactagaatatctgggccaacactctcatttaagagatgagataactttgtctcagaaaaaggagcagtgcctttgtgaaacacatggctaatttgtggcagcactaacatgaaaacttcagtttcctgattacacactgtcattaatatggtaattgcactaacaccagcatgagccatattaaacatatgcttctaattgcatgtagctacactgtttccttatatcccaatattactcttttttaataaaaagtcaaaacaaataaaaatacttgtatgtgtaagtctatagaaagtatatattgttctccttagcagtcaccttttcaaatacagatgctcctcaacttatgatgggtttatgtccatataaacctaatttaagttaaaaatatcttaagtgaaaaatgtatttaatatgctgaatacaccaaacatcataagtgagcctaacataccttaaacatgagcagaacatttggattagactggctgggtgggagctgcaacttgccagagtatcatattgcgtatcactcatttaggaaaagatcacaattcaaaaatttaagtgtagtttatattaaatgctgttgctttctcaccatcgtaaagtaaaaaaattgtaagttggactatgataagttggagactgtctgcataattgtttcagtgttaatcgtttgttgtcttttacacattcatgttccttgaatactctttttttggattccattcctgaacttattagcttcaatgtataaatcagacatgtgatattatttaagcatcccttgtgtagtcatagtttccctacaatatatgatttctgttctcattttataggtaggaacattatatagggcaagatcaacaactatccttgagcctcatctaaccagcaaaagggataatgtttgctcaatctctattagcctgaaagaatttcacccacgttttgtacttgatttactttcagctgttctttaggaacaatttcaagccatagtgcctttaagatacttcctctgaaccccaaaatataaagccacacatataatatctctctatgcatcccagagtaactcacatgtatctcctttgcttcggatacattacccttactgtacagttctctatttaatttttggtgtttttctgtttctgttttgttttgatttatagtaaatactaaacaaatgcttgctgaatggcttggccataactttgactttagactgcaggacttgtctacatttctcctcttgcattgtcctccaaccataggtaacccaacagatttgagtttaaacattactttcatatgaaatatgaactacgattttcttccagaaaaccaagcaacattgcaaatcttatacaaccttcccatttgaggataccactgaaatgctcataaattctatgaggtttgggaaaaaaaaaaggctctgtaacatttgagaattcattctgcttcttgtcatcactgggactattttcacctttgtctttcctaagtggaactgtagccctcattcttcagaagcataacaagggggacatgtatttattcttccatctaatacatgattaataatgatctatactcctctcgttttgagttgaataatttacgtatccatactttttaatattctctatgttcgttccaatttttaaaccattcattacttcagaaagacgcgacaatgaaaaacaaaaatttctcggccgggagcggtggctcacgcctgtaatcccagcactttgggaggccgaggcgggcagatcactaggtcaggagatcgagaccatcgtggctaacacggtgaaaccccgtctctactaaaattgcaaaaaattagccgggcatggtggcgggcacctgtagtcccagctactcgggagatgaggcaggataatggcttgaacccgggaggcggagcttgcagtgagccgagatcgcgccactgcactccagcctggacgacagagcaagactgtgtctcaaaaaaaaaaaaaaaaaaaaaaaaaaatctccagtgtgtgtatatattaggcgatcaggacatgtgtgactgtggcattcctaagaagcattttatacaaattagcatgagccttagtcttctcaaagtaattattccctgaatacttttatttttcaaccatagaaaccaatttattgaacccgcagaatacacaaagccttcactaacaagtgtgaattgagaattgtgaatttctactttggaaacaagtttgatgaataagaatcatagagtaaacacagtgtttctatcatcttttagtaattatgcagttgtaccagaatggaatatacacaactattttccaaacaagaggcagttgaaaactgccaaaagatttgaggcttcatcttggctttgtaaatgtaatgatgaattattttgatatagtaacccacagtctattgactgatgaccatcatatcattaggaataataaaaaagtgccttaaaatcatactgcctgccaatgaagccccattcttctcatgagtgggtctgtggcatttcctcttctgttatgatcctcatttcatgtgcatgtattataaactttattagaactgatggtacaaatgatgccctctttcacacttctaagatgtggtaaaagactcttatccataacctagaagagttaaattcttgcatcttaccaatctcaattttccatgctatttagagttgaatttttcaacattatatagaggcttgtccaaatttcatactttttgcttaactttatctttgcttcctgattctattgcctcaatatataccctcacgaacttttattatttttatttttatttatttttttttactttttaacttttaagttcaggggtacatgtgaaggtttgttgtatagataaactcatgtcccaagggtttgttgtacagattattttgtcactcaggtattaagcctagtagacattagttatttttttctggtgctctccctcctcctttcctcctttctctggtaggaccaagtgtctgttgttcccctctatgtgtccatgtgttctcaacatttagttcccacttataagtgagaacatatagtatttgtttgtctgttactgccctagtttgctaaagataatcacctctagctccatccatgttctgataaaagacttgatctcactctttttatggctgcatagtattccataatgtttatgtaccacatttttttcattcagtctaacactgtattagtccactctagaactggcataaaaaaactacctctgactgggtaatttctaaagaaaatagttttagttgatgcaaagttccgcaggctgtacaggtagcatctctggggaggcctcgggaaacttacaaccattgcagaaggcaaaagggaggcaagcacctctcctgctccatggtggagcagaagagaaagggagtgaagagggaagtgcaaaacactttcaaacaatcagatcttgtgaaaactcactcactatcatgagatgagcaagaagaaaatcctaacccatgattcaattgcctcccagcaggctccgcctccaacacacaggtattacaattcaacatgagatttgggtgggaaaacagagccaaacaatatcattccaccttggtccttcccaagtctcatgtccttctcatttttaaatcatgaccatgccttttcaacagtcccccaaagtcttgactcattacagcattaagtcaaaagtccaagcccaaaatctgatcagaggcaaggcaaatcccttccacttatgggcctgtaaaattcaaaacaagttagctatttccaagttaaaatgtgggtacaggcattgggtaaatgctcctattccaaaagagagaaattggccaaaacaagggagctataggccctatgcaattccaaacccagccgggcagtcattaaatctcaaagcttaaagtattttacaggctcatatgtggaaaggagttgccttgtctcagataagattttggacttggacttttgagttaatgctggaaagaattaagactttgggggattattgggaagacatgattgtgttttataatgtgagaaggacataagatttggaaggggccaggggtggaatgatatgttcgactctgtgtccctacccaaatctcatgttgaattataatacccacaatcttctttgacaccacaatcttctttctcacatccaggccacaatgatgtaagggtgagctcccaaggccttgggaagctccacctctgtgactctgcagggcacagccctcatggttgctttcatgggattaagtgtctatgcctttttcaggtgcatagtgcaaactgttgatggatcaaacattttggggtttttaggacagtgggacacttctcacagcttcactagggagtgcccctgtggggactctgtgtgggcgctccaaccccatatttcctctctgcactgccctagtagaggttccatgaggactccacccctgccacagacttctgcctagacactcaagtatttccatacatcctctgaaatctaggaagaggctctcaggctttaaatcctgctctccacatgcctgcaggcccaaccacgtggaagctgcccaggcttgaggattgtaccctctgaagcaacagcccaggctgtattttggccccttttagccatggctggagctggattggctgtgatgctgggtgccatatccagaggcagtgcagagcaaagggtccctgggtctagcccatgaaaccaatttttttctccaaggcctccaggcctgtattgggtgggactggcatgaagtctctgaaacaccattgaaacattttccctattgtttggctattaacttttggctccactttgtttatgcaaatttatgcagcaggcttgaatttctctccagtaaatggggttttcttttctaccacatggacagtctgcaaattttccaaacttttatgatctttttcccttttaaatacgaattccaatttcatgaccatttccttgtgagtacatgtgagcttatgctcttagaagcagccaggtcacaatttgaacactttgctgcttagaaatttctgccatcagataccctagattatctctctcaagttcaaagttccacaaatccctaaagcaaagctacaatgccaccagtcactttgctaaagaatagcaacagtgacctttaaccagttcctaaaaagtttatcatctgaggcctcagtctggactttactgtccacataactatcagtattttgtgtgcaacaatttaaaatgtctctagaagttcaacaatgtccttcatcttacagtcttctgagccctccaaacgattccaacctctcaccattacccagttcaaaagatgcttccacattttcaggtatctttataacaaagccccacttctctggtactaattttctgtattagtacattgtcacatagctaaaaagaactatctgagactggtcctttatataaaaaaagagagtgaaatttaactcacatatctacaagctgttcaggtgacatggctgtggaggccataggaaacttaaaatcatggcagaaagtcaagaggaagcaagcactgttctcacatggtgaagcaggaagtgggggggaagtactacacactttcaaacaaccagacctcatgagaacttacaatcacaagaacagcaggggggaaatccgcccccatgatccaatcacctcctcctaggctctccttccacaacgctgaggactacaattcaacatgagatttgggtagggcccagaaccaaaccatatcaactactaatgggcatttaggtagattccacatctttgctattgtgcatactacagaactaaatatacacatgcatgtgtctttatgactggacaattcatatgcatttgggtatatgcccagtaatgtgattgctgggttgaatagtagttctgttattaggtctttgaggaataaccatatttttttccacaatgaatgaaaaaatttacactccccccatagcatataagtgttcttttttctccacaacctcattagcatctgttatttttttttaccttttaaaaatagccattctgattggtgtaagatggtatcccattatagttttgatttgcattttcctagtgatcagtgatgttgagctttttaaaatataattgttggctgcatatgtgtcttcttttaaaaagtgtctgttcatgtcctttgctcaagttttatggtgttgtttatatttttcttgtacatttgtttaatttccttaatttgctagatattagacctttttcaagtgcatagcttgtaaaaatgttctcctattatgtaggttacctgtttactatgttgatcgtttattttgctgtgcagaagctatctagtctactaagattgcatttgtcaatttttgcttttgttgcaatttcttttggcatcttcatcatgaactattttcccatttatatgtcctgcatggtattgccaaggttgtcttctaggcttttttatagttttgggttctatatttaagtttttaatccatcttgatttgttatttgtatggtgtaaggaaggagtccaggtttattcttctgcatatggctagccatttatcacagcatcatttattaaataaaaaatcctttccttgttacttgcttttgttgactttgctgaagagtagattgtagtaggtgtgtggccacatttctgggttctcgattctgttccattggtttatgtatctgtttctgtaccatcaccatgctgttttggttactgtagccttgttgtatatattaaagttaggtagtataatgcctccaaatttttctttttgcttagcatttccttggctattcaggcgtttttttttgttttcacattaattttaaaatagttcattatagttctttgaggaatgtcattggtatttccataggaatagcattgcatttacaaattgctttggcagtgtgaccatcttaaccatattgattcttctatccattagcatgcgatgtttttccatttgtttgtgtcatctgggaattctttgagcagtgttttgtagttcttcttgcagagatctttcacctccctggttagctgtattcctagatatttcattctttttgtggcagttgtgaatgggattgcattcatgatttggcacttggcttggcttctgatgatgtatagacatgttagtgatttttgtatgtttattttgtatcctgagtttttgctgaagttgtttattagcttaagaaacttttgagctgagactatgctatggggttttctaaatataggagcgtgtcttctgcaaacagggatagtttgatttcttctttttctatttggatgtgtttatttgtttgttgtgcctatttggtcttgccagtacttccaatactgtgtgtaataggagtagtgaaagaaggcatccttgtcttgtgccagttttcaaagagaatgctttcagtctttgcctattcagtatgatgttggctgtgggtttctcatagatggctcttattattttgaggtatgtttcttcaatacctaatttcttgagagttttaacctgaaggaatgttgaatttcatccaaaggcatttctgcatctattgagataatcatgtggcttttttcattagttatttttatgtaatgacttacatgtattgatttgagtatgttgaactaaccttgaattccaaggttaaagcctacttgatcatggtggataagctttttgatgtgctgctggatttggtctgccagtattttgctgtggagttttttaaatcagtgttcataataaatattggcctgaagtttttttgttgttgttgttgtactctgcctggtttttgtatgaggatgatgtgggcttcattggatgaattgggcaggagtctctcctctttaagttttgtaacagtttaggtagaaattgtaccagagcttttatgtacatttggtagaaatcagctttgaatctggctggtgctgggctttttttttagatttgtaggctatttataactgattcaatttagagccattagtggtctgttcagggattaaatttcttcctggttcagtcttgcgagggtatatgtgttcaaaaatctatccattccttctagattttctagtttatgtgcacagatgtgttaataatattctccgatggttatctgtaattctttgaggtctctggtaatatcccattgttgtttctaattgcatttatttggatctgtttacttttttattattctagatagtagtatatctactttattaaatttacaagaaaataacaactcctggatttgttgagattttttaaaatttttttttaatctatctcagagtccttcagttcagttccaattttggtaatttcttgtccttagctttgcagtttgattttagttcttttcgtcatgatgttaggtagttaaaatgagatctttccaactttttgatgtgagcatttagtactataaatttccctcttaacactgccttagctgtgtcctggagattctggtgtgttgtatacttgttctgattggttttaaagaacttcttgatttctgactttattatttacccagaagtcacttagaatcaggttattgcatttccacgttattgtatggttttcaggaaatatctttgtcttgatttctaacttgattgtgctgtggtgcaagatagtggttgttatgattttaggtgttttacctttgcttaggagtattttgtgtccaattatgcaatcaattttatagtgtgtgacatgttttaataagaaaaatgtatattttgttgcttttgggtgtgaagtaatgtggatttctatcagattcatttgatctaatgctgagttcaggtcctgaatatctttattaattttctgccttgatgatctgtctaaaactgttaatgaagtgtggaaatcttctactattattgtgtgagagtctaagtctctttgaagttctctaagaacatgctttatgaatcttagtgctcctgtattgggtacatatatatttaggatagttaggtcttcttgctgaattaaaacctttaccattaagtaatgcccttttttgtcttatttgatttttattggtttaaagtctgtttcatctgaaatttaggattgaaaccttatctgttttctgttttccatttgcttggtagatattttttcatccatttactttgagcctgtgggtatcactgcataagagatgggtctcttgaacacagcataccaataggtattggttctttatctagcttgccactctgtgccttttaattggtgaacttagcccatatacattcaaggttaatattgttacgtgtcggtgtgattctgtcactgtgatattagctggatattatgtagacttgtttatgtggttgctttataatgtcaccagtctgtgtacttaagtgtgttcttgtagtggcttgtaacaatattttctttccatatataatgcttccttcaggagctcttgtaaggcaggtctggtggtaacaaagtctctcagcatttgcttgttcaaaaatatcttatttctccttcacttatgaagcttagtttggctgaataaaagattctggaatgaaatttcttttcatttagaatgttgaatattggaccccaatctcttctgactttaaagtttctgctgagaggtctgctattaattagtctgatgagcttccctttgtggtgacctgacctttctctctagctgccattaacatttctttctttcatttcaaccttggagaatctgataattatgtgtcctgaaaatgatcttttgtgaagtattttactggggttctcagcattttctgaatttaaatgttggcctttccaacctgattgaagatgttctcatagatgatatgctgaactatgttttccaagttgcttccattttctccatctctttcagggacaccaatgagtcatagatttggtctctacataattccatatttcttggcggtttcgttcattccttttcattactttttctttagtcttttctgactaacttatttcagaaagctgatctcttcaagctctcaccttggtctattctgctactaatatttgtgattgtattataaaattcttgtagtgtgtttttctactctaccaggttgattatgttcctttctgtactggctattttgtctgtcagcacctgtatcattgtattgtgattcataactttattggattgagtttcaacatactcctgcacctcaaagagctttgttgctatccatattgtaaattctacttctgcaatttcagcaatctcagctcacttcagaatccttgatggaaaggtgatgtggttgtctggaggaaagaatgtactctagctttttgagttgttagagttattgcattggttctttctcatctttgtgggctgatgctaattcaatctttgatgttgctcaccattgaaagttttatttttccttttatcctatttgatgaccatgagcgtttgattgtggcataagccaattgaatggctttctttctggatgatttcatgggaccaatgttcagctcctaactcctagactgtgtgctctaactctgggggacttgtattgggccccaactttgtcatctgcctactcaatgtaaggagtccactgtgctagggtctgaggtgctccttgactcctggtcactacacttcaatgggtggtgtcagacaaatcatgctgcagtggcagcatggtggggtgcacgatcatcagctgtggcagggtgctggatacttttattcttatatgcaatttttttgtttcctgatgttggagagattttggtatagacattactattaatcatatagtcactttggagatcattatggtactcatataccaaactaccttagatcttccataatttatcataccttctgaccgttgtgacaacggaaaattgtggcccattggccaaatttggtaagcagacatgtgttacttgtaccctttacaactgacagaaaataattaggaagttgccaatagtttaaaaggaaatttcacaaacaagtctgagtgtgtggcttttctggaaaatattagaaaatgtgttgtcagtgaatctgcaactatctcacatagcaacaatcagctggagctgtgtgaggaattcacagttctcaacagttttactttctaacatgtggcttgctcagctcatttgtttctaatatctggtctgctgtaccattttaacatatgagttaaaaataaattatttaagcagatagataggataaggaagtcttccgtgaagtttactttttaatgagaagtagtccccaaatcatttgttttctaactaagagcagcctgtaaaattgagctgcagacatagataagcaagctggagcacaggtgaatgctggcagctgtgccaatagtaaaagtctacctgggggctaggcatgttcaacatgacatctccatctttccttttccttgccaaccacgtgtacagtaaggagcacacaacgtggagccaaccaagtaaaaaatccatttgcataataaaagattagggtggggttgcaaggttcttcactcactgtgtaaatgtcctgcctggtacaaccaatctttgagacctatgtaaatcagacaccacctcctcaagccagtctataaaaccccaagtgcttcactgtaggaccggaagtcccactcaagtgcccctctctttcgcaggagacagagctattctcttccctctttcttttacctgttaaacctccactcctaaacccacttattgtgtgtttgcatccttgacttccttggggcaagacaatgaacctcaggtatttaccccagacaacgatgctgcttcaatttgtttactctgttttcctttacttgaatttttgatttcaacacttgtgtgactagcttggtcaaggtaaccttggctctctcatttggtttaaatgtccttttaatgactctgtaccttatttattcttatagaaataataaaccttgaaattattatattatataatgtttacatattaacatgatactaactttcctatcaatactctaagatttctgaggtcctagctcatgttcctctttgcattccaaataactgtaaagtgtaggaattcagttaatagttcttgtttgattgaacaaagagatctaataacatgaaaaatttaataagacatacgtaatcaattacatacgtacttactaatagagtaacaaaacatttgggcaatttttgtctcttatgaataatttacaatgtatttccatcagaattatgaattagcatgattgatggcatgattgatggattatatatttacttaatctcctttggagctacattccatttttcctggagtattttactttcaaactatactttaggaccattttatcaaataacaacttcatgtttatttcagatacataaaattatatcaaaaccacatttctgagcatttgaaaactggcatgaagagtgacagtgatgagctatattatcctctgggttttatcattctgatacattcctgcttgtcattttgcaagtgttttctggaatatattctgttaaacagaaacatatcatttatttcaaataaatcattgtgtgacttttcagtaacgtttgaaacatctactaaaactcaaatatgaagttaacctctatattccaaagcaaatgtcatagaatgatgtcagatttccaggatattctcatacacagggagagtttcctactccacactagtgggcaaccagtgaattctgcttgtgctgaggtataagcccatttaattccctggagcagatggataccttggtgtataggcagatttgtccacttaatatagtgtgccttacaaacaatatcttttctatgtgttccaaaaatctgtaagtgggtggtattcactgttattcatcctgaactttaggaagtcctgcctttgagacagagaaataaagacacatctgctaggacaatcctcattttggtgattgtactgccttttgcatttttgcaagttttataataaaccattaatacatactgggatttgcagggttttttaaatccttgcagaactcacagtctagtgttttgtagtttcagaaagcatttcatgtcttttgtttcatttgttttctctatttcagagaggcttagtgcattgttcagaatcattaagtaaagagcaaatgaagagttgctacttaaccctagggaaagaaaatgcacctccatattaaagaccactctgctttcacactccacttagactgtacatacagtcatatgcctcttaacaacgttttggtgaacgatgaaccatatatgctacagtgattccataagataataatggaactgaaaaatctctaacacctagtatttactacagcatacttttaatccttattttagagtgtacttctacttataaaaaaagttaactgtaaaataggctcacgcaggtccttcaggaagtatttcagaaaaaggcattcttatcagaggagatgagcgcttcacgcatgtcactgcccatgaaaactttctagtgggataagatttggaggtgaagacagtgatattgattattctgaccctgtgtatgcctaggctaatgtgtgtgtttgtggcttaatttttatataaaatttttagaataaggatataaagaaagaacatatttttgtacagctgtatgatgtgtttgttttaagctaactctcattgcaaagattaaaaaatgttaaaaaatttaaaagtttataaagtgaaaaagttataatatgctaaggttaatttattattgaaaaggcaattttataagtttagtgtcacctaagtttatcatggttttgtttgttggtttgagacggagtctcattttgtcgcccaggagtacagtggtgccatctaggctcactgcaaaatcaagcaatcctcctgtctcagcctcctgagtagctgggattacaagcctgtgccaccatgcccagctaatttttgcatttttagtagagaaggggtttcaccatgttgatcaggcaggtctcaaacccctgactgcagatgatccacccgcctcggcctcctaaagtgctgggattacagatgtgagccactgcgtccagcccatgtttttaaagtctacactagtgtgcactagtgttctaggccttcacattcactcatcactcactcactcacccactcacccagagcaactttcattcctgcaaggttcatttatggttaagtgctctataaaggtgtaccatttttatcatttatatttttactgtatcttttctatgttttgatatgtttagaaacacaaataacattgtattacaattgtctacagtattcagtatagtaacatgctgtataggtttatagactatgagcaataaattataccatatagcctatgtgtgtagacaacatcatctaggtttgtgtaagtacactctatgatgttcatacaacaaaatctcataatgacacatttctcagactgtatctctgtcagtcagtgtttcatgattgtgattaattgccctcaataagctgagtaatttcaagtagttgtgaattaaaattttgatgggtctgctgattgtgacagtttttatgtaaaaaaaaatgtgttttatattgtttcttgggtgagacctctctgcttttccccaccagttgctaactaagagcagcaggtataaaatagaaaaacatgattattcttgaagtgtagattagaaagattcaagttcatttcctacaacctgatacacatacaatggaatagaagagcaaaagagaagacaaggtatcaccactgttctatccttgaaaatttgtctgatacaggaaatttatcagcataaagctaattgccagtttgagatttaacaaatccacttgtttgccttaattagtacccatttcccaccaagaaaaccttgataaaattccttaaaaagctggccttttttaaacccatgcaccttaggtgagtaatattaattagatattttaattatggattccatgtgcaaactttatcagtgaaaaactgctattatactgtggcactcttactttaaattgactctgtaataactctgaaagctgtgtaaagtaaaattaaatccttatccgtagacaattgctttagcacttgttcctgtgttcatgaggtaccaaggttaggctgctattacttactgtgaatataaatttaaaagtccagttatttgcattcttgcttcggtgtaccctgaacataatgaattaagatatagagacactatcaatataaaggtgtaacatcaaagaacagtaattgatttcctaaaataacgtcatgtatataaactccaaaccagatttttaggtaaggaattgtgacgttagtaaataaacttgtgatttgaaatctatagtgtttaataatttgtgggaatttttttgtcctattgtctgttctttatttttcccttgtgtgtctgttactaaaagcacataatttatcttcatatgttcttaaacttatctccaaattttaaaaggattttaaaacacatgacatgagagaggaccagaaaatattcatgtgtatatactaagatattatgttaatagttatatataatttggagggtgactatagtctgaaaatactaaaaattttttttattgaactccctgattatttattctgggctatgctaaactcatggacattcaggaaaaattagagataaaaatcattttatccatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctacaactagaaataccatttgacccagccatcccattactgggtatatacccaaaggattataaatcatgctgctttaaagacacatgcacacgtatgtttattgcggcactattcacaatagcaaagacttggaaccaacccaaatgtccaacaatgatagactggattaagaaaatgtggcacatacacaccatggaatactatgcagccataaaaaaggatgagttcatgtcctttgaagggacatggatgaaactggaaatcataattctcagtaaactatcgcaaggacaaaaaaaccaaacaccgcatgttctcactcacagatgggaactgaacaatgagaacacatggacacaggaaggggaacatcacactctggggactgttgtggggtgtggggaggggggagggatagcattaggagatatacctaatgctaaatgaggagttaatgggtgcagcacaccaacatggcacatgtatacatatgtaactaacctgcacattgtgcacgtgtaccctaaaacttaaagtataataataataatataaaaaatcattttaaaatacacatcacagatgcttatgcagagaccgatgaaaattctgcattcattcactaagttcaatgcaacttttgagagctaactgaatgcattgatgccaagggataatacatcaactgaatttttattgtgagccatttatcatatatattttcctatgtttccagacattaagtccaccttgtataattaattttattagtttggttgcttaaaatatacccttcaaatgcaaaagcaattactaaaatggagttgaatcctaaaagtcactatagtgtgcacctctggtaacttcatttttctttccttgctaacctttgcttgccccaaattacacacaaagtaaaacataaaatctctcaccatggtagctttaccctctaaattgtactcacatactcagttcctgaacttatattttgcaattttccttcgtatccccttcatacaatattacatactatctaccacataattcctttctattattgcctctgaatttttttatactatttcatttcactggaatttaattcattattacattgttattcttaaattccataactgtgagacatgtcccccaaaaggaatttttttatgttctgaaagcattttatcatttattgatatataactcactatacaactaccaatttgcagtacaaaattcagtgattttagtgaattcacagaggtttgcaaccaccactgcaataaattctcataacattttattcacttcataaagaaataccatacccatcaattgtcactcatcattcccctcaataccctcagttctaggcaaccacagattgactttgggtctctatagatttgaagattcaagatatggcatataagtggactcatataacatggggtctttatatgactggtttctctcacttagtgtaatattttcaatatttatccatgttgttgcaagcatatttattttattgccatattaaatttcattgtgtggatatactacattatatatgtccattcattagttgatgaacatttggcttctttctacttttgactattatgaatgacaatgcttgaacattgtgtacaggtttgtgtatagtcgcatgttttcccttctcttgggtatatatctaggagtggaattgctctgtcataagggcaagtttgtttaaaatactgagtaactgccaaacagttttctaagatttttggaacattttacattccagccaacaacgtgtagagattctaatttgtttacatccttattgatatctatttgtaatgtattttttattacagccatcaccctaatgaatgcaaaaatatatattactgtgaatttaattttctcttcacaaataactaatgataatcataattccatgttttctttagccattttttatcttcataggaatagtgtctattacttttttgcacatttttattgtttttttttttagtttttagttttaagagtttttttatatacttaggaaacaagtcttttattatatgtataattttctgttgattgcctttctactttcttgatgttttaccaagcacaaaatttttaattttgatgtagtctaattatctatttttcttttgttgtttgtgctttttgtcatatttaataattaatcacataatccaaaatcacaatgattacttctatgttttcttctaagagttctatggttttatttcttacgttgaggtctatcatctatctggaattaatttttgtgcatcgcgtaaggaacagttccaacttaattgttgtgtatgtatttatccacttgtctccatatcacttcttgaaagatttaccccattgaaatctcgcaatactcttgttgaaaatcagtgaagaggcttatttttgaattctgaattctgtgtctatcctatgtcaagatcatacttttgattaccgtggttttgtagtaagttatacaattggaaaatgtaagtcctttaaatgtgttattcttcttctaaggttgttttggaaattctgggcccttgaatttcagaatgacttttagatctggcttgcgaatttctgcaagaacaaaaaaagcactttgatcatgatagggattgcactgaaatcatagatcaattaagagatatattgccatcttaatgatattaaatctcctaatccctgaacataagattttttcccatttatttatattttatttaattttttaaaataatgttctctagttcgccgtgtctaagactttcacttattttgttaaatttattctttagtattttgttttttggggtgttattgtaaatgtaattaatcacttggtttaatttttggtttgtgaatcactaatgcatagtaatacaattgaattgtggatgtcgatcttagactctgcaacctcgatggtcttaattatcacttttagtaataatcaccactaaattactactacagaaaataatttaattaggaaatgaattccttagaattttccatctgcaaaattatgtcatcttcaaatagagatacttaaaaatttcttattccaagactttattttttccttgccaaactaccttgtctagaactttgagtacaatgtcaaatgggaatggtaagagaaaacgtccttgtctcattccttatcttaggggaaaacatttagtctttcacctttaagtaagaggattctcttagttttccattgttgtccttcttcagtatgagaaagttctctctattcctatttgttgaatatttttaatcattaaagagtgttagattttgtcaaatgttttttgcttcatctattaagatggtcatgtgctttgtgttctttattcagttgttaaactatcattagatttctgagatgaatcacacttgatcgtagtgtatagtactttttatatgttgatggatgtagtctgctagtattaagtgaaatttttttgtctatattcattaaagatattactttatagttttacttactcgtaatatttcggtttagcatagtgtatagtactttttatatgttgatggatgtagtctgctagtattaagtgaaatttttttgtctatattcattaaagatattactttatagttttacttactcgtaatatttcggtttagctttcacatgccagcaatacatagaatgggttgggatgtaatatattctattctatttttaaaaaattgttggggagaattggtattaattttttcttaaatatttgtcataatttatgaagtaaggcatctgagccagaaatttattttgtgagacatttatacttttctattttaatctctttactcattatagattgtggtagacagaatgatcattctgcaaaaatgttcacctcctaataacagaaactgttgatatgttaatttatatggcaaaagactctgcaaatataattaatttaagagccttgataaagggagattattctagataattttggtgattgcaatctaaccacacggatccttaaaagtggagaacttttctccgctctgatcttagagagatgtcattctggaagaaagatatagaaaaacgtaaagtttctggctttgaaaatggagaaaggggccataagcaaaggattgtggctagcatctagattctgggaaggttacagaaatgaattttaaacaagacctaacaaaatgaaagtaagccctggtaatatcttgattttattcttttgagaactgtgacagttttctgacctacagaaatgtaaaacaatacatttatgttgatttaagtcactgaatttttggtattttttttgcagcagcaatataaaataaacacataagtcttctcaaatttcctgtttcttattgagtcagtttcagtagtttgtgtctttctaggtaattttctattttatcaaaagtgatgtaggccgggcgtggtggctcacgcccgtaatcccagtactttgggaggctgaggtgggtggatcacgaggtcaggagattgagaccatcctggctaccacggtgaaacctcgtctctactaaaaaaaacaaaaaattagccgggcgtggtggcgggcccctgtagtcccagctactcgggaggctgaggcaggagaatggcatgaacccgggaggcggagcttgtggtgagccgagacctcgccactgcactccagtctgggcaatagaatgagactccgtctcaaaaaaaaaaaaaaaaaaaaaaaaaaaaatcagtgatgtaatttgtaggcatttggtagttcgtagtattcatttaaaatctttttgcatttctggatagccagtcataaagtcccttcttttattatttctgagtcagtaatttgagtgttcttccttttttaatcagcaaagggaaggttttgtaaaataaaaatgtgttggtcacagttctggaagctgtgaagtccaagattaaggcaccgacaaatatgacatctggtgaagactcactttatgattcagaaacaatgcctttttgttgtgtcctcagatggtgcaaggggcaaaacaggttccctccagcctgttttataagagcactaatctagttcgtgagatcagagacctcatgacctaataaccttccaaacaacccagctcttaatacctaccatcaccttaggggttaggtttcaacaagtgaatttggagggacacattcagactacagcacaccttttgattttttggttttctctattgttatctcttccattaatttcatctataatcattatttcctaccatgtgttggctttaagtttagttttttccttttttaaaatgtatcagtgtctttaggtttaagttaggttacagatttgtgattattattttttaaaatatatatacttacagatataaatttcattctaagcatgggtttcactgtatcgtataagttttattatattgtgtttccattttatctcaaaatatgattgaatttcccttgtaaattctctttggtccattgattgttaaagagtgtgttgtttaatgtccaaatatttgtaaattttctcagttttgctctgttgttcgttttttatttagttctattttggtcagagaaactttgtgtgatttcacatattttaaacttattgaggctagttttatggcctacaatatgatccttgaatacgtaccatttgcatttgaaaagaaagtatatagtgctgtattggataggttattctgtaggtctctcttagatctagatctagatctggttggtttatgctgttgttcaagtcttctatgtctttattgatctttctacttgttccatctactgttgaaagtggacactgcagcctgcagatatggttgcattctctatctcttaatttgtccatttttttcttcatgtattttggtgtcttgctgttgggtgaatatgtgtttgtaactcttatatctttgtgatggagtgcccctcttatcattagaaagttttcatctttatctgcggtaattaaaaaaaaactttttatagtctatagtttattactaatatggttcctctagcattcttgtggttgctatcatttccatcctcatattttccacctatttgaatctttgagtctaaagtgtgtctcctatagacaatataaagtaggattttagaaaattctgtctagcaatgactgctttttgattagattgtttcatttatttacttttgatgtcattgtttatatagttagatttatgtcttccattttatttttgtgttttctgtatgcttttttgggtcttgtgttctttttcgcttctttaattttcattaagtaaatactttttggtgcaatatttcaattactttaacaatatgtttactttttaaaattttcttaatgttcaatctagagctcaaaatatacatcttattttaaactacttcacctccatagtcaatttaactccagtgagatacagaaacattacactatatatctctattccctttctacccctcttttttgtgctacaattttatacatattacattgtacaatgattattttacttcaaatctgttgagattccctagagaacatttcgtttcaacatctgtacttttcaattccaagatttatttttggtttcttacaataatttttatctccttattgatgttttctattttatgaggcattgccatcttactgtactgtatgttgttaaatatttcttttagttctttgaacacatttagaatagatactttgaagatttgtctgctaacccagcatctgcctgtttttgtcattgttttgttttcattgtttttaacatgtgcatgatcatactttattacctctttgtagaccgtgtaattttttgttaaaacctagagttttaaaaaattatatattttagcaaatctgcatactgattccctgctctatactggagattatatttgttatgttcttgtttatagtttttactaacttggtttgactactttattgaagtctatttcccccccgtattgtacaacaatctaatattgatcttcaaatgattcagccttgggaatgtgcatattctctgggcgatgcagtaactgctttagtcagactctctttgactgtctctttcaatgatttctctggtaagctatctgacactccaagtatcacacccagttgttaccctctactaattcctatctgattgcactattatttttgacaatactctggggctggaatatctccccaatatagtccaatcagaataggactgattttcaggaatcaaaggccaacgtttatggcttattctgactgtgctcttcggtctacactttcctaaactttttcattctaaataaattctgcttccttgggaagatacatgatgctctctgttttcactccctttttctcttcttgggtcaaacctctgtgttgttcattaggaaccacagatatgctttgccattctgagggagatgtgggttgtggtgccaatgccacaggtttgcattgcttctatcagaatttagtagattttattttatttgaggaatgtcctttggaaaatatccagagactttaaattgtttgcttatttgtaaataattttcacgagttatttttttttcctggggaccaggttcatagctcttcactattccagaaatcagtcctcaaataattttaataacatgttttaaatattctttatgtaatgtaatgctttgcatactataagcatgttaaaggtagtagctatgccttagttgtatttttcatacctggaatgacttatcacagccacacatctgcacacattataatctcagtatgtgctttttgtgctaaatatgtagcacaaggtcaaaggcttacctttacaacttccttatttcttatagagtgcggagcctgaaaacaggttttccaattattgctgaaattattttcagtgtagttaaatagattgttagagaaccactgaataatatgtaagccaagtaaagatgctgcttctgttattgtcatcataaaatacccaaatggaaactttactctgtgctaggtcacagattaagctaaagagtgtcatactttatggcaatgcataatgtggtgccttatttgtcagaatgagttaaattgactctctaagtcactgctgagcataaagcaaagcccctgagggagaatattgctgaatttattccatgattgtcagatactatattagtatcttattgctggtgtaagaaatcacaaatttatttgttttaaaacatcatttatttattcttacaattctgtatgttagaagtcaaacactgatctccttgggctcaagttttcagcaggaaagctacctttctttctagagactctagaggagaatgtgtttcattgacaattccaactttgcaagccactcatattccttgtctcttggtgttcatcctcaaagccaataatggtgggtcaaattcttcatacattgcatcattctaacattctcttctgctgttttcttccattcttaagacattttgtgattacaatgtgctcacctgaataatctaagataaatttgctctgcctatgtaattaggaagtgggtactatttttatatccatttaactcatggcaaaattgtggctcagaatattaagtgatttgcccctggtgcagtaaaacttgaaaacatatggttcttatgaaatgaagtatcacataccaagagctactgggaaaattgcaagcacacaactatggagtatgttaaagagcattgtaatggatataatgcatttgatatataaagccaatatatattttatttcttagaaatcttgtttctctgcgactcaacatcctttgtaccaatgtcatccatcatttcatgtgcagagcaagtatatcttagaataaagtggtgattcctctggttaagattcaaatcagactttttgatcttaaaaaaagcacgatcttaagaaccaggcttttctgagagtaaaataatttttctaaattccaaagttttccttggctagaaaaaaaaaaagcatgacattctgagtaaagatctcttaaagagaagataaaagacatggtttaaagggagtttctatcccacagcaagaaataaagcctttctcaacagtaggtagtttagccaagaataaagattcagaggagataaggcctgggttaaatttctgtctaaatttctaagaacatatgtctcagccaattaggccaagacccaaagcatggaccaaaaggagtaaaatcccacataagcaaagtgggtggctgacaacaaaacatttgaaactcattttttagaattccccatgaccaaattgggtgattagggaaaagtaaaactgtggtatggtagcatgtgtttaggttgagaaagggtttgacaaaatgtagctctatttccccacagcctgcatctgacattgacaaaaatgtatgtgttcctatgtgtcttgtgggatgcaaaaggtttctgtgaattacaagtcagcagactgtctaatgattttctatgctgaggtgtaagatgatagcaagcctattgtgaatctaaattaaaaggaagggatgtggcatggttgagaagcgcaagattaacagaatcaactaaagggcagtcagaggagctgtctggattttggggactaatgctcaagaattatctaggcagtgaatacacagtttatgctagttattttttaagcagccaatccattatacagacgctgttgactaaagaaagtccacatatcaacatatcagtcagaggtcagcagaagacagaagaagcatttaaaaaattattgtttacccctctcaggttgttatatgagctattgggtggttttataccatcaggtaagtatgaaattttattgagatacgatatgtgagactaaggtgtgtgtatatgttggggagaatacaaaggatagttggctagactgagtggtgaaaccttaaaagtctaattatttatcaaaaggaaactttgtttaccttaaaaagatcatgttgaactagaaaagactgaataacttaaatggacaatttttttttcaatttgtttttatttgtatttacactgtaagcagtcctgaagacactagaaatagataagatcagtcatgaaaaactgaaaagattacctttttcatatgtgtgtcattgtgtgcaaaggttgacttctgctacagcagatataatccttctaacatattttgcatcagtggaatttttcttttcaattttattgcagcaccaagttttattatatttttgttgaaagatacatagaaaataaatactttctgatattttacaataacagtgaaactatttcaaaaggaagaaagggattgaaccattatccaagcaacagaacatataattatgccaatgaaaggggctgtcttatcattgttcttagaatcttaagagataggtgcagatagatggatgtatggatagatagatagatagatagatagatgatagatagatatatagatagatagatagatagatagatagatataaaaacaagactcagatgactacacgaggtctttccaactttcaaaaacatggaattattttgccttttttttttggtgtttttttgatgttgtgattcagtttgtcatttgcctgagaaatcagtatgagaaatttgtattgatcactatttgaagagcatataaatatataattttcatggtaaatattcataaattggaaccatggtattaaagagaaatttgtttttatgttgctgataattgattccttcaccctactctaaacagtagcctttctaaaatggccatccaagcagccattggagtttaaatggctggaagcacttttattcattcattctttaaggctcaatcttacctcatccaggggctgcattacgttcacatagaagaaacaaaaaatgtcagcaagtattgggatctgcagatttattttaaagactgggtgagtctatattctcaaaagtgttgtacttttgttgtaacaaaatttgttgtaatgtgtggcacctgccttttaaataaatattatgtgtgtttcaatgtactcaatttgtgtgttagtcatacatactgaattgacagtagaatgtcagttaatttaccctgagaaatatattaaccatatttcctttgcttgctcattatctcttagtaaaaaatatgtaggaaaccaatgtcataattgggactattttggtcagattagaattacactaagatgaatctgttgtataattttaatgaccaaagacttcatagataatgaaagatgaatttcaaaaactgtgatatgagtggtatatagatgagagatatcacagcccagggtataggctcccttcctcttgatgacaccggttgttcactttcaagttttacttttcttgctgttgtattaacattttattatctgctcatttgccctagttgaaacaatgatctcaaagtaggagtctcctcacgccttaactgtgctccttgggttaacactgtctcttgggttaacacagtgttaggagttgggttaactcctcagttaaggagtgagggaatgaacagagaaagaacaacaccctaacgttttatttttacatttgttacgcaaaaacatacacaatgtctaaataatgttgattgctgggtctttttagaaacacagctgtgaccatacattaggaaacacccccgcccctgacaatttcaaataatagtttacaggatgattgcctgaataaaaaagtgattcttatcattttttgaaataaatttgaagaatccgtgcaatgtacctttaaatcataattttctctagtaaatttaagcactttacaaggtgatcttattacttgatggagcaattgtatgagatggattattcaagctggtgttaggaattagttaagtgataatcagacataatatcaaattccttgtgctcctctaataaaatcagaggtaaatagataattcaattcacaaaacattgaataaaacacaatatttgagaacttcatctgctgtgtataataaggtacatctgtattagcaatgctctattcacagttaccaccaagctatcttctaaaacacaaataaacaaaatgttaatttaatgactattgccttttccttgtggactgagtaatttaaaatgcattacaataggttttatgtttatttgttaattaattgcaaaattgaacagctattatgtataagacactatattgagcaatagaaaaaatagtaagacgtaataagacataacactagttaacatttctagagtacttaccataactcagcactgtgctattaaggtttttgcgtgacttagctcatttagtccctttagaagcctagaaattttgtctcagtgttactaaccattaacaagaagtaaaatgaaaatacagatagttttaaatataatgcaaacttatatccttgtttttgcagatttgtatatctggtttatgcctgttcttcctatgtaattattaatagaacatcctctgcctttgaagaatgtcccttgaatgatattttacatcgttatcccatttaaataacttgcccaaggtcacacagctagttactggcagaactatttcttaaacccagattttctgaagccaaagcctaaattaaaccatctcccacagctaaggaatactttttagtttaatgtctatatatgtgtgtgtgtgcacatgtgtgtgtatgtgtttgtattttaatggaacatctttcaaacccaatatgttcaaatgaaactcagctttctttctaaacttgttccatcttcctatattcactatcttgaatggcatgaattacttatgctaggaacatgagagtcatcccagaataaaatcctgtctttattcatattaagcagtgtcatcaaattctatcaatttatttcccttaaatattttcttaaatcctttttttattctgcagcaccaaaaattcttccttaagttgtgtattaggtagaatgaacatgagaaattcccattcacttgatccttccaattctatcttctttcctaggaattcttactaactctttggtatttcttcttcatagactatttgtatacattgatatttgtgcaaccaggatgtagcatatgcaagttgatttctatcttccttcccaggaattcttactaactctttggtatttattcttcatagactatttgtatacatcgatatttctgcaaccaggatgtagcatatgcaagttgatttgtagttccagtttgagtctgacaaccattgttataagtggtataagttccagtttgaaagccttaaggcttgagacctaaaaagagccattatttctgtttgagtgcaagggctggaagagactgatgccctactcaaagcagtcagacaagaggagattccccttagtttttttattctattcaggtcatcaagtaattggatgaggcccacccacattagagaggtcaatctgctttatcaatgtgatgattaattttctgtgtaacttgacagagctaaggaatatccaggacagctaatgagacattatttctgagtgtctattaaggagcttctgtaagagattagcacttacatcaatagactgagtgagcaggaactccctcatcaatgcagatgagcattatccaatctgttgaggatcccaaaaaactggaaaaaataaagcagaagaagagattaaaaagttattccctttactggagctgggacattcaacttctcctaacaagtttatgggacttgtcaggctccataattaagtaagccaatcccttataacaactttaaaaatgatctctgtatatatcatattggttatgtttatcgagagaaccttaactaatacacttagttcaatgattaaaatgtcaatatcatccagaaacaccctcacagatatatctgggataatttttggctaaatatccagggaccccttggcccaatcaagttgttacataatcgacacagtatatgttagccttggtctctttttttaagattccacacataaaacattcacatatgcacatactgtacatatagacattagtaaatatcagatatttactaataatctagtgataattttgtaagagacatggaggaaaacatatataataatatctattactaaaatattatgagtgtctttgatttcatctaaaatgcataaattttcccctaactttatgtattagtccattttcacactgctataaagaactgcctgagactgggtaatttattaaggaaacaaagttaattgatacacagctcagcatgactggagagggctcaggaaactcatgattatggtagaaatcaaagggcaaacaagtcaccatcttcataaggcagcaagaagaaggatgaacacaagaggaactaccaaacactgataaaaccattagatcatgagaatttactcactctcatgagaacagcatgggagaaaccacccccatgattcaattaccttccaggcctctgggcctgcactgggaggaactgctgtgaagacccctgacatgccctggagacattttccccatcattatggtaattaacatttggcttctcattacagccagcttgaatttctcctcaaaaaatgggtttttcttttatatcgcatagtcaagatgcaaatttttcaaatttttatgctctgcttccctttaagttgcaattccaaaccatctatttgtgaatgcatacaactgaatgcttttaagggagcccaagtcacctcttgaatgctttgctgcctagtaatttcttccaccagacaccctaaatcatctctctcaagctcaaagttccatagatctctaggacaggggccaaatgctgccagtctctttgctaaagcataggaaaagtcccctttattccagttcccaacaaattcctcatctctatatgagaccatctcagtctaggcttcattgtccatcactatcagcattttggtcaaagccattcaacaagtctctaggaagttccagattttcccacatcttcatgtcttcttctgagccctccaaactgttccaacctctgcctcttaccaagttccaaagttgcttccacatttttggatatctttacagcagtgcactattatctcgataccaatttactatattagtccattttcccactgctgtaaagaacttcctgagactgggtaatttataaagaaaagaggttgaattgactcacagttcagcatggctgggatcctttggaaaacttacaatcatgacagaagtcaaagggggaagcaaggcatcttcttcacaaggcagcagtaaacagaattgaaatggtttggctctgtgtctccacccaaatctcatcttgtagctcccataattcccatgtgttgtgggaggaacccagtgggagatgattcagtcatgggggtgggtctttcctgagctgttctcatgatagtgaatgagtcttacaagatctgatggttttaaaatcatgagtttctctgcacaagctctcactttgcctgctgccatccacgtaagatgtaacttgctcctcctttccttctgccatgattgtgaggcctccctagccatgtggaactgtaagtccaataaacctctttcttttgtaaattgcccagtcttgggtatgtctttatcagcaatgtgagaagagactaatacaagaatgaacacaggaggaactaccctttataaaacaattagatctcatgagaactcactcactatcatgagaacagcgtgggggaaaccactcctatgattcattgacctctgccttgtctctctcaatacatggggattatggggattacaatacaagacaagattttgggtggggacatagtcaaactatatctgtttatatttgtattctatttggaaattatgttggtattagtgtttttgaaaatttaattaatatagcttaaattttggagaagtcttatatttacagaaaaatcaagtaaaaaatacagtttgcaaatatttcctcacctccacccctacaaaatataggttcccctattcttaatatctttcatgagtgtagtgtatttgtttaaattggtgagccaatattgacttattaaccaaaatttgtattttacattagagttcacattttgtgttgtatagactatgggttttgacaaatagagaatgacatgtgtccaccagtacaatatcatacagaacagcttcactgcctgaaaaattaccctgtgttcctattcattcctccctcatgcactctaaacctctagaaatcactgaaagttttacagtctccatagcttcatctttcccaggatttcatatagttgggatcaaacagtaggtggcatttttagattggcttttctcacttagcattatgcatttaggtttcctccatatatttttgtggcttgatatctcatttttaaattactgaatgatattcaattttatggatataacaccatttatcctcacctatagaaggacatcttgattgcttctacattttgacaattatgaataaagttgctataaacattgtgggtgaattttggtgtggttattagttttcaccacatatgggcaaagatgaaaagttatgactgctgaataatatggtaagagtgtttttagttttgtaagaaactgtcaaactgtcttttaaagcggttatagcattttgcattctcatcgggaaagaatgaatgttacttttgctttacatccactctgacatttggtattatcttttgaattttacccattctaataggtaaacagaggtatctcagattttaatttgcagttcccaaatggcatataattttgaggcatttgcttgattgtcatctgcatattttctttggtaaagggttggtcagatcttttgtccattaggaattgttttgttttattttattgtttcccttaataattatttatatatttggaatccaatacctctatcagataattatgttgaaaattgcctcctcaatccgtggcttctcttttcattcttttaacgtatcttgcacagttcagaagtttttaattttaataaaattcagctattcaagtttgtctttcatggatcatgcatttgttgtgcctaaaaagccattgtaaaacccatggtcatctgggaatgttatagttttaagttttacattggggcctataatccattttgaactaattttcatgaaaagtctgtgtctagattaatattttatatttggatgttcattagttccatcactgtttgttcaaaagctattattcttcatcgaattgccttttgctcctttgtcagagattagctatctctatttgcataggtctacttcgaggatctctgttctgtttcattgatctgcctgtgtgtttccaccaatatcacactgtcgtgattggtgtagctttataatacaccttgaagtcaggttgtgttgtttctctaactctgtttttctctttcaaaactatgtttgctctctggatcacttgcctctccatataaattttcaaatccgcttgtcagtattcacagaataacttgggattttgattgagattgcatgaatctataaagttgggaagaaatgatgccttgacaatattgagtctttcatcaatatacatagaatatctttccgtttatttagatatatctgatgcactttatcagaattttgtagttttcctcatataggcattgtacacattttgttagattttttacccaagtatttcattttcttggatcttatgtcaatagcatcatgtttttatttttaaattctaatttttcgttactggcacataagaaacctaccaactttttaaaattaactgtttatcttgcaaacttgctatattcacatatagtttcagaagggttttttgttgattctttcacattttctacataggcaatcatatcatctgtgaacaaagacagttttattcttttcttcccaatctgtatttttaaaagtttctatttcttatttcattagttaagtgtaccagtagaatgttaagtagaagttttgaaagaggatattcttaccttgctcttcatcttcatgtgaacgcacctagtttctcaccattaagtacgttaagcatgttagcgctagttgtttttatttgtttgtttattattttgtagatgttttttaagttgaagaattcctctttcctctttgttcataatttgctaagtattttcatgatgaccaactggtgcattttgtcacattcctttcctctatttattgatataatcatatatatttttcttctatagctgttgatgtgatgaattacattaattagcttttgaatattgatgcagaattgagtatatgaaataaatcccactttgctgtagtgtatacttttagtacattgttggattcaatttgctagtattttgttgagagtacaagtttctgaacaggaatttatttcccggtttccaaatttctaacaatttttcttggcttcttaagaaatcattataatacacctaatctattgctatagttgatacctgggctctccggttagcattatttttttcattcatgtctttttgacgtagcttcataatatgctttgatatatatcaagtcacttctaatagtctaaaattattctaatagcacttgtacatactcttacaaaggaaacttttagtcagattatcatattctatgaaaattccacttaaatattcatcggtatgtcctagaatttagagattaatactggtaaaccaatgcttataagatattaaaactgtatattaaggacaatgaaatattttaaacatttttatcttatgtccctcaaatattatttacaattttttaaaaaatattatctaagtttctttctagcatttaaaatacatttaaaaaatatattttcagttttgtttaatattttgataggatttttttctggtactttaagtgttaattcttcatgtatagataatgctcagtacagacttttagggagggaagccaaatatttaagaatcaatggaaatcttatcttttctatatcatgttttacaagcactaacactgtcttgttagttttctgtttaaaatctctgaatcgtgtcctatcatctaaaggataaaataatagaatgtcattgaagcaccacattatcagacattttcttacctctgcaatttaatctcttgtctcctaaattattttagcttaacttatcagtttcactcaggcctctattaaattgcgcatagagtctcatctatcaggaaaacacatcctttccttctgggctttttgtaataaagtatcatccattctcaaaaaaaattctaatatcttcctacaggttaatatttcccatcttctcatctctattgaacatatcttagcattatcctacatgtaattttctcgtattcccttcttacgctcttcttaaaagattgtcttggcagtcctatgaaatttagcaattttgctaattttttatgacagaaccttgtctttctctattttcaaaatctaccattatgccctgacctctacagttattccaacaaaacaccatttcttaaagtctgatttacaagtcaatgttttgccctgaaatcctccaggtaatgtctaaatagatctgctttacacttgtattttctaatacaaaaatacttacaccaatttttagctctggtaggattttataatttgctgaagaatattgttacttattttaaaggtgttctcccctttattaaagtttgttgggactataaagaaggaagttgattagtacagatcagcataaaataattttgttccttgacacaatctttagaacaaaatagataattactagtttagaggaatatacatttaaagaaggaatatatgtgccttgtgaatatgtcttatacatatatgtacaaatggaccttattatcttaatgaaatgtatgaaagatagttcataaaaaccatacaaattcttggtttcaggtcattttttaattgtgataaagtattaatataattcattacgtttgttattgtccaatagtgaattgttttttgcattaattggattcagaagctttcttggcaagaaaaaacaaatcaagctggcactatagctgttttccttgactaaaataatgcttaacaaattacttagaagcttgaaggccaaaacatacaggtacaattaacatatcaaataattatattgctccacaatttatagaaataagaggaaaagaacttttgttcttttgtttttctttttacctcatctgtaaattgtaccaatgttttaaaacaatttttatctcagattttaaaaacaactcaaaacttaaaagtattttggtttttgtaagcatttctccaaatggtgattgttttgtttacctacaatttcaatatttttagattgatgttcacattcttccagtaaaaaattaaataaaatagtaccaattgacaaggtatgtttgtttcatattttcttccatagccctcttttctaaatgtagctatgttcagagaaaagagataattcttgaactgtttatagaataagtactaatattcataaaatcaatttgattttcttctttttatgtagtatgtaattttttcagtaaataatcaaaaatataatttcataggtcaattaccaaataaaatgattttgtcattctgtaggcacacatcttgaaactacacctgtaaccttggcagagttacccatatttgacacttgtagcagcgcaattaatttatgacattcagcacactatcaacatgctctgactaaaaatccaagcaaatttcttaaatagacaaatttactctgatttctgaaaacctctagccacttacatgcactacatataattgcaaagccataatgaaattcagcatttcattataaaattcactttgaatttcagtattgaaatactgaatttcactttgaaattatttgaactttattattttaatgaaatgtatgaaagttcagaaaatattatggatgaaattacatccatattattttcttcctcaaattggagagctgagacctgctattttcatgagctcagtgccagtattgattgacaggccatgccaaaaaacaagtatcattctattctctactacaggtgactagaccacataagtattgtgtattatatataaaattttaaaaactattagaaattgtttttcataacaggacttgtctatttcaaatctgtttgttgaaattatatcacatattttgagaatatactacatggtaaacaatgagttatataaactaatgatttttctccatgagtggcagattcatttacattaataaattatccaaaaaatagcactgtccttcaaatgtgcaaactcaaaactatgcaaattgaacttacatacacttaagataaaatattctttaaataactgagaatgttcataattattattttccttctaaagattaaaaaagagttctactttgccaaggaagatactatcttacataaacagcaaagaatagggtatatttaatcacggtatataaaattaatactatgtcataacaataatctaagagatggaattattggtaaaagttgttaaaattattatatttttattcagcagttatccaggactatttagtagtaatacttaacacaccttgaatatttagtatatatcatataaacatgctgtttggtgggacaaaaatagttgacattgagaaatattgtatggttcaaaccaatatttatgtcacttaaaacttttgttagaaaatattattgtaacaatacatagatgaggatactgacatatcattgaatatggaatatgctcgaaatcaaacagtgaatggtggaaccaggaagggaacctttatctgtccaaagctgaaccactgtgttatactgtcgctaattagatgaagcagtttggtatgacagaaaaaaaatgccctgtactgagttataagactgctatttgtgttacagttctgctcctggcccagtgatcattaacaaatcatttaaactttataactttcagttttctaactatcatgtggggataattacacttgtgttctctacttcacagacataaaaatgaagtgcaaacttcaaactaaagtatatgaattgtataggcagagtaaataaactgaatgggatgagaataatttgggcaaaaaaaaatcagtagtaaagaaaggaggttaggagaatccttctgaggataatgcaagcagaaattgaaagtgtggtagtcatataacattcagtttatttgagatttggagagcaaaatgcttgaactttttcttaagttcaatatgaaagacagcattacaaagaagtgtgtgtggtaggataaaaggtttttttcctccactttcaaacagaacaggtttagagcagtgaatacatggctgagtagcattttaaggaaaataaataagaaaaatccctgaatgtagcatcagtaattgcaatacacatttctcaaggagcaggaaagaaataccgtaactataatacagagatcaagcagaatggtactggggtggtagatctctccatagcaggaaggaaaatgccagaaaatacaatgatcaaaatgaaggaatgtatttgaattatttacatctccaacgtatccaattatcagaagccattttaagcttgtgcagttaaaaggtgaaacttataattgatataggagatcagaatatgacatcccaaaatatgccactttagcataagaattattatgaattaaaggaaaatgacaattaaacacatggaaagctctctgccttctccctgtttgcctaaaagcaggacataaatttacgaaagcaaaaggatgcctccttacctctctaccaggaagaaaaaaggttgacccactgaagacaactttagaccctttcaattagagaccaaaggaatctacattagcaaactttgctaactcctattctcaaatttgctgtccctagagattcaaagttcttttaatttgtcttatcacttctctaaaactttaccgttttttgttgaagatgctatataagctaaaattcaaaaccacctcttttagaattattcatttctttggtatcttccatgtatatgtgaagtacacagggtagtaaatttgtctcttttttttctcttggtaatttgtcttttgttacaagggttcatctcagataagaagtatgaaggataaagagaaaattggttttgtcttacctacgtcaccatggtatcccatgaaattcaaggaaaaaacaaacacaagcaaacataacctaataaaacaaatgcattcaaagtcactttgagaagaggaaaaagaatcaaacttttggcagacaaaagataaaacccaaaataatgaaagagaactgttacttgactctcccacataattaaaagagcattttcagttatgaattaaacatttaaatatcaaagatagaaacaaacaatagtaagattagaaatggaatctaaactctgaagaagctgaagaaaacaattatatcacctcagaatttaaaaacaaagctgccaagtatagtacaacttactatacaaaatagtatgatagaagctaggaaagaataaagccaacaccatgaaaatagggcataaaagagatgaaatgaaacagagaaaaggatagtcaaaaaaaaataccccactctccaaaatgaccagaatacttaaagcaaaacttctagataattttcataaaagaaaagacatccccaacatgcatattaaaatgacacctatgttctttgtaaaactgactcagaatagttcataccttagacatactgctgagcttaggaaaaagttataaatgagcagtaacgtgaggaaatactatacaaatacaaccttttaaggagtcaactaatggatgccttttattcaatgaagagttgaatgggaaaacttaaaataactataagtgagtatgagtcactgggtaaatgaaaatccaggagttcacagtgatcatataaagacatgagaaggcaggaagagaaggggaaaaggatgaagagaaaaaggaggagggggaaaggaggagaaagaaaatgaaaacaagatttgctgccattagaggttagtattattctaagaatttaacataaaaataggtaatggaaaaatataagcattaactattcctttttacaaagacctgtattactttcccagcaaatgagagaggaaattacacagaagaatgccaagtaatatatgtagaacaaatgattgaattagaaaaaccaccattttgcaaactctaatcaaataattggtacaagtaagaatcacaaatagatgttacatctattaattttggggaacaggaaaattttaaggtgaaaaggttaagcagcaaaagctacttgctaagatccacagaaaaacttatctttgaaatgaacacattttatgatcattttcttaggcaaggaaattaatatcactaatagtgagacaacatgatattatcatatgtgctcatcaatgtgaattattaagtgatctttaaaacaatctcacaaaaagtttaatcagcatctaacctagcctttatgtctatcatcgaatttagaggaactaaaggaatagtgtggaagacacaaagaggaaataatcagacaaataaaaattattctgtaggaaaaattgtccagttttcttgtataaatgtcatgaaaaaataaagtgaagcaattgctttagaacaaaagtgactgaagaacaaacaataacctatcagtttgttgactctcatcctgacatgtatctggccaggccaataggtgaggcaattatgtttagagacaatgcacacagaaaggctgggaaagatcatagtagtagtaatagccttttggtctttgaaaatttgtagtttacttcttttgactcaaatttgaagcgtccagtcttatgacctttattcttcttttattctacttcacctggaaaatgctttattcttgtatttaatagaatgcttgaatatgaatgacattctagtctgtatttttatatcaaacctctcacctgaacatcactagattctaacatctctgtcagtgactatctaggcaatctttgcccaataattcaagttgtgccttagtgtgattacatataatatagaaataaaaataccaggctgacttacctcaagagtctattctaataagctaataagaaaatatatgagaagttctaaaagctgtgaaataatgtgcttatgataatttgcttagtcttccctcaggtgtatggatatataaattcccttcattgaggtgggcagtatttcacaaaggtgcctataggcacactacctccatagagagctaataaaaaaactaatactcttgaactttctaccaatgctattttcttgagttcccatgtgatttatgggcctgatttcagtcaatatgtccataataaaaaaagattaagtaacacccagtccttgttttccataagtaaattaatcaattttaaaatgtcttttctcaacccaatattaagaaggtcaaaagcttcttttacaaaaataataatatggttgaaatttgtacctatagtagaaatagatgactgaatgcttttttataagctttgctcctttaaaataattttagttatcataaaatttaaaagatacattgagccaattttcctaggcatgtacagaaagatagtaatatatctacaagtgtacaacgtaggctggtgtattccagaataacagattctgataacagatcagagaacatcctataacacataggcacacaaactgcaggccaatcacaaggaaattaaaaacaggcctattctgatgctatgttgtgcttaaaacaaatcaatgcaaaggcaataacaataagaaagaatttaataaaagtatttagaacactgcaggaaaaatatatatcaaattgatggttgtgactgcccgtctggagcagccactacagtgatgccagctgcagtgttggaggagcagacaggggtgcatgctcccttgtgcccgctccagtgtggagcaaatttgtggctgagccagggtgctgctgtgacctggccagttgtgcacacactccaggcagcactgacattctagccccctgccaccatggcaccctccagactttgggtgctgacgagtgtgggagggaggctggggactgagggtgactcagtaccagcctgcaggaacccctccacatgaacatcctgggtgctatggatggcatgttgatggtggcgagaggcaggtttttaggtgggaataggcaggttttcagtgaagccccaccttcaagccaggaatggcttgaggcctaggggctaggctaccagttctggagtgggaacttatgctgatttttccaggcccacccatggctgcccatggaccaatcagcatgcacttcctcccttctgagaccataaaaaccccagccagactcagacattcttcagggtgacctgcctgctggaaggagctacccacttcgggattcctctacaatcttccagacaactgcctgcagttagaagctacccactttgggtctcctctgtactctttgggatgacctgcctgcagaaaggtcctaatcactttcggtctcctctactctcactgggacaacctgcctgcagataagaggtacctttgggtctcctctacactctttgggatgacctgtctgcagataggaactactcacttcgggtcttctctactttcactgggatgacctgcctggagatatgagttgcccactttgggtctcctctacactcattgggatgatatgcctacagataggagcaacctaccttgggtctcctctctgatgagagctgttctgtcactcaataaagctcctctccacttcgcttaccctccagttgtccacataacctcattcttcctggatgtgggacaagaatttgggatccactgaatggtgggagtgaaaggagctgtaacacttgcctgggcagctcgttgagctgcaggcagtgacatgctcctggactgtaggagtgaagagtggtgacgtttctgggagcccagaccttggtattccctaagacagagctgctgtaacactacagtcctgctgctctctgctggcactgggcagccaccccacgtgatgggaagcagtggtgggactggaccagcccaggaactgtgggccagagcagggtggtgggactgaaagagctgtaacataaatgggctgaaacatatctccccccatttgccacacaacaggcgatgagaaggagagaagagctggtgcccttctgggagcccagaccttggggctccctgaaccagggctgtgatatattgtgacacttttgggggctctgtggttcctggcatcttcaagattttgggtaccacagtgttcccctcatctagacacagctgacaacagtgggagctacttgctgtacattgggtcaagccatggcctcacacagaactggcacctgtgccggctcctggagctgcctgccttgccacagcagctgggttgcttgactgtgcactgtggctggactccttgcttgctcattcacacacccctctctactccactcctggctaacctttagcaggcatgggatccgggatggtactgccagccaagaacagcctgctgggccaagtgggtggaatgagcccagaaggcatgagaaatactcaggaagaaggcaccaccaaagacaaaggtttctggctagtgaagcaacacctgaaggatcctgtgacagaactgaactctgtttatgaaaaatgcgtacttgaaaatctgagaagatacaggcttgactactaaattccaggtcaagtacatctaactataacacatctaatttcatgtcataaatctctacgtagaaggttttagttaaatacaagggttttttgttgttgtttctacagtgattatcaggtgctttatgaaatagtttttctgacatttaaggaaaatggtgagtcccatggcccagtaaatcaaactagtatttctcatcctttctttccttagctgctaccataattctagtcttcagttccactggctgtaggtaataaaggcaattcttcctggaaggtgtcagtggcaaaagaaggatagaatatctgcttaactgacataaaatgtgtttttttttttttactattttaatggaaatagattgggttgaaccccttatcccacattctcactaaaatatctgtatattttacatctcagtaacattttacctcccgtatttttgtttcattgtttttctgtagcaactcttcgtgtaaattaaccagtgttcatgggttttccctgaaacaattcacttgactgaagatgttaagatgataagtttgtttcatcatgcagcataatacaaatgtaaaggtgaatattaggcaacactgtatttaaaaatcctttagcttccaactgaaagttatcaccagccaccattttgcaagatcctaacctggttattttgctagaactccccttttcaacttaattctctttcaattttcctatacagaccactttatctctgtacactgtattcttttggatgtagtccttcattaatgtgtttgcaaaatcaaatgccccaatacaattccagggtgttgttctaggtcccatttctcaccaaacagaaaggcaatcactgtgacaaaaattgccagggaagaaatctttacttggatgctacagctgagacaatggtgatgggaggtcaatctcaaatccatctcctgaagaggctaaaactagggaaggaatgtaactacatgtggggaaaaaagaattagggacaggtaaggaagaggagttggcaacaggaagcaggtggtcagttaggccatcaagactagtgaggcgtcttgtgtctcattgttcagatatggtgatctggtcagtttcattttcttggtactatctggaagccctgacggttggtttcctaagaaaagaacttagataagacaaatggaactttttcaagttttaaggctggctgagtcaatttctatgtttattcaaaagaaaccataaacattagttcggtggggcaattgggctagtttcaataccaggactaaacattgccagaagaactggcaaatattttggaatgtaagtacatttttgaccctaagtccccaaacacttagaaagtagcagtgactttaatcacttttcatataattatccttactctcctattataagaatatttcctgccaattttgtaggaggaaactgtatcagcctggaaaaatatggtttttctgtgatccctctgatctcatgtgctcattactggagtacatattctcaaaattgtataaagtgtgtggtcccattgtttccccaacaagatccagatatgaagacaacctgttccctttccatctatcacactgtgaatattcaaaaacctataagatccttaaaacatttagaagacaaaattatgttaataatatcactgatagcgtttgcaagggaactctaggaagtaagaggccattttccctggggcttaaaattacattatttttatgtagaggtcaagttctgaaaggcaataaagcttttaattacaattcccctgaaccacaaggtggaaaaaggtataactgcctcagagaccactaggaaggcactaatgaatgataatgtattctcagcagtcagaaagagcagccaactctgagataatgtgttacaacttctgtagcttttgcaaacacataggaaaggttttgttaatttgtagaatacttgaagtaccattttaaatatatttgataaattacattttactagagatctgacacaagagaatattagctataagctgcatattaagtatgtacatattaatctaagcataatcactgtaagttctgacccattcatgggcaaggaatgaagttactgctttttgaacaaaatacaatattttgcaagtaaggtagaaggtaaggtagtataattaccaatatgtatctcacatagtggcatggtttggttgtggccccacccaaatctcatcttgaattgtagctcccattatccacaagtgtcatgggaaggaaccagtgggaggtaactgaatcatgggggtggattttccccacgctattctcatgacagtgaataagtctcatgagatctgatggttttataaagggcagttttcctgcacacattcttctgcctgcttccatgtaagacgcgtctttgctcctccttgaccttctgccatgattgtgaggcctctacagccatgtgaaactgtgaatccattaaaactgtttataaattactcagtcttagtggtttcttcataacagtatgaaaatggactaatatgcatagtatggttttgtgaaactttgcttcatatatatatatatatatatatatatatatgttgggtatatgtggattagcttgctatgtctttgaaaagccacattaattttttttcataagaaaaccacatttaatttgaaacatttcctcactggggtaatcctgattaaaaacaaccttttctgtgaatctaaaataaaataaactaattaatatgaaaacacatagcttaactcttcatgtagtttactcatgaaaaacaataccaaaatcattaatatcacatagatacccacacactcatatatatgcacacatataatatattatgtaagtgtatattatatatgcagcacatattatataatacataattatataatagaccttatataataaatgcatattagatattcatttattgtacacacataaatatatcatatatattagtattaaatgggaacaagtaaaactgaaatataaatcactaatcatacagaatattctataggaacatggtcaacagcattcaagtaactacttagacttcagttttgctgaattgagaatgcaggctaagaacagaagctggattactaagtaatttttttaaaaaaatattgttttcagcatggtagggagaaaagatagcagcaaggtaaaaaaaatctggaaagaatagctagtttctgtttttgtttatttattttattttatttttatagctttatcaagccataattgacatagagtcatgcactccttaaacatggggatatattctgagaaacgtatggttaggtgatttgttcactgaacatcctagaatgcacttacataaacctagatggtatatcctactgcatatctaggttacatggtatagcctattgcttctaggctaccaacttatacagtatgttactctactgaatactataggcaattataacaaaatggtaagtaataatggtttggctgtgtacccacccaaatctcatcttgaattacagctcccataattcccacttgttgtgggagaggcacagtgggagatcattgaatcatgggggcagtttctcccatactgttctcatggtagtgaataagtctcatgagatctgatgtttttataagtggtttcccctttcacttggctttcattctctttcctgctgccatgaaagacatgcctttcatcttccaccatgattgtgaggccttcccagccacgtggaactgtgagtccatgttacctgtgttttctttataaattacccagcctcaggtatatctttatcagcagcatgaaaatgaactaatacagtaagtagttgtgtatctaaaaatatctaaacatagaaaaggtccagtaaaaattcactatgaaagataaaaaatggtacacctgtatagggcaattaccatgagtgcaggctgcaggactggtgttactttggatgagtctgtgagtgatgagtgaatgtgaaggcctaggacatcactattactcagctttagactttataaatgctgtatatttagtctacactaaatgtataaaaaaactacaatgttacagtggctacaaagtcactaggctataggaatttttgagctccactataatcttatgggatcaacttcatatatgtggtgagtcattgactgaaacattacattatgcataactgtgtattaaattgcacatattttaagagtaccactggataggtgttgagatacacacatgcacacacacatgaaaccatcaccaccatcaaggtaattgaagtaatcatcagctccaaagtttccttgtactcctttgtaattcctctttccctttcttttgccaatgtaacagtattgatttttttataattacatataaataaaagtataaattatgtatattttggcttctttcacttaacataattattgggaggctaatttacacttgtgtagaaatatccagctcatatattttacttctgagtagtattccattgtatttctttacctgatgatagatatttgggttgtttccattttctgggtattacaaataaaattgttatgaaccttcctatataagctgtgttagttttccagggatgctataacaaaatactgcagactgaatgctttgaataacagaaatgtatttccttacagttctggagtctagaagctcaagaccatggtgggagcagttgtgattttttctgaggcctatttcctcaacttggggacagttatctttttgctgtgtcctcacatggactttcttctgtgtgtgcacctcactggcatcaccctatgtgctcagtgtcctcatagaacacaacagtcaaatttaagtaggatctaccctaatgccttcattttaccttgtctccaaatacagtcagactctaaggtattgggggttatagttttaacatacgcattttggggagtcacaacacaacctataacataaccatttatgaccatttgcattatttcttacacttatacatacatataggaatggaaagcctgggcttaatggtagacgtatatatgtacataactgttcattaaactgctaatctgtattccaacgtggcatattatttccaccagcatcccactgtctacttattatatcaattagtaagagacaggagtagaaatgttcaatgcaaaatttggctttgtcattgtttccctgcagttctaacagatgttgtttcattattgttaacatggtatataatttcatatccttttattacaatctatttgtcttggtattcaccttcatttttgaaagatatttttacagactatggtttatagattgacattttttttttcttttcaggattctaaaaatgcttcttggcagtctcctaccttgtattgttccagatgagacatctgctgttgtctttgactgctttattcagactgcttttaagttttaacttttatctttggctttgaaaatttttattatgatgtgtcttactgaagttttcttcatgtttttctcatgcttgggatttgttgagcttcttgaatctgcccgtgtgtagagtctgtcgaatctggaaatttgcagccattgtgtcataaaatactttcccttcctctttcaagaatatcaatcacacatagccatttgacattgtcccatagctcatggatgctctgtttattttggcttagtttattttttctctgtgtgtttcatttcagatagtttttattgttctatcttcaacatctctagccttttcttcaaacgtgtttatttttttgttaatctgttaatcctatccagtatatttttcatattagacattgcattcctttttcatatattccatggctctatttatcatgctcataatttatcttcatgtacatttagaatgtaataacattttattgtccttgctattaattctatcatatctgtaactctgaggtctgtttctattatttttttttttactacttaatgggtcacaatttcttgctttttaaaatacctagtaatgtttcattggaatattagacattatacattttacctggttacatgataaatgtctttctgtttcttcagatattcttgaatgttgtgctaggagagaggcacattacttggaagcagtgtgatcctttttggtatggctttttttatttataagctgtgttaagagcagaactcagtagcaggactaattatttcccactactaagtcagactccgtctgaatactccaaccaatgtagaatttttccattctgtgaattaattttccaccctggccagttagaatataaattattcttagtcctatgtgaatgttgagatgatttctctgttcttttcaggttctttccatagcctcaggtagtttccttagatgtctgtgccaatcaacattcaactgcagacttaaggaagactctgcaaatctcatggtctgcccctttgtacagatgttttctcgccagtattctgtgatatgaattctagctgccttagacttaccagtcacctacttttgcctcctaaactcagagataccttcatgcttcacctggattacctctgaaaagtagctcaaaagtatcttcaggctataatccagcataatcacagtgttcacttcatttgtctctcctctctaaaggaacactgttctgataaccaatatatgaaaatgtgttttaactaacttcatttcattttgtagttgtttcagtcagataggaaaatatagactctattactctatcctggcttaaaatgaaaattccccagagatgttccaattatttgaagaaatttttgttgtctttttgcaagccttcctatggtttgaatacttgtgtccctccaaaattcatgctgaaatgtaatctccaatgcaacattattaagaaatgagtccttaggagatgattaggccaggagggctttgtcctcctggattggattagtacctgaagagaattagctaggcccttttgtctttctgtcccttctgccatgcaagtacacagtggccctcactggacactgaacctgctagtacctttatcttggatgttcagcctccagaattgtgaaaaataaatttctgtttatataaattaccctggattctgatattttgttattgcagcacaaatgaactaatacataaattggtaccaagaagttaggtatttctataataaacacctagaaaaatgaaagcagctttggaactgggtgatagctacaggttgaaccataaagtgctatcttggggagagctcagaagaaaaggaaagctgtaaagaaagccagagattaagtggctgtgattagaacattggtgaaaatgtgaagacaattctgataaagtctcaggtgaaaatgagaaacaaagtacagtagtcttttatctgtagatttttttctgcagtttcatttacccatggttaactttggtttggaaatattaaatggaaaattcccttaaaaaaactataagttttaaattggttaccattgtgagtagcataataaaatctcttgccatcctgctccatgttccatcctaccctggatggaatcatcactttctacacagtatccacactacctttgctacctgcctgttagtaacttagtcactctgatttgtctcaaaaattattcacaggcctcaagatttaaagttgttttccttgtggggttttagacttccttgggacctgttactgctttctctattactaattcttccttttgaaataaaaatatttatcatatgtttgttccaccattgagttttggaaatacctaacttgtttgatttcacaggttcacagcagaagagcaaattcctcagaatgaattgtgccttgagccaaacccatatctaatttagatgagactctagactttaggattttgagttggacctggaatgagttaagacttttggagttaatgagatggaatgactgtattttgtacattagaaggatgtaaattttgggggtcaagaggtggaatgttatagttttaatgtttgtgtcccctcccaaattcatgttgagacttaattcctaaggcaatagttttaagaggtggggccttgaggaggttcttaggttatgagagcaagccatcatggttggatcagggccacatgaaatggctgagggaactggatgggtccttttgtccttccatcccttctaccatgtaagaacacagcatttctccctgcagggacatgtcaaaaaaatgccatcttgaaagtacagcctgggcccttactggacaacaagcctgctagcaccctaatttcagcttccagtctccagaacagtaagaaataaatttctcttctgtataaattacccatctaaggtattttgttgtagcagcataaacaaagatggcagtacaatgtaaaatctttcatatcttcccatgaaatcttcagtagaataatcagttaataacaaagtgtgaaacgtattttggcaagacacagacactcttcctcccacttcaataactagaatacagatgtaaacttcaaattaatttgcgtatcaccagaatctacaactatatttggcatatagtaaacacttaataaataattgatgtataatgtaaaggcagccatggctaagaactaaatattcccatacgtatatataaactcaagttttcagtttagtatagatttctaaatataatttgtcattaagttctctggtttagagtaattaagaaaatgttaacactttctatatctacatttggtatacctgtagagttaattataccccaccttccccaggcaggacactgtcgattccctgatgtcattaactacggatacaaacacaatcaagaaggaaaacttgataggcattctgagaaattgctttagccgtagactgttagaaccactctcccatctacttcccacggggcttcaaaaagggaaaagctctgtgtaaggtacaatataggaatagtacatcaagatacaccaaattataaacttttatgactttgtgacaatctaagttacaataatgccgcatataaagcccttttaatatgtatttgatatgatttataagaatacttggctgggcgtggtggctcatgcctgtaatcccagcactttgggaggccgaggtgggcggatcacctgaggtcaggagttcgagaccagcctggacaacagggtgaaaccccatctctactaaaaatatgaaaattagccaggcatggtgataggcacctataagctcagctactcaggagacttaggcaggagaatcgcttgaacctgggaggcggaggttgtagtgagctgagatcgcgttattgcactccagactgggggacaagagcaagactttgtctcaaaaagattaaaaaaagaaaaattcaggccatacgtggtggctcacgcctgtaatcccagcacttttgggaggccaaggcaggcatatcacgaggtcaggagatcgaaaccatcctgggtaacatggtgaaaccctgtctccactaaaaatacaaaaaattagccaggcgtggtggcacgtgcctgtagtcccagctacttgggaggctgaggcaggagaatcacttgaacccaggagacggaggttgcagtgagctgacatcgcgccactgcactccagcctaggcaacagagtgagactccatctcaaaaaaaaaaaaaaaaaaaaaagaatactcagagatttttacctagcaaatacactccttagaattattttataaaaaagaatgaggtattattatgaaatatttaataacagtgataagttaaacttacaagaataacaatgatataatattattaaattattaaaattataatgatgaatgctttgtggccacatggaaatggttatgattaataaagtaaaaatatagagaatacaaaaatcaatctatgatgctatgtgaaaatgtgtgtgaacatgaataaggattggaaaaggaatgcagaataataaaaacacctggtttgttaatgtggctacattgtgaataattctttacaaacacacatatttagagaagaagttgctatgcaaaaggctgtgtgcagatcaagtgtatatgttaaggctaggtttaatgtgggttatatttatagatatggaaaatcagttttcattccttgaaacctctctcaaattaattccttatatataccattagagattaaattttttaggttgcataaaaatatgcacatttgtaacccaagggtgttttaatttgcatctgtgcttgttgcagaagcaacactggtaatttgctactattttgtgcagttagctcttaagggctttggaatctttatttttgctcccactttagaatgccctaatcatgcctgcttgcagtagtttcagaattggctcaatactagtgtagaaaacaagggtgactgatcaagcttcattattgcttacatgagcagacaactgaagtgacagaattaggactaatttaaatgaaacatgtgccttgtctcatgtgaagaaaatgtaaggcttactgacatcatgacagttaaaattatctaagggagttgaagctagatctggaaaaagaaacaacctctatcatggaataaataacccaaatagtggtaaacatatacacaatacacaaccacacacacactatgtatttgtaagagcaaaagaattatctctaatcattaaactcatatctctaaaaatctaaaattaaaaagtaatttcccaaatgtagataagtatactacttgtgcctttatttactaaatcaggaaataaagcaaataggctaaatgatcttatactggagactctcatactagccctctctctctctccttccttctctctctctctctctcacacacacacacacacacacacacagacacacacacacatacagacacacacacacacatacagataatataggcacaatggcacagcctaggagactaaagcaaatgtctttccaattaagataatatatggtaatttaacagtctttgacaaaactcagtgaacacaaagaagctaaagaagtattatacaactgagcatactatcctccactaagaaaactccttttacattgatacttcatgtctataaaaaatttaaatatattaatggcaaataatgtaatatacatgatatatgtatgcatataatttagcatactatgcttcactaagaaagctctatttatgttgatactttatgtccataaaaaatttaaatatattaatggcaaataattcatgtaatatacatgaacgtgtgtgtatatatgtatataatagaaatgtatagatatataatatacatatatacttggaaattatttttatattcaggcaatgcataaaaaatatttccatttacctttttactttcttaacattgaaattccctggccttctcttcttaatgaaatgattcttttgatctcagtaaaataaatatatatttccatgaaaacccttcagagttgtaaaaggttgaataagttcagaattctgagcagccatcaagggcatatcctttgatacagtttgcccttaccatgtaatgtggtgtcccagaaataataaagttaacattgtcctgttaatgcatatagaaagtagacatgaattttagagaactttttcatgcatatttatttgggtttaaggtaaatcctaattattatttttatagaggatttcaagaattgataagtttccataacatacttagaggtgtgcagtgtcataaatatagcaaagtaagacctcaggtcaagtcctacagggcaagcaaaacacacatcttctcagctactagcttttctattggacacaccctaaaagtgactaatttcatcagtgaacaccttgagcactttctacatgctgagctttcggtgtgtaaaattagaaatatctccaatatattctcatttggtctatttgctttctgttatcccatatcttgattatttgagaaatgcttttcctattagattttcgaagatattaatgtagtcattaggtgcctatagcagatattcttgaggtcactccttgatacctgtgtgatctttcacaagttacttaaaccttctgtgtttcaactacctaatttaggtaactctttaatacagatgtaaagaaaagagtgtgtatgcatagtctagaagagttgctggcacataataaggacttaatattttattgatatttctttccatattgttgttagtgttttgcggaaccgtagatgtgtgaactgactgttaatatggtgtgtgatatataaatcatgtagggaggtagaagagctcatagcagtaacaactaacagacaaggtagatggagtgatgagaagtggtggtggcagagaaggctttctaggagaggtgacttttgagataaacattaaagataactagaagttagtaaggtaaatgaggcagaaagagagagacttctaaaaagtaaggtcacaaagtctcttagttaagtgagatatatcatatgataatacggtatttgtatgataattgaattgaaagtttagtatggccgggaaaacactgtagaatagaaaaaaggaaagtgtcaaggaaacaataaggctatatcataaattactatgaaatttatgtaacttgtaaattagcacactggggaatccctgaatgactaaaattggttatactgtcagttatgaattttagaacgcaagttttttttgaaattttattgtccttaagttgaagtgtagtgtctatggtaattctgtttaccctgaaccatttcttccatccttaagtgtatcatggaattttaaaagtgtatgaaaacaactggttacctggaattgagcaatctctcagcctagcaattatcttttcaaaattatgagaaaatttcatcagttcactaaattactaatattgatatttgaggaattagagtaaaagttgtagaagatgagaaaatgacaaatattaatttcaaagaaagaaaacaaaatatcagatatagtcttaaaatcaatctcaagattggttctagaactattgtctaattgtccaacagtttcttcctgcctgctgcacagacaaaaccaattcactgagaccatggtattgtagttaaaaaagagtttaattaatggtaggctggtcatgcagaagaaggagttttactcaaatcagtctccccaaaggctcagatgtcagggtttttcaagcatagcctaattgtcaggagactagggaaagggtgctgctgattggttggggatggaatactaagggtgtggaaaacagtcctcatgcacttattccacctctgggtggtgccacagaaccagttgagtcacgagttgtgagttgtggtaatgtcagtctgaaaaatatttcaaaagaccaatcttaggttctacaacagtggtctcatctataggagcaactggggaagtcaccaatcttgtgacctctggccacatggctcctgaacagtaagggattgtagaaattctgcctacatcttagcagaacttagattccttgcataattctaattttgtttactttcattaatcttacagaggtggtttcagcccccatataaggaggggattagttttagggaggaactgttatccttgattccaagttaaaccataagctaaattcctcccttagttagtttggtctacacctaggaatgataaagaaagccagcctgtgaggctggaagaaaggtggagttagaatattagattttctcacagtcataatctttcaaaggtggtttcatttgttcaaataatattaaaatgaccataaagaacaatgattcactggtaacttgcacaactgctttaagagtaagttataacagattgaactcaattatttcttaaatttaagagattggaaaatgatgaaagtgtcagaggctttcacaccagcgggattccatcttgcatagggtctgggtaaaatgagactgacacttgctgggctgcattcataggagattaggcattcttacaagatgagaaagaaggtcagtaggactggtttcataagacacaggtcataagatacaggtctgctgataaaacgtgatggtaaagaagttggccaaaacccctcaaatccaagatagctatgaaagtggcctctgatcatcctcactgctgattatactgtaattatagtacattagtacactaaaagacactcctatcagtgccatgaaagtttacaaacgccatggcaatatccagaagtcacactatggggtccaaaaaggggagaaaccccaaacctcagctccaggaactctccaatcttttcctggaagactcatgaataatccactccttgtttagcatatgatgaataaataatagtaaaaatgcccaataagcagcccttagggcttttctgcctatgaaatagtcatccttcattttttttattttccaataaactcgctttcacgttactctgtggacttccctgaattctttcttgtgcaagatccaataaccctctcttggggtctggatcaggatccctttctggtaacaaaaatacagtgtccttttgtatttggtattcacaacattgtatttatcataaagatatttgacaaattcttacagaaacattgtaagcatatagcacatgttaactaacataaggacattcagatagaataattatcagaaggacaatattgaaaactatctaaattatgtacaattttattctttgggaaagcctctcatagcatttagtcaatttatagtcttagcctagttcttaatatttcttacctataacctgaattaaattcgagaaagcacatcaatcatacatatgaatgtatattgatgacaaaatatttttataaaaacctaaatgcatgaaataataatgttatgacagccaaactggctaaggtgaaacaataaattgaaactagtaaaggtaatatagagaaggtaaagtttagcactaacctcaattatataagtacacagggagtctgggtttagcaattatacctgtgaagtagtggggattcagtttggaattttagtgatagtcaaaacaatatgagtagactatgtattataactggtaaaaatcgtgcatgttatacgactactttgaatgagggtagagataattttacaattattataatgtcaataatgcccaagacttgtataagtgtataacagattagaatatgccacccaaattgtgcctatttgcataagaactattataagctgattatgttgggaagctgtagacacagaagaagctttaaaaacaaagttacccttttgtagggaaatttacatctatgaagaaaatgtccatttttaagtgggtctatctctctgttttccaagaagactcactagagaagatttaatagatactgtaatcaatggaaaaggcattgacttaaatctgcatatcaaactctaccttttttacctgctttttggtcatcttcccataattggcccccctcaacattcctgttactttgttttatttgagatgctatttaagcctgagttcaaagctatctctttaagatttactaattcttctacatttcttccacatctacatgaggtatacatgttagtaaaattttgctcatatttctcttattagtctgtcttttgtcatagggcaccccagctaagaattcagaatgagttaaaagaaaattactttccttcctctataagtgctataataaaatgaatttatttaattttagctacaatcttgtgatgtaaatattatttatcaattttataggtgaagaaacaggtgcagagagattaaataattgcccaaggtcacatatgtagtaaagaacagagtgatatggctccaaagctaatactctcaagcaagacactgcattttttaaaggtaaaatgaccattcagaaatgatttgttatggtgataacaatgctatatgaggaatggatagttgaaatagaaataaaagtttatagaagaaattactgaagttcatggtaattgacttcaaattatttgaatagttctcttgtgaaaagaagctggacttgtttctgtggcttcaagagggagactaggatccaaaagaattttattttcctgccaggtgaggtggctcacacctgtaatcccagcactttgggagcccaaggtaggcaaatcacctgacgtcaggagttcaagaccagcctggccaacacagcaaagccccatctcttctaaatatacaaaaattagccagacgtggtgatacgtgcctgtagtcccaactactagggagactgaggcaggagaatcgtttgaacccaagaggcagaggttgcagtgagctaagattgtgccactgtactccagcctgggtgacagagtgagactgtgtctcaaaaaaaaaaaaaaaaaaccagaattttatttttatcaacagaaaaatggataaagaaaatgtgatacatatatacaatgaaatattatttagccataaaaaagaacaaaatcttttatggctaaatattatttggccatattctacgtgtaacatacaatatgtgtaacatattgtaacataaaaagattttaaatactttttaatgcaatacttgtctaagataaattttggttaatgatatataaaattgtagaattgcagagttccaggaatgaaatgtagataaatgtgtcttcaataatagtgacaatattttgtagtatatttaacatttgtgaacatctgcaattgctctccttaaccagtaaatgggcaatgattggtggccatccattacagatttaaaaccttaacccatttatgcctgaggttgcaattttttgaaattttgccatcaaaccttggagatgaccttgagcagtaggatataaataactttcacatgcttggcattccaataatggaatactaggcataattaataccagcaaacaatccatttcaaaagaaagattaatgtgctcacaaagccaattagcgtgctctaagtataacatttacacatatctatatttaattttccttgatgtatcttcaattcatctaatgaaaagagagtaaatactctttttttaattaaaaaatatcaccaggcaaaacatttcttattttattatatttcttattttattgaattaccattaagtcattacccctaaacagaaaattattttctgttttctacattttcctctctttttcaagtattctgcatttagtaacatatttaggctgcacatttttctcaacctatctggataattaactatacaccctagatttttaactctcattttgacctactatatgtggtagtatattgatacactataaacattatcaaattcacaaattagtctcattatgtcttttactttctgagtattttcttttgtttgattctctacttttctttatgttacacttttcaatcaaattcattcataatttaaattgatttttttcaaatttaggtgtatttttctattaggtaatttaatagacgatttattgatattaaaattgtaccgtggcataccataaggctcttgagttcattttttcagagtagagaaattgaatatagaaatgagtgaaaaaatctacctgattttcatagaaaattgctcacagaaagaaagtgaactttctttaaaacatgtataaaatgaaacgtacatcttatgttgtaacccaagttcatttgggccactttgaaatgtgtttccatccatcaaagttaaaaaaaaatgggcaaaaagcatttaatactttcaaattgtatccaaaatccatgaagaaaaatatatctacattttgattctcctcaatggggaacacaaaggaatgctgcaacaaacaaaaactcaaaacgaatcttctttagatacatttcaccatcccaatacatttcatagcagtaggtgaaatctccagcttcctccccttctctcgtcaatgtaaaccccatggatgtgttgttcaccaattaaaatccttttgtccttgccataccaaattccatcactatcatgagtctaaatccctaccttcacatatcttgctcactaccctactccctggaaaattctgatgaatacaattttttatcttgtatacttctataaggaggtattattggctatttttgtatcctgaaatcaactatgatataactactggttagttaacacagaagtcagcacctgccaaaacacgactgatgaaaatttctaaatggtagggcttactccatatcaaaccagattgccaagagataataacgaagagatttaaaattaaactaaacaaaagggtttttttctttgaaaacttggcctaatcgtaaggaatatttcttgtgtcaatatattctccattctttctgcagaatcacaataagtaatattgatgaaatttgctgccaagcttcagagtttgtttgtttacatgtttacttatttttcctggaaccccccacctcctttaattaattaattttgagacaaggtctcattctgctgcccaggttgcagtgcagtggcccaatcatagctcactgcaaccttgaactcccaggctcaagcaatcctcccaccacagcctcctgagtagctagaactcttggtgcacattttgttttccttttttttttttctttatagaagagacttcactttgttgattaggctcttctcaaacttctaggctcaagtaatcctcatgtcttagcctcccaaactgctaggattacaggagtgagccactgcacctggcctgcctagaacgttggatttacagatgatcttatccttacttcagagccgttcaaaaaacaaagctgttataaataaacagcaattatgcatagggtatctttcaataaagagacgtaaagtgatgataataatcttgaacattattgaactcctcttgtcttcaatattatatttcaaatgctagaggcaatatagacacaatcctatggttagggtacttgaaaaacagtgaagataaactaaacagtatgtagaaaattataattaaacctaacatatgagtagcctagacccaaaactatatagcttcaaaaagagtcaaagtttatctatatcaagtttgtaaatcaagcaagcatcagaacattattcacttgagataaaacttgaagaagaaatattatttgcataggtaggaattataggaaatatattttagaagagagaaacacaatttactactcataatctgatgatgattaaaattcaggttcacctcttgcaaatatgtatgaactatcctagggctttgatgagatgctaaaggataatgataaatacattacacaaaaagagtccaacaatatggttgttacagtgaagattttgggcattagtaaaatcttataaaatctactttctaaaaatttttcagcaacaacctagtattaactgcataagttttgcattgcttctttgttaacctagcaattttactgctgatttttaccctcaaaatgtaagcattatattgataatatctagcaaatattaataattatgtactacacattggcatttattatcaaacccaatcttcacaaaacccctggagctagattctatccctgtgttacaggcatataaacagagactccaacagcttgagtaatttgaccccccaaaatagagctaacataatgtagagcctacttacaacattcagtctgattttacaagttatgttctgaacaatcaaggaatgatttaagcttctctgagtaggcatatatcaagtttattaggaaacacaaacactaccaatgaaaagcctattcaaatacatgttaaaactaatttaaatattataaatattaatacttgatttatccatcaaatcctttggaaattataagctaattttatctcaactgttactttaggtacttgtcaccttagcataatcaaataagactaagagaacaatcaggtagttcttaggctgatcttgttatttctgaacaatatgatggttcagttctatgtgaaggtcaaaataatataaaaattgaccaatagtgtgtaaaccttgtcatgaaaaaaaattttaaatgtatgctgacagtaaatgtatgctgacatcatgcatggtgagtgactcacaattttgtactacataagaccagaggaaatagagcttagcaagttatttgtcctggagacaactaagtgttcttggaataaccaggcctgagaagaaatagtaacccagggtcactattgattaatttaatttctatcccaaagtttctcagtaagagtctgaacctattgttcatctcactaaatgttattataaccttagcagttcatgttagtatgattcttaatcctaaagtaattgggaaaagtactattaatgatggctggtgttgatcatctgagctgatcccagatagaaagaagctatttcttttggtgggatcaaattccttggggctctgtttggctacaaatgattaaaaagtgagtttattccctgtctcccaaaatgtctcttccactctgtacctcctccccattccctgtaaaaacagagataacacaattgatagaaagtgattcaagtactccacattagaaagttagaaagtagcataaacgctatatatatggatttctggaattccaaggattgaggaaatgaggaggaggcacctagaaagtgtaagtagagaattataagaagggaattaaaagtaaaggctttagatcatgactagaggtcaattcctatgaagggactgtcagggctcagaagctgacaccccaaagtatggtggcttggcatgctgaatactttaacctgaagatttgaaaggcctgagaaacaaggtccctctgatcttctcctgccctcttgtctctacccctgttttcctcttctccccacaagtgagggaaaccaaaatttaccttccccaaggaaggttgaagctagagctcctctccccacgcaagtcataacggtaacttacagtagtcactctctcccttctcctttttcccttggagactctcattacagagagatcctgccccatgcctgtgaggaagaaatgcaacacagagaagccaagaatctgaacagacaggccttgctgtgtttctcagtctgttaccatcagcatatccttagtccaatcacattttctacatggctgtccattcttaattgaacttaagcataaaagtagacagcttttggctgggcacagtggcgcatgcctgtaatcccagcactttcagagtctgaggtgtgaggattgcttgagtctaggagtttgagaccagcctgggcaacatcgtaagacactgtctctacaaaaaaaatttaaaaattagctgggcatggtacatgcctgtagtcccaactactcaagaggccgaggcagaaggatcccttgaaccaaggaagcaaggctgcagtgacccacattcatatcactgcagtccagcctgggccacagagtgagatcttgtctccaaaaaaatttttttaaagacagttttccctgagtcctttggtctcccagtccttcagtctcttctgaagtcttctctgtcacatgaaactttgattaagtaattttgtaagagttttttcttgttatcctgacttttgttataggagtattagccatgacccttatgatgggtaagtaaaagtatcacaccctttccaccctcccagggctttgaccaacattatatgacctatatgttaggctaaaccacgtgtaaaaatgaagatattagagtattttttgacctacaaaatgggcaattttatattcttcactctaataaattaatgtttaacattagatttgcaataactaatttcatgccttaggtatattatggtatctatatacaatttgtgaatcttagtaaacttttaagaaattgaaaagagatatggactctcaataaaaagggatagaagtttgatatacacatatattcacatacaaatatttgtgtttatactcagatgtatgcatatatacatatgcataagtatttaatatgtagtatagatgctccttgacttacaatgaggttagagccttgataaatccactgtaaattgaaaataccacaagttgaaaatttatttattacacctaagagaatgaacatcataacttagcctagccttgttatatgtgctcaaaatacttacattagcctacagttgggcaaaatcatctggcaacacgttacaccatagagtactgattatttaccctgatgatcaggtgactgactagaagctgtggctaactactactacctagcatcaaaagtgactattgcacagcatattgctagcctgggaatagagaaaattcaaaattcaaagtaaagtctttactgaatgtatatcatttcacaccatcatcaaattggaaaattgttaagttgaagcattgtaagtcagggatcatacctatgtctcacatataaataggatatttatggtttaaaaataataataaagtgaacacacttttaccatctcacaacaaacaggacatgccttatttgaatagaattaaaagttgacactaggtggcgttaggccttagagtcatgtgatttaaaataacataaggcaaaattcaacctggggtttgaagtagaggcctatttttaaaatcctctgtggaatttctttctcttgtcatttttgacaagtaggaagaagaaatttgggagaatatcttgttgtcttatgctcaaatgcaatgccctgtattttttttttaaatgaagtgcaatcttggaaatgtgctttagtcttgccctagctaaagaagggcatcaagggaagtgttaagggagaggctgcacccacgggtactatgcaggggatacactgtagctttctgtcaagtcaaataagtaaggagacaaaaacttgaaacatgtaggtaccaagcaagagcaaaatacagccagaaattcattaggcacacaggattgagaaaaaaaaaatatgacatatatctggaaaagtacaactccagagggaaaatatgtgagttaatattttatttatatctgattttgtacttttctctactgaattttcccactagacataactctgaaaattcaaaataaatctgtatttgaattatttagcaggagtgagagagtcagtttcaatatcattttcaagatgctaagttagtaattatattaatagataatgaatcagtgctatgattatctccattataaaggtaggaaaactgaagctcagaaaactttcaacaaagccacatggataaaatgtggtgaagctgaatttttaagccaagctattaaacttccgtgttgtgttcataatcactgttttataacacattattgtaactaccgctttgatgtgcctgtgtaatgcatcatatttttctcatatgcatatcatatatatttatcatgaaattttatcaggaaatttacatagtaaaacttgccatccctagagttatcaagcaataatctataatttcctgaaaaactttttatttttcattttactttaagtttcaggatacatgtgcagaatatgcaggtttactacatagatatacgtgtgctatggtggtttgctgcacctattaatcagtcatctaagttccctgcactcgccccccagcccccaacaggccccaatgtgtgatgttcccctccctgtgtccatgtgttctcattgttcaactcctacttatgagtgagaacatgtggtgttcggttttctgtccctgtgttagtttgctgagaattatggtttccagcttcatccgtgtccctgcagaggacatgaactcatccttttttaaggctgcatagtattccatggggtgtatgtgccatatttgctttatccagtctatcattgatgggcatttgggttcattccaagtctttgctattgtgaagagtgctgcaataaacatatgtgtccatgtatctttatggtagaatgattcataattctttgggtatatagccagtaacaggattgctgggtcaaatggtacttctggttctagatccttgaggaatcaccacactgccttccaaatgtttgaactaatttatactcccaccaacagtgtaaaagcattcctatttctccacagcctcaccagcatctatatttttctggcctttttagtgattgctattctgactggagtgtgatggtatctcattgtggttttatttccatttctctaatgatcagtgatgttgagctttttttcatatgttttttggccgcataaatgtcttcttttgagaagtgtctgtttatatcctttgcccactttttgatgttttttttttttcttgtacatttttttaagttccttatagattctggatataagaactttttcacctgggtagattgcaaaattttttttccccacgctgtaggttgcctgttcactctaactatagattcttttgctgtgcagaagctctttagtttaattagatctcatttgtcaattttgccttttgttgcaattgcttttggcatttttgtcataaagtctttgcccgtgcctgtgtgctaaatggtattgcctaggttttcttctaggatttttatggtttggggttttacattacaatttttaattcatctcgagttaatttttgtataaggtataaggaaggggtccagtttcagttttctgcatatgactagccagttttcccagcaccatttactgaataggaaatcctttcaccattgcttgcttttgtcaggtttgtcgaagatcagatggttgcaaatgtatgatgttatttctgaggtctcttttctgttcccttggtctatatgtctgttttggtactagtaccacactgttttggtttgttttggttattatagccttgtagtatagtttgaagtcaggtagcatgatgcctccagtagagtgggctgctgctatagataccccaaaatatggaagtgactttggaactgggtaacaagcagggattggaacagttcggagggctcagaagaagacaagacgtgggaaagtttggaacttcctagagactcattaaatggctttggccaaaaggttgatagtgatatggacaataaagcccaggctgaggtggtctcagatgaaaatgaggaaatttctgggaactggagcaaaggtgactcttgttatgttttagcaaagagactggcagcattttgcccctgccctagagatttgtggaattttgaacttcagagagatgatttagggcatctggcagaagaaatttctaagcagcaaagcattcaagatgtgacttgggtgctgttaaaggtattcagttttataagggaagcagagcattaagttcagaaaatttgcagcctgacaatgtgataggacagaaaatcccattttctaaggagaaattcaagccagccacggaaatttgcgtaagtaacaaggagcccaaatgtttatccccaggatcatggggaaaatgtttccagggcatgtcagaaatcttcacagcagccctcccaacacacacctgagacctaggcagaaaaagtggtttcttgggccgggaccaggatccccatgctgtgtgcagcctagggacttggtgccctgcaacccagccactctggccatggctgaaagtggccaacatagagcttgggctgtgccttcagagggtgcaagccccaagcattgtcagcttccctgtggtgttgtgccttcaagtgcgtagaattgggatttgggaacctctgccgagatttcagaagatgtatggaaacacctggatgcccaggcagaagtttgctgcaggggtggggccttcatgaagaacctctgttagagcagtgtagaagggatatgtggggtcagagcccccacacagagtccctactcggcaccaccttatggagctgtgagaagagggccactctcctccagaccccagaatggtaaatacactgacagcttgcactgtgtgcctggaaaaaccacacacactaaatgccaggacatgaaagcagccagaaggcaggaggctacatcctgcaaagccacaggggcagagctgcccaagtccatgggaacctacctcttgtatcagcatgacctggatgtgagacatggagtcaaaggaggtcatttttgagctttaagatttgactcccctgctggattttggacttgcatggggcctgtagcccctttgttttggccaacttctcccatttgaaatggctgtatttacccattgaaatgggtaatttatttactcagatgaaacaatggactatggacttttgagctaatgctgaaatgagttataactttgggggaatgttgggaaagcatgattggttttgaaatgtgaggaaatgccatttgggaggggccaggggaggaatgatatggtttggctgtttccccacacaaatctcatcttgcattctcacatcttgtgggagggacccagtagtaggaggtggttgaatcataggggcaggtctttcccatgctgttctcatgatggaggataagtctcacaggatctgatggttttaaaaaggggagttcccctgcacaagctctctttgcctgctgccctccatgtaagatgtgacttgctcctccttgtcttctgccatgattgtgaggcctcctctgccacatggaactgtgggttctccattaaacctcgttcctttgtaaattgcccagtctctggtatgcctttatcagcagcatgaaagcagactaatacacaaagcatagcatttcttggagatctgttatgaaaattggcttactgaaggccttaataaactctgcagtaaatatatctgtgtaactttttttgtatcagcatttcccatgattacttcagtagaaaataccattttttttaaatgacacatcacatttcaaaaaatagtgctttaaaggtattaaatagattactggatttagaaaatgtcccctaagcattttacagttcagggaatgtctggtaagattgcttgacatatggaatactaagtaggagttattagactcatctatctagttataaatttagcttctagctatttttctctattttgaaaatcatgaattaaaaataaataaatttcattgaaattggttaccactttttcaaactctttttcaatttctacccagtgttgtttgtgcagagatatttttaaaattaggtaatacatacagtacatgtttatataaaccatcattgcaaattagaaattctgagatgaccaacaagatgtttatgttcatatctgttgccattttagtcagtttttcaaggatcctggcaatattcaaatctctctttatcctttcagttttaaactggattggtctctggtcaggtgaatgacaaatgaatatatttgaatgttaaatagaaaggaaaggaaatcccctcaggataataatactgttttagttttctcatagtaatttacaaaagaacattaactagttccagttgcctgctccaaactattatggcaattcaaatcttccccaataaaattttaaaagaaaaaaaaaacaattctaattcctagtaataatcatttgtaaaataataaagctccacaatatttttgtaagtttctatttcttgctttgaagtcccaatttactttcatttcgtttgcattttacattctattggacatgattttgaaagatactttgtagtgaatgcatgctcagcatggatacttatttgtgaatatgttgtttaatcaatagtattgaccactgtctttttaagaatgctagtttcttgcataaaaagcattattaccaaccaatgggcataatttgtcttcaacaacattaatgtaatgtaacaatgataactgaattcatataaatatattgttccacttactgagtagatggatgtaattatctgaggaaaagttcttttctcaaccttagaaatagaggtaattgaaaaaagagaaaagctgggcatgtatactgtatataaccaaacattttactttaatgggtcaataaaaagtaaatagacataaacttgaaactgaaaaccatcttggcctttcaaataattactaattttatacacacagggtcacagacataattaaaacatggttgatcagaagatgagatttctggtttttatcccatgatttttcattaaaatattagtaatgtcttacatacctcaggcacttttcatttaaaagacagcggctatgataaaaattttgaccttctcaacatgtctcttagggataaatggcaaaagttagatcagctaggtgaggagatatttaaaatcactcgacttatttatcagtggagctgaaaataaaactgatgtctttttacaaacttgctttataatattatgccttattgaaatatattctagctgaaaagcaactaagtagggcatactgtttccaaaggtgcttttagtatatatttaaaatattaaataattgatacattagaaactcaaaactattatttgagtttacaaataagacaacggctaacatattttatataatatctttcagtttgtaacatgctttctcatattatttccccaaaattaaaatgcctacttgattgatgcaaatgtttctatgatgataatatttaactatatttaaaagaaaaaataaagaattttttaaaaatcactctataatataaacctcttgaaggaaaatgtattattaaatattttaccaaccctgtactacttatttctgagaaatccatcttcacttctatggaaaatatgtttctccaccacactgccatttgatcaatgtgtaaacagcaattgtcttaagtgaaaatgtcctcttgatcataactactggtcaaaacatgaacacttgatccaagctgaggcaataacttcgtaacgaaggatacgaggatgagcatgcagctcaagtcagttgacctaaagttttcaggacagaaaaccagacccgccctcagcaacatcctcttatacctgagaatccagtgaaaaagggtgaagttgatcgggcgcagcggctgacgtctgtaatcccagcactttgggaggccgaggcgggcagatcacaaggtcaggagattgagaccagcctggctaacacagtgaaaccctgtctctactaaaaatacaaaaaaaaattagccgggcgtggtggcaggcgcttgtagtcccagctactcgggaggctgaggcaggagaatggcatgaacctggaaggtggagcttgcagtgagcagagatcaggccactgcactccagcctgggcgacagagtgatcctccatctcaagaaaaaaaaaaaaaaagtgaagtcaacatgaagataagcaaaaataatagatggagagatttccttgctagcttttgggtctctggtttgctttactatttaatttatttatattttagagataagggtctcacagacttatcacacgaccttattttcaatactaaaagataatgtttgctgctctttatagaattggttgaaaatagtccaagtaagtcagggaagttggaatagcagaaactccaccaagatggtgatcttggtgtagtattgatagatcttgactgtagtattgtaaaggaagaattatggtggcttagcatggtgtacagacactgaatataaagaaaaccagatgcatatgagattggtttgagatacgactgaaaggacttggggacagattgaatatgggggtcgatgagggaaatagaagaattcaaagaaattttcaggctaaacaaacaattaaagacctcaaagtcagaagaataaataaagatctgaagctgagttgcttatagccaaatttgattagccatagaactgaaagcttctgaggttgggtgtgagagtacaggtaggtcatctgctatatgcaatatgagaaatgcaactgcaatatctacattaagccacaaatcatgaatacctgcttgactatgtcctctgtaatggaattatgaaacattctgtcgactctcttaagaaaacatcaggaaatcttgtagaaatagagggatcccttttgtttggatgacttagactttatttccagaggtatcttgtatttaacaaaatggatattggacagctactcaaattcacactgaatttgagtagctgatgaatgaactagaggtaaaaaagtagtaatacgcaacacacaacacatttcatgagttttgctgtgaaaaaacacaagtgaggtagagcctcttaagacaccagataacaagaacatgctgagatatctctggaaatggtgctaaaaagagaggaattagtaatacagaaatgagaaaatctacagtgaaaatatatttattttttgttactgaataaaataaattttactttaatgacacgaaaagatcaaccatccctcatccaacaaattaaaaagtcagaaattatcatttacagcaatgacaaaaagtgtttctgatttatagttattctgaaaataacattttttcaaacacttttcacctgaaatctaaccagactcctgtacataattttgatgttattaaaatttacattcacttgaaagaagcaaagttttaaacccagatgtcaaaaacatgacaccaaatcccacagagaatccatggatgttgagtctcttcaaaatttaaaattatgtagctttttaaaaaatgatgttttccctttactcataagaatattttattaccgcaacctggcttcaccttaatctttgtcattcctaattaatgtcctaattaatgactctctgtcatttctaatcaatgtagaatgtgtacaacaaatttcagtttcacaaagacaaatccataaaagcaagtgcaggtgtttaaaccatgaatttggggcagttactttcagatgtcaaaaatagcagcctagtatctgcaaagcagttgcctgatataaagaattcttaagaagatgcagttttataacagtaatgaaaaaaatactatatctagaaaatataaagtatatatttctaggtatagtctataaatacagtaaacttttgtgatctccgtgagttctgagaaacttgttgatagttttattttcagattatagaagtttacattataaaatttattataaattttggttataactattattataactagcataaaagattagtatctttgtcagacaatgttattataaaccaagtgtatttataaaacatatgtgtatatatgtatatgtgtgtgtataaaatacctataacttcatatacaatagccatttacttgggatgcattaatattttgttagaagaaacacaacctaatctacaaccattacataggtttttgctatttgcgcttcttctactgcctttctagatctttactttgattacatttctacagattatatgtgataaattatcagtgttccaacataaattaatcatttagaaacaaaatagtaatatcataattacattaaagtttatatcttctttcagagatctaagaaaacctaaggtttggtgtttctttaatgactaaacatctaaagatataagaatgtaggtagttatcgtaggttttatgattattgtatattctggggaagaggtttagaaattagtttaggccgggcacggtggctcacgtttgtaatcccagcactttgggaggccgaggcgggcggatcacgaagtcaggagatagagaccatcctggctaacacggtgaaaccctgtctctactaaaaataccaaaaattagccaagtgtggtcatgggcgcctgtagtcccaactactcgggaggctgaggcaggagaatggcgtgaacccgggagtcggagtttgcagtgagtagagatcgcatcactgcactccagcctggacgacagagcgagactacgacagagcgagactccgtctcaaaaaaaaaaaaaaagaaggaaaaaaattatcttactttagaatatcataaaatcatcatgaagattttaaaaattttggtctggtatattgtatgaatcccagggattaagagaggcaattttgcccataacaacttctaatattctcggtgctaaatggtgtcagtgaaactggtccaactgtcccgtagaactgatgtttatagtttcttccgaataaacatataaattaaccctcccccccacgccccaaacacacacacacactctagtctcaaacttaagaaagttacgtttgtcttattgagttcctttctcaggaaaccaccaatggggggcttcacagagactaccaaagaactgaaacttaacaggttactgcatctggacgatgagatactagattccccacccatcatgactgtcttacctaccacctgttgtctgttgacaaactcctcttccttacatctccctaattcctattttctcacacatggttacatttctttcctgttatataaatccctaatttcagttggttgaagagatggatttgagactcatctctcacctccttagctgcaatacctcattaaattcttcttccctagaaatattcattgtctcaatgattggctttctgtgcagtggggagcaggacctatactgaacccctagcatttcagtaacagattttggtttcctggccaggaacacattgctcatggctcagactgcagtgggccaggagtttcagaaaccctcctaaacagtggcttcaccattttttcgccagagcttggtctcattctctcttcggccctgccacttctggccccaaccacacttctgattgcctaggaagaatagcctttgacatttgacatctgagtttggatggctgagtgtcttttgtaggtaccagatagctggatatgccgtcctcaatttggggaatgctgaaggaatttccatttgaaggttgaacaagcccaaccaattcagagaggaaaacaccctggctgtttcactttggatacttggggctagtttgttgctcagtatgtggattgtgttttggttattgtttgtgtgtatgttgatgtagtcacgggaggtcagtgttctatcccagaatacagccctttggggtgccttcttcatggttggtctgtatgggcttgtgagccaggccctgaatgtgtctatctcatctgatctttgaaggtctttaaatggtactgttgtcttacaattggattcattttgctattgaatgggaaagcaggatggagttttgtgaacctaggcttttatgctgctgttctaagcagggtttggtcaggttagtacatgatgttcttctgagatgctgtttggcccgagtgttctttggagtctggggaggtttggcttttaaaaatcaaactgctggctgggcgcggtggctcacacctgtaatcccagcactttgggagcccaaggtaggtggatcatgaggtcaggagttcgagaccagcctggccaacatggtgaaactctgtctgtactaaaaatacaaaaattagccgggtgtagtggcgggcgcctgcaatcctagctactcaggaggccgagacagaagaattgcttgaagcctggaggtggaggttgcagtgagctgagatcgcaccactgcactccagcctgagcaacaaagagcaaaactctagtctcaaaaaaaaaaaaaatcaaactaccttggaaactgctgcacccaaaatattggtacaaaaccttcactggattacctatgggggcaaacaaagtttacccatgtgaccatatttgtaaactggtgagttcatgttgctatctgatggcgagagtttcaaggtaaaaactattggatctttgtgtgtgtatatacatgtttagatgtgtttatcatatgttgcatctaacaaattggcttttaaataaaagagtactaataagtccaggcaattttcaaattcatgtgacttaagtaaatcttaaataaacaagctagctttacaattattggtaaaattaaaataaaagtttcttaggaattgtcagcatacattttcatctgggttttatatttgtctttgctagatattttgaaatatcagagttcggcacagaaggctataaaactataaaagcaaccaaaacaaaatgatctttgtgcaaatttatttgacaaaactaatataatgtttttggtttaataaaaacagctaaatcttcggaattattggcaaaataatccatgtatttaactttaagtttgttactataaaacctaatatttacaggttataaaatggttaacaaggaaatgctgattttgtctaatacttcagttcttataagtaatctagataaactgctaaaaaaaatgaaagattccagtacatgtgaatggtattagtgctggtgaacattttgtagaatataaaaacaaaattattttagacgctcctttgatgtctgggtcatttccaattaagaaagggttatgatatgcagaaatgtattttttaaaattgtagaatgttctcatctataaaatccaataattggtagaagttcaggatttcttgcttcctaggctttcactaaaatgtaagggtacttagaataagaattctagctaatatatcattctgtatataaaatgtgccaaagaagatatgttcttattgaaaaaaacaataattttgtctaattcacaagtcatctaaaggttaattcaaattatggactatggcaaagttttgccataaaataaaatgagtggttacttttaaaaaatatatagaataaaacagaaattccaagtatgtcattgtctgtgtaagtcataaattttttttcctgtttctctgtgtgtctatcttcatggccactccagcatggcacatgtatacatatgtaactaacctgcacattgtgcacatgtatcctgaaacttaaagtataaataataataaaaaaaagaaaaatgtagttgacttctttagcataatagtttggataattctgtcattaaaatacccttctgctttttccagaataaataatcatcacaattaaaaaaaaattgaaaatgtttagataataaaatattctttgaagcccaatagataattggagacatttgactaattaacattgttcatagttaaagctcttagtgtttatgaaggtaaaataagaaatattgtaaagaaatacattggcaatttggcaattctttttttaatattgttaagcatgaagctggatttagcatggagcctaatttcacataaatgcttgctttgttttacttaacactaaatttgctattctgtttattagtaccagcactacaacatttacttgtcaaatgcctgaagaaaatttcttaattgcataaaatgcattgtggtattttgtagacttaaagatattcagttgtatatcaggaacaaaatatccacaacgtgtatgtttttatgtcctggatagcactgtagcctccgatgtaaactgagtaagataaaatgtgggggttgctttcctgtttattttgttttgcttttaatttttattcattttctatcttttcttagtttttatgtatatatgtatatataaagcactttcttgttgtttttttgttttttggtttctaacagaatgctcatatttgactccttgaatagtcattttgtttcctatacatttgaaacaattcatcatttgttctgtttatcaaaagtccctaagttacctttgtcaagcctcccaaaattgataggacaacctagccatttaaaattcaatatgtttttcttacctctgatgacctagagagcttcaagagctttgaggattctggaaataaataaagaaaattttttttttaagttctgaacagggatagtacattatttattttgttatttggaaaagtaggtaggagtagaaatgtttaaatggtatttatgttcaaggtaacttaattcagtccataatttgagttggtttttgatcttttcctttaggtaatgaggaaaaactgatatggttacaaagttttaatgttcaggaaagattggccttgttcttaagataattatgacggctgcgatggtgtgtgtggagtggctgctgtaaggatgctggcttcagtgtgggaggtgcagctggtgctgcgtgcttcagagatggtgggagccaggaacaggtgagagctctgccccctactgagttggcagggcaggacgccacagtactgggttgagcgatatcggggaaaattcagccagatatcgggcgaaattcacccccgatatttcacgtaggttcttttctatattccctaagtgtcggatggtctgagaaataaagggacagaatacaaaagagagaaattttaaagctgggtgtccaggatagacatcacatgttggcaggttccgtgttgccccctgagctgtaaaaccagcaagtttttattagtgatttcaaaaggaaagggaatgtatgaatagggtgtgggtcatagagatcacgtgcttcacaaggtaataagatatcacaaggcaaatggaggcagggcgagatcacaggaccacaggacaggggtgaaattagaattgctaatgaagtttcgggcatgcattgtcattgataacatcttatcaggagacatggtttgagagcagacaaccagtctcactaaaaatttattaggcaggaatttcctcattctaataagcctgggagcgctatgggagactagggcttatttcatccctacagcttcgaccataaaagacggccacctgctgaagcggccattttagaggcctaccctcagggacacattctctttctcagggatgttccttgctgagaaaaagaattcagcgatatttctcccatttgcttttgaaagaagagaaatatggctctgttccgcctggctcactggtggtcagagtttaaggttatctctcttgttccctgaacattgctgttatcttgttcttttttcaaggtgcccagatttcatattgtttaaacacacatgctctacaaacaatttgtgcaggtaacacaatcatcacagggtcctgaggcgacatacgtcctcctcagcttatgaaaatgacgggattaagagactaaagtaaagacaggcataggaaatcacaagggtattgattggggaagtgataagtgtccatgaaatcttcacaatttatgttcagagattgcagtaaagacaggcgtaagaaattataaaagtattaatttggggaatctgataaatgtccatgaaatcttcacaatttatgttcttccaccatggcttcagtcagtccctccatttggggtccctgacttcccacaacagagctgcacctgtccagtcacagtccagactccagcatccctgaactcttggggacccagagtgagaacttcattgatgactgcttggcaaatctgatggtgctttttccaggcccatttgtggtcacccatggacaaattagcatgcacttccttcattcttagcacattaaaaaccccaggctcagctagactcacacactctttgagacgacctgcctgaggaaaggagctacccactatgcaacttctcctctcctctcttctgagagctagacattcacagggacaacttgcctgtggaaaggagctacccactctgggtctcctctctgctgagagctgggcattcattgggatgacctgcctgcagaaagaagctacccacttcgggtctcctgagagctgttctgttgcccagtaaggctcctttcttccttgctcaccttccagttgtctgcatgccttattcttcccggatgcgggacaagaacctgggacatgctgaatggtgggactaaaatagctgtaacacaaacagggctaaaataccccctgctctacacacacacttgccacgttgtgggtgatgagaaggagcaaacagctgaggcccttcatggattccagacctaggggctccccaaggcggggctgtgacatcctcattggggctctgtggttcctaacatctccaagcctctgggcaaggctgtcagtggtatgcctgttccacccacagccttgcacagagctggcacctttgctggcacctggagctgcccaccctgacacagccagtgcccttggctgtgtacagtggtaagacctcatgctcactcactcacacacccctcactgatccctgcctggctcacccttggaaggtgtgggatccaggctggtagcacaatccaagcacagcctgccaggccaagtaggtggaatgagcccagtgagcccaagcaaaactcaggcaaagatgccaccagccacagaggtttctggctggaaaagcaaccccctaaggatcctctgacaattatattgactgggatttctctaaattactgtacttgtatttagcattattaaaattatgtgatattcaaatggattaagtagtaataaaaaatgtgagactttctggtaatttttttgaacccaagatgtttatcactgatgggccttcatgtgtcttcatgaaaacaaaatatgtacaagtgtcacactagcttgaagattctactggtggaagttacctaattagttgttagtactgtacctagaaactgatcttggaaatgtgtgatgatactcttttaaatagcttaaaagaaaatattgtgtggttattcttcctttgtccttgtttcgctgcatagtcttaaagtgcaagattatttacttttaaataatcttttaaatagcttaaaagaaaatattgtgtggttattcttcctttgtccttgttttgctgaatagtcttaaagtgaaagattatttactttcatactgaatttccaaaaacaatatttgcatttaccattttttaatgatgaggaaaagttaattgtgttacttggcaagtttgcattgaacctatcacattttttaatgctttgctcacagtactttcactagagtgctagcaattagatgtatgcaaggagtaaccttaccacattaatacaatgttttgcctagacaccaagtcatagtgttttaatttctgacatgttagagagaatgataggactttcttcagtataaatgtcctattaactgccaaatcttgagcattgacagcagccaaagccttctcttcagaccagggaaaaggtgacaatcaaaatggactactttcaagagactcagggccagaaactaaaactattcagtccctgtaggcccaagtactattatggaagaagtgggcatgtgagattgtaaaagccagttccagggataaaagtagttcagagtttttctataaattaaacattaatagcaaaagtacactgatgcaagccagcatttaggtatttgtgtcagaataacagggttttcttggagcattcatctgaactttaatagcaactttaaaaaagttataaaaggtttatgaaattcttaccttatggtcaaactaatttcaaatgtgaggtggttttaattttccttatttttatatagatgtgttgttaatatgtgttccaggattgtatgagatttctgaaattctgatatgttttaacatatgttgtcagtaatgattatcattattattctaaattttttatatgccacagaaataaccaaattttattgtcaaatgtgtctgtcctaagacttttgttatccacaattgttttgctttgattcttctaaaaagcaacttataattagctacggtccagggcttgcttcttccagggagttcatgaaaaggactctggaatgcagttttctgttaatgtttgagattatgccattagaaagaaaatttctaggacacaaattaaaaggcttatgttttcaaaaagattgctaacccaacatgaggtagatcaggagttgattgcatagaatgaactaatggaggacagaaataatattgaaacattgctgttttttttttttcagagtctagagaatttttttcttttgaagtatttatagcctttaacaactgagtagagcgtacttttgtaaacagaatttaaagcatgtttctctctttgcctgatttctccagaattcagaaactgtgaatattctttattcaggacaatgtggttgtttgcataagttcaataagagtatattttatgttataataggacacaattgtaggaactgattattttctcagggctttcactgaaatgtcgtgttttcagatatgagtagcctgctttgagaaactgctgttaactttatggagctgatgagacccccttagaaggattggcctcataccttatctacacattcctttgcagggtttctggcctgtggttaagttgacaatttcactttctgacaggtccaggaacctcaagtatctcaagttggggcctggagaaaaaggggttcactgaatacatgcaggtatctgcaggtgcagatagattcctggctgggctcgggaggcctttggaggccaagtctgagattccctgtgagaggttccaatgaagctaacttaggagaggtatattgaaaatgatacttgctatattttttgtgagtaatcaggccaagtgtaatgggactgaagtttattttgcaggtaggtttatccagctgtgatttgtctttggtggaagtgggggaatggagagagaaaaattacatttcagaagaaaactatataattatattaaccgttgattcctgggtggacagtggccacccctagtatgaagttgcccacaaagactactcagcataaagcaggcagaaagatccacgatgagatttctcacgattgagaaattggtaaacagcaagaggtggcctgaaactggcccaattgtttcatagaactgatgtttatggtttcttctgaataaacatagaaatttaccctctatgtctcaaaacttacatttgtcttatctgaattcctttctcaggaaatcaaccaccaggcctccagatagtatcaaagaattgaaacctaccagatcacaacatctggagacaccagacccctcacctatcatgattgtcttacccaccatctgtttactgttgatcaactcctctctgtcttaaccctccctaatttctgttttcctgcacttggttacatttcttccctcctatataaaccactaaatttagttcagttgaagagatggatttgagactgaactcctgttttcctcagctgtagcacttgaataaccctcttccctaacaacactcatcttaatgactggttttctgtgcagtgagcaggaagacctacactgaatctctggcattttgataacatcagttataatttctattatctctgtatgctaaggacaataactttgaaatatggggatagttccagtattaaaactagaaaaaaagtggcaaaattttttacatcagaatgggtagtaaaatttgtatagcccctcacaaagaacatactggtgttccaatgatataaaaccttctgggatcgtgaaaaggctgaaatttttagacttgataaaaaatgaataagatagtgttgaaaccatttttagtttctatcaataataatgaatggagcgaggggtgatggtacgttcctgtagtcccagctacgtgaaaagctgaaatggcaggactttttgagcccagaagtttgagacaagtctgggtaatatagtgagaccctgtctctaaataataataataataataatcaatggagcctcttggtagaattgtatttttatcttgtactccaaattgtccattactatgtggccaccaccctccaattcaagaggaattatatttctacataaattatcttccatagcaggttttcacatgttccaagataaattattttaatcaaaaataaggtaaatttgaattcttttagcagataacaactttaagaaatttttaatctcaattttatgtttatcaagatattcattccaagtttcatttagtatctacgtggatacgcatccctcattaattgatttctggagacaaaccattttctgaaagacttatcttttattatctcatagatttgttttttcccagtcacccagctactgcaactgtattttacttctctactttgacttccacatttttttccctctattcttctgtaagttcatttattgttaacacttggtgtcattagcgctaattttattctcttattttctaatgaacaattatagcagcatttctaaagccataatgatgtaataacaaaaaaaataaagatttaatagatatatagggtaagatttttaccaacactttaaaatctagcttggttaccctgaagcaaaaacaaaacaaaacaaaacaatggtaactagagcagaactattttgctctataaatattccattatctgcatcattcagagttgtctgttataaatacttattctatttttattttaattgataaatatttatgtatatttatataaatacaatgtacaatatgatgttttgatctacatatatgttgtagaaagattcaatcagggtaattaacttatccatcaccacacaaatttatcattttttggagtaaagagaatgttaaaaatttatccttttagcaattttcaaatatataatacattcttattaattgtattaatatgcagtataatagatcactcaatttatacctccagtctaactgaaactttatatcctttgatcaatatctctcaagtcctcatcactccttcttctcccaccgccaaccccagccttcggttactacctttctattttctctatttccatgatttattaaaattttcccttaatccattattaagccatccaaatcaaccaccaaaataatatttaatttaaagcacataaaactttaattgtttaaggcttattatagttgttagacatgttttaacttggacatatttaggaaatgcaaggtatacttacaagctaaaaggtagaaggaacattgcattaagagtcaagagaaattatattcctcttggctcatgggggtggatccttcatggcttgataagtctttatgatagtgagttttcaagaggtctggtcatttaaacgtgtatggcacctcaacaaactgtaagagcagcctgaggggctgaaccctgcaaagccgcaggctgggcagagctgcttaaggtctttggagctcacccttataccagtgtgccatggatggaggacatggagataaagtagattattttggagctttaatatttaatgactgccctgttgagtttcaaatttccgtaaggcctgtagcctctttcttttcacctatttctccctttgggaacaggactgtttactcaatgcctatacattccatttcaatgctgtaggtggggcctggtgggaggtgtttgaatcatgggggaagatccttcatggcttagtgctgtctttgtgatattgagttctggtcatgtaaaactgtttagcacctccccccagcacccacaagcatctctctctatgtctctctctcttgctcttgcttttgctatgtgatgtgcttgctcctgtttcatcttccactataatcttaagcctcctcaggactccccagaagcagacaccactatgcttcctgtgcagcctacagaactgagagtcaattacacctcttttctcataaattacccagcttctggtatttcttcatatcaatacagtaacagcctaatactgatactaaaaccaatttgtgaaagatagacaggaaatgagatttccaaggtgcctaactattaccaacagcattatttgctaatttcaaagagaaaacatactttcagaaaatagtgttgtggctgttatcatcttagttaaattctcttaaatagcatatttatatcaggtcaactttgcttcctaaggtaatgtaatacgcagttcccattaaactgataaactaatattgtcaaaatgtttaacatgaatttaacagtatatgaggttggcaaagtttttatctagagggtaggtagtaaatattttaggcatttgggtcacatactatctatattgtatattgttctttttcttgtttgtttgttcctttacatgtaaaactccttcttagtttgaatgttgtttaaaaataaatcacaggctggggttgtcctacaggtcatattttattgacttctggcttgaaggaatacttgaaaaaccctacaagaaagtgatctgacaaatctaaattataatacattctaaaagacagtcaacgcttctttcttcaagatgtaaatggtataaaaatataaataaggggagaggactgtttaaccataaatatgactaaagagataaaactaaatacaaaaacctgcatactatacatgaaattggatcctgcttcaataatattttacaacttataaaagacattttagaatattttcctttatttcaaaggaaatatccattatttcaaaaaatgttagtatttaaagtagtgattacttcccagtatttcttaatattagtaaaacactacatcatctgaagaaataattgccacatatttgaaagtctatgtctgctcgttttaaatagtagttttcaaaatgcctaaagttgcaaatctggactactcaagtcaatagtctacttgagaactggataatttaggcatagatattccactgatatattctggagcaccatgtagataaatctttgaaaaaaaaaacaacattctcagtcttctctttatgtttaactctatgggcacatgtcagtaatgagcttagtatcggtaatcacagagatagcatgtgtaagcagactcttgagatcagctagatcatttcctatgggaatttacaaggatatcttgctcctttcttttctttacttgtatatgaattacttgatacaggtttggataatttaaatgtttgctcaatcctctacacgcctctgttctctcactacagcccaaagaaagatgtacattggtctttgtaagatgagttatgtgattcagccctgctaactgcagtatttgtagggtggcagagtaactatttcaagctcaaagtcattaaaaatgtcatctgatatctaactgacttagggcataatacccccagcaacaagtaaatccgtggactcaaagacaggcaggcctccaattaaccctccccagctactaaaactgaagaactacctttcatatattgtcactgtgttggtgattagtcaaataatttatgaaaaaatatacatagttatttggaataaatgaatgctgaaattactaaacatcaacagctacagtggttactgctgcccattccttgatcttgtttaaaaaacaaaaacaaaaacaaaaacaaaaaaaacctctcatgattcatattagtataaaagatgtttctgatgaattgtcaaccttagatcctccatactcgtctcactccggaagaaaacaataaagacctccagatgtcaaaataattctgtactatccggtaccttgtaaattaatatgtacacaaacacccactcagaactacacataaaacaaagccttcttttaaattctgacagatcttttcaaacttcatgttatccctctagcagtttttaatgtagcatcaaccttaacaaaaacagtcttgtgttgtgaagacaagaattatttcctgaaattttgttttaattgcacgcacagatgtgtgtgtgtgtgtgtgtgtgtttgtgcctttgtgtgtgctaagtggcaatggaaatttgtaattaggatacagtaatgaaaagttcgaaggttataatacttgaaaggataacagcattaacaagactagatactttttctgcttttactaccctaagaagaataagggctttagtaaaagccatctaccaccaacattttaggattataaaatattttattcacgagagttgtagttagagaaaattcatagaagccaccttctatttcacttatcgagactgtaagcaaaattcataattattattatcttttatgatttctttttatgtataatttcaatttttcattaatggccattttatgtctcattattcttcattattctttacaagaattattattatttaggtgttacctgttccaagactaaaagaaatagctatattactaagcatgaaaagaaatctagtttaactttgcaatcgaaaactaaagagcgaaacagaatccttgattaacaaccaaagtttctcattttgtttacagcaaaaatgattaattgtcttctaatgggtaaatcaatactttgcttaatggtatctgtttctcagaactgcatacctctagttcattaactcttctaaatagcatcctgccttggaaaactgcacaaaatgtgctgatgtttcttttaaagtcttgataaatcttctgttctctttgtcttaatcagtctctcactaagtctgcattactaacaatacaagtatagtgttttagtattctgatacagtttacataagtaataggagaaaaaatgagaagactattgttcaaggacttataatagcaataaggctagcaatggaccaatcactcattacagaaacccattatgcaccagcaagtctaataagattgtacaacctgaagtaaaaaactaaaaaaggaagaaataataaataaataaataaatacattgatggagttttccagtatgcagatagactaaggggctattatccattaatttaacaaatatgctgggaggcctgactatgtgattggctaacataagcagcaaagacaggcaaagcccctgagctcatggaaattcctttccagtgggtgatttaaacaatagagaagcccatcaataaattaacgagataaattcatttagaataagtgctataaagataacaaagagggactttgggtaggaggcataatgtaaatttggcttgcagtgaataggtcgctgaggcactgatgtgtcagctgaggcttacttgaatgacaagaagtcagccatgtcattcaggctgaggtggcaacaggtccaaaggccttacacagaaacaatcatggtacaaataaaaacagaaggagggcagtcttaatttcatctaaagaagctgaagtcttattcactacccacataatacttttcaaaggaaataacagaatagttgaaaacataatattgataaaatgattataagtctcttccctgcatttgccatgcataaacaacaacttataaaaaaaaaaggtatttatatcacaatccatctcataatattataccatctctctagtctctggactctttctctttttcaggctgttagcaatagtgcttcccttgttctcttctttcataggaaaacccattcaaataaaacaaaagccagaaatacaagattaatactttcaaccctaaagaatattgctcccttgaatcaacaaaatacaaagaaaatacacaatttttgaagaggaataactgaaagaggataaaaatatatcaagagagtaaacacaaataatctcaaatgattttcttgttacacacacacacatacacgtgcatacacatgcattttagagaactatgatatgattaatgcaggagacagaaaaacatataactacacatactgaaaaaatcgttatatttattaaaagtggacaaagtggagaaattgccagaaaatatataattgagatttcagacataaagaaacatacaaatgaccaaactatcagtgcttctatttctgaaattgagacagaatataagcttaaagcaaagctgcttaagaaattatgaaattaaaatatggaagacatttataatgtcaaatatacttagacgtggaaattagttaattaaagtgctatggagtcttttcttaaacggaaaactaaggtctcttctaattgtggttgtgttactctcaatccctgatacacagatttatatagaaggaattctaggttgtttgacttaagattttacatactttaaattattcatggtttaaaaatgaaaacaattgaaacataagaattaattataagacatttttgttttctttcaatttttcaatttaaacaacacagacacaatacttaggaaataatggggaagaaatagaagtacattaataggtcatgatgtcaataagaggagtggaaagacagaatgcaatttcaaagaaaattttaaacatcgaaatgaaaaagaaaatgaaaaaagggatcaagaaaatgatgaaaagtcatattacagattaactcaaaaaatggcatgatgagtacttgagccactgtgtatgaaaaacatactaatagagacatagcactcaaaactaaggcgagaaatcaattttcaatgcctccagaacatccaaacaatactaaatcttttggtccatttctgacaacaggaagagccaattaaaaattgcctcttgaaaaaccatttctcccttggcacgaagtatatttctgaagccaattttgggaaacacccccattttccttgtaggtcttcatttttctgaaagttactttgtattgtatctcttcctcttttatttaaaaataatcaagttgatacttattaactattttgtttcttgctttattattcatagatatcaaggttatgcttgcagtcaaaaaagatatattaaaaatattgtgtggtcatttaagaactcagtcatataagttttgagtatacagtattgcaatacatataattgttttctaaaatgttcaaaattaagatatttggttataacaatttaaaaattagatattttgaaaaatgataaagatctgttttgccaggttttattgtcaaaaggtaatttagctacctaactgtggccatatctttctcctctataaagccaatgtttcaaaatttgtttttgcttagtaattccatttcttcagctctaatatagttggtagcctacagtgcccagtgaaaacattccacatcaaggtcatcaaatgtcttctgtatttctaaattcaatggtgctttataaaattgtcatcttgagctttcttcagtgtttgtcagagccactcactatttctctctgaaacacttttctttgcttccactaaaccatgtctttttatttattccttctaaatttctgactcctttgaagattcatttacttaacgaccattacattttaacatatgtcaggacagtgcaaggcccctttatctttcctcttcagaatctctccttaaaaaaaggtaccataatgttaacatttacatgggtgtcttttcaatatatgactctagtccagacttttcttttaaactaagtaccaatataaccaactgcctattaatcatctctttgcatgtgtcaaaattacttcaagctcaatatatgctacattaaagacataatttatctccttctgggaatcaaattctctccagagttctcaaatatcatggttgggatactatgcgtttattgcccccaagctgaaacataggaatcatatttgataacttccacttctgtattaaatttgtcactaaatccttttgattttactttcaaactacatcttacaaatccattcatgtattctctgtctacatttcccatctggatgtggccttttgcatgagatgatatgaaactgcaccctaaagggcaattcttcatcatctattagctcctccaacagttctgtgcacagtacctgaaaaaatcttttgaaaatgcaaatgtggatatgtgttgccaatttttcctaagataaaaaacacaattcttatcaaaatctaaaatttctgcaagaattggcacctggttaccacaccaggcaatttgaacctctttttctctctcaattactgtgtttccaccactcagaccatgatttatctcacatcagggcatctgcctttcccttaactcagaatatatcagcaatcctcctcccactccctctgcttagtaaactgcagtacctaccatcaatctcaactcagtgatcctataaataatttcaactctccttgtaatgtgcttccttatatacccatatttttatttaaataaattattaatgtataattaaattgttgtgtgattattcaattaacatctgtcttcctcactaaattgcaagattcatgaagtcaaattcaagacatttgcttaacctgttatccataggaaataaaatagcacttggccccaaataggtacttaaacattttaaaatcagtgaatatgcaaatgaataagaaactgaatgaataaatataaaatttcaaccctagaacagtattcaaactattaattatattcctaaaatttaggccactttaatctcattgaatcttctagtctctatgaattcaatctcaccattgaagtttcttttagtttctagtattcatttagatattatgatataaaaatatactgaacagttactttataataaataattacttaaggcaaaaggcaaaagtaagaagaaactgtatactatcattaaaatatatttacatttttgcataaatgagaaagtagttctgcatttaaaagttgactggataatactaacactctcaaagggaggaatacaccttgaaattttttttttataattacaaagtggaactttaatagcaataacttatgctacaacttgtttaaaagaaaaataaacgtgtctattataaggaaaaaattaggtgagatgcaatacacaaacttatttcttcacctttgctaattgtgaccccactcttacaatatttacagtcatattttctatgggcctcactttccatttatatggggaaaaataaattacattgcaaatggcaagttctgctcttatttgcaaaatatataaagaaatgatgcttataaccagaccagagtgctgctcttcaataaaatatttttgtactagtgagcagcacttctatacagtgaaaaaatgaaaaaatgaaaagatcagagaaataaaaatatattttagaaagaggatgttatattcattttgctacaagctacaatgcaaaacgtatagtcttgtctttctaattcattgaataacaaagaaatcagcatgttgattataatgaataaaaaatgtttctttagactactctgatcagataccttaccagagacacatgctactttactatatttaataactgagtaactgtaaaaatacttttttaattgaaattagtcctccaagcatcacactatataaaatgtttcttttatgagaaatacttaaaactattgtgtcgccatgtcctcagttccacagtgtcagataaaaattttctcaatttaatattgtctgtctctggctaggcgcagtggctcacacccgtaatctcagcactttgggaggccgaggcgggcagatcacttgaggtcaggagttcaagatcagcctgagcaacatggtgaaaccccatctctactaagaatataaaaattagctggatgtgatggtgtgtgcatgtagtcccagctgcttgggaggttgaggtgaggggatcacttgagcccagctacctgggaggctgaggttgcagtgagccaagatcccaccacattttacacttaaaatatatttaaatttatattttaaatttatttgtaatataaatttaaaatctagttagtctatctcttctttcttggccagtaggctccacagagaacacttttgctgtcgatctcctaccacagggacttattctacctcaatgcctcactaaactcatttacattatttattcattatagagacacaaagcctggaaaacgcagacatacttttataaaacacaatcaacccacttttcccagcagtgtatttaggaggtgggtttgagtactgagcgctgttcaatgtacttaggaagtccagtcaaaaataagcgaggataggtccaattgctgggtccttggcaagattatgttatatggtcaaccgttactgacaaagagagtgtctgtcatggtcctggcggaaaacagaaaatccactaaaactgggtaatttatgaagagtttaatatagtaactatgtgaaagatttggacagagaatgaggaaaccacaggagaaggttgttccctgcagctagtatcagtgggccagttctgattgtcctgcagcagatgcgctaggtgccttgttttatgtcccctgaacctacctttgatttcagcttagggaagctcaacagttctgtgcacactgcaacccctcttcatttgtgttttggaatttttcagaacccacaggagatctatgagggtaaaaactgcatagaagagcaggggagttaatattctagaataaatggggtgggctgggaatttgtaagggcctatgctttccatccttcagagagaaaatccagaagaacattctacaaggttccttaaaaagttctcagcaggcttgagttgtaattgaccaaattttaaccacctcaatgaccttttttttttaaaaaaaaaaaaaaaaaaaaagactgtgggtacaaactaggtgtatatatttgtgggaaacatgagatattttgatacaggcatacaatgcgtaataatcacatcagggtaaatgtatttagcacctcaagcccttatcttttctttgtgttaaaaacaatccaattacactctcctagttactttataatgtacaataaattgctgttaactgtaatcactcttttgtgctatgaaataatagatcttatttattctatctaactatatttttgtacccattaaccatccactcttccctagaacccatcaccttccccagcccccggtaactggcattccactctttatctccatgagttcaattgttttaagttttagctcccacaaatgagtgagaacatgtaaagtatgtctttctgtgcctggcttatttcacttaacccagtaaccatcataaacatttttgcaaatgacaagatctcgttctttcttgtggttgagtagtacttcattgtgtatatgtaccaacttttctttatgcaatcatctgttgatggacacaggttgcttccaaatctgggctattgtgaacagtgttgcaataaacacagaagtgtggacatctcaatatactgatttcctttcttttgggtatatacctagcagtgggattgctggatcacatgaaccaaataatccagtaacataccttttattgattttctcttctgtcttgtcttgattctgggataatttctaataaactccttctaatcatatatttttctcaattcttcatgggagaaaaaaataagatacacccctgggccctaatgagtaagagtataaagcagttacactcacacacacacagagggagagagggagagaagtgagtgcaaaaagctatcagataaaagttctaacattagtcaaagaaggtatgtgtatgcatctatcacaaagagaaaaaagggaaatagagaccccaactttactttcttccttttctcaagactgctggccttccctattggccaaatcaaccaaatttcaaaagacagacaaatgtatttgtgtagttcctacaagtcagccacagaagaaaggggcaaatagaacacctccattcagcacaatgcagaaatctacattccaaacctaaattaattatgcctccttctactttctcccataactctatttcccctcttgctgttctaatatagtttaacttatatgataatactaatgggagtgtattatgtgtgtaaaatatagtttggaaaaataacacaatatcttcccatctatatatgttgagcaactttttcctgttttatgaatgcacttaagttcagtatctccagagattaaagatgagataattgctaattaaaataataactggaaacatttctaccataaaaatacattttgttgcctgacagtgtaatatgtgaatgcttaaatccaaatatgtaaatcacatgtattattgaataagcatgttcaaaagtagaatatcctctatatgcccaagagaaattttacaataatatgtctttggagctttaagtattcaataaattattatctagtggctacaacatgtaaactttgactttgagggaatataaatatataacatacagtaatctttaaggacaattataatgggatagtatacctccaaaggcctattagagctgaataaaaactcagtggtctatagactaattgttctgtgttcagtagtgagatgatgggaaaagtgttcccacaattatcaaattttaattttatatcagtggccagctgacactcttaactctgaattagctgacatttattgttagctctcatataatggacaaattaacatattaaaaaaccttcaaagtaagcaacaatttaacatttatatttgtactccaaaacagcagtaaagactagaaattgtgaatgttattttcaaataaacttgaggtaagaagaaatttgtcttgaagagtaaccaattttcatctacccattaacctattgatgtttagaggccagtaatattttaagattaattttgcattgcagtataatctggaaaaaattaatgcgaaaaagttgatctatgatgaacatttagggaaccacagttgtctttcagtacaaagagcggggattgattctaggaccatcacagataccaaaattcatagatgctcgagtcacggatataaaatgatgttgtatttgcacctaacctatgcatatcctcccttatacttgaaatcttctctaggttatttttaatacctaatacaatgaagacattttgtaattaattgtaatactgtattcttctttttattattttatattgttgtattgttattttttattgtttgttttcaagtattttcaatctgtggttggttgaatcagcagatgtggaacccagggatactgaggaataactgtactgcaatagtctatgaataaggaaataaatgtgtctgaatgaggataaggtagggataaagaaaagaagcactatttgaagaaactttttaaagaaatgaaacaattgttatctctaaaacttttaggtttggaagtcaagtgctttataaaaataatagttagaataatgtgataaatatcttttgtttttcaagagcagctagaacattttgttgacattgaggctagatgttgtggaattcccaaattatgttagcacactgataaaatatatacctcgtataggataaaatactgtggatttctctagtgtatcttagaatataatacatggcataatttaatatagttttcttttctcagcagaaaacatccattatcaagtatcataacaaaaaccacaatgctatcaattcacaagatcccataagtaattttattcttttaattgtattcaaaactatcttattttgcagctctttatcacctttaaagaaatgctctaaatctttttttattataatattacattatcaatcactgacacgaagtcatgagattttaaagttctagatgacctaatagtcaattcctttttattacagacgaatacatttatttccactgaacttacattacatcaagaagttaatataataaactctaattcccagtttaaacatttacccagaaattacatgtagatatttaatcctctcacttcaaacataatacaacatttgaactcatgtgtttttgtttgtttgtttgtttgtttttaacaagccacctttattttttaggagacaattctccatggttctcttgcattttacatgactttcaaatgagacaaggactacccctttttttttccttagatttttttcaagttcgttttcatagcaaacaactgaaaacaactcagggtctagacctgtaacaaactgcactgtgtgcaagtgccatctggccctcttcatgttaactggggctaggagaatcacacaaaaattctgatgctgtgactcctgctgtactaagaaataaactgccctttgtctctgacccaggaatcctgcatctgttgccagtattcatgaaactgtggccaactaatttgtcagtctgaaagtagagcaacctctcatacccttcggagttcttggcacttcttctcacttctgtaaattaatccagtcttaaaagcctaaaacaaaagtcatctgtaatagtatgttgaagtggaattatttctgtttcaatactcaacacaatgtcaatagaatagatattaagaataaaaaaaaccataagacacatataaattgcattactagaagggaagtaaaagaaactctactactcttgaacccccagccaaatcaaggtaacagaaagaagtcacaaaagagctatgtcatttttggaaattctcagcagagtaagtgatactgagtgtctttatttcctctcaaagaaaatcgtagtggattaatattttctccctctctctatatataatatatatgtataattatatatatatatataatttcttctccttccactcttcatataatattcaattaatcaatttgaataagcttggattcaggcacttttattgagcacttactgtgcaaatactccatgcaaataatttagggaaacaaagagaataaataatccctttctacaaatagctgatgaggggatttgggcatgtaatagtaattaattgaaacacagagtgtagtaaatgctgaaaagatggataaatataaagtaatgagaatgcaaaaaaaaaaagaagacttgatttcacctggaagatggatgcaaattttttaatgggctttgaaagcattggttagattttaaatgagtatgttgtaataggagagaaagacaagcaaaacaaagggaaaaacagatatatggttaagggatttatttgttaatctattactacatttttttcatttatccttagatcattttgtgaaagggaaatacatcttgggatctcaaactcattaagccagagggaaaagtcaagctgggaactgggtcacacaaatctgcattcgccttttcgttcctaaataagatggctacaagatgaaaggatatacacctccctcatgttttacagatgagaaaattctagtgggctccaagatcttaactgtaaaggttttctgttaaaatttaccatgacaatgtaaattgatgccttatcttcacaggtgcataggacagaactcaaagtcatctctctgcccacctcccacaaatgcatatctgactgtaccccttgccctattatctatcttatcttacgcaaaaatgcagattcacagagccaggcaaaggcataaatgactattgccccctacccacctcttacatgcaaaatgtttatttctcaatatcccaccatttcccttttacatttggagctctcaaaatcatcttcagagaaaggcatagacttgtctcccaggtgtgttcttaacttcggcaaataaacttcctgaaatgattgagatttgtctaggtcattgttcttgattgacaatttcaacattctttatatctaacctttgttcagttcaatctatcttgttactcttccaccacaaatatgttactaaaccatctctttctggtattatttttctccaaaagacttaacatggtgtttctctgatgggggacatttagaacctcacaaaatgacttccctctttagctttctcacattaactactgttattttccaccaaaaagttactgaatactatgtgtaagtttgaaacgtttattggaaataagaagggatggagaggagcaagtcactatggtaaattataggatgtgttcgggtgtctttctctccatcatccttcagaatttggtcttttttgaaggttttctcaatcctatttttccctgattacccctgaaagaagtgagtcttgacctttagaatatccccataatatgttaaaataaaactttaaaatctcaaattaaagtatagatattcttctttcaaaacaatagcataaatgtctggctgttgttgtagatgttgggttcatgggcaagttcaatttgtgaaaatccaataagtgatgtaaatctgtgtacttttctatatgtatcttgaacatcaattaagaacataccgtcacttgtgaagaaaggcacattaagaagtaataaatgggtctgcatatttgctaactgttcttttattatagtaaatttgtttcaatcatggctatttaacaacccggaagaacctgaggacatcatgttaaatgaaatatgccaagcacaaaaagacatatacctcataatctcagtcgcatggtggaatctaaaaaagttggtctcataaaagtagagagtagaatgatagctaccagaggctggggtggttagtggggcaggggaatgggaaggtgttggtcaatggatatataaagttagataggaggaataattttcaaaatatctattttacagcaaggtaactataattaataatgatatatcgtattattcaaaaatgtaggccgggctcggtggctcatgcctgtaatcccaacactttggaaggccaaggcagccggatcacttgagatcaggagttcaagaccagcctggccaacatggtaaaccctgtatctactaaaaacacaaaaattagctgggcatggtggcacactcctgaaatcccagttaatcgggaggcagaggtagaagaatcacttgaatccgggagccggaggttactgtgagccaagatcatgtcactgcattccagcctgggtgacagagcgagactctgtctccaaaaaaaaaaaaaaaaaggaaagagatattatgtattcttaccacaaaaatgcaaaccatgtgaggtactgcatttgttaattagctagatttaaccagtccaaaatatatgtttacttcaacacattatgtcctacataaaacacacaattttttctgtaaatttaaaaatacatattttaaatcattatctcagaaaaataactttgtaagatatttattttatttgataaactctaaaatatgaattttctttttctttttttttttttttttgagacagagtctggctcagtcacccaggctggagtgcagtggcgcgatctcggctcactgcaagctccgcctcccgcgttcatgccattctcctgcctcagcctcctgagtagctgggactacaggcgcccgccaccatgactggctaaatgaattttatttttcaaggctcagaaaaaacttactttatttttattgttttattgtatttatttatatacatatttttttgataaggagtcttgctctgtcgcccaggctggagtgcagtggctccatcgccgctcactgcaagctccgcctcccaaattcacgccattctcctgcctcagcctcccgagtagctgggactgcaggcgcccgccaccacgcccggtgaagtttttgcatttttactggagatggggtttcaccatgttagccgggatggtctcaatctcctgaccttgtgatctgcccggcctctgcctcccaaagtgctgggattacaggcatgagccaccgcgcccggtttattgcttacagtgacagttgatttccataatggttaaaataatggtaacttaagtgtgtacctcttgttttgtgaagaaaactaatattcaaataaaacaaacgcagtgtagataaaatcccaatggcaatttagaacgttgtcggtagaaaaacattttaatatttaattttaacacacaacatctttgaaaaactacaattttacatgtaaagtctagataaattttgtaattacaataaaataagcatgaatttttaaaagatgctgtgaaataaactagtatacaaattctagatcgactattaatcttcctcaccacacacacacagacacacacacaagtgtttgctaagatgaaaggcaatatttctgctatttatatctcattatttgaaatggcagacctatttgtttcctgccttcttaaaatctaatttacttactgctacaataaacacaggcttctctgattatttgcatccacacacagtgtctcaaatatcctatatttgtgtctgtgtataactgtgtacacatatacacacatattcatatatatattctttcatatatatatacacacacactcatatatatatgcctatatatatatattccttcctatatatatacatgtatatacacatacatgtatgtgagtgtgtgtctgtatacatctggacctgtgggtctggagtttacatctgaatcagagaaagagattttatatatatgatatatatctgtctctcatatatataatctttttatatatgtatatataaaatctctttctctgatacagatgtatatctgtgtacacacactcatatatatatatatataggaaggaatatacatatatatataggaaggaatatatatatatatataggaaggaatatatatagagagaggaaggaatatatatagagagaggaaggaatatatatatatataataggaaggaatatatatttctttctctgattcagatatgtatctgtgtacacacacactcatagatataggaaggagtatatatatatgaatatatatatgggatggaatatatatatatattcccatatataggaagaaatatatatgtatatttatatgagtgtgtgtgtgtacacagatatacatctgaatcagatttcatatatatatagaaagagataaagggataatatattatatatatatacacacacatatatatatacacacacacatatataatctttttctgattcagatgtaaattccatacccacaggtccagatgtgtaatcagtgatatcatatacatatctcattagcacatgaaatctaacaggtttagaactgaactcatcttcctcttgctttcttcctctatgtaccccatctcaagaaactgcattattatttatttggtcaactgacttagaaatctaagaattatccttacttccttatattcttgaaagctcatgcctaattggcatgcattcccatcagctctacctttatacactcatgagtgtgatcccctcctgccattcccactgccactgggtttgctttatttcaggccttcattatttctattctagattgcagtgacaacctcttaacttggctgcctgccagtagtcactgctgttcctctttaactcgttctccaggctgtggcaaaaccatggttttttttaatcaaaacaggatttttaaacatctccttgacagcagaatctgattatatgactcttctacttaaggtttccagtgcccatgggataaaatctaaatcctttaggaggcatacaacctctctccctgtatctctaataccttttaatgtctcttttcatacattatgttgtagccataccccaattctagtagttctgtgtacgtatgcatgtgtgtgtgactgtatatgtgtgttgagtgaaaataacagcaacaaagaaagagagattgaaagatgaagagacagagaaagagaagaaatgaagagacagagaaaccaaaatttcattgtactttttgatctggctcatgagatttcagatggttttatgttcttctttgtgttccctcctattttccataatttctcaattgtcatgtgtgttttgcaattagagaaataatctagccttacatgacacaactgaatatttgaaaactgcatagtttttgtttcattttaaagtccacctcatctatttacagccattctttaaaaccatatgacaaattgactttaatcattttgaaaattattatagtcagttacttttagaactcctacattcttataattcttctgtgaataaatatttacttcaagacaaaatatgtaaattaattatagcttagtatgacctttatacatattggaggagttataaaatatatattttatcaaagactatactcttagaatgcaataacagattttataacttatttatacttgtatagaagagttacataaatataatatagtttattcaataccatgtgattagaaattgaagtttcatgatggttttgatatttagtatatattaaatgctttctacaacataaaacagaaaggttcctgcgattgaggtacagatcaagtgtaaggggactttagagtcagtaaagattataagattacatttgatttttactttatttatttataagtcatttcacaatactttgttagactggcagaatattaagatgaaaaaaatacctggagtaaaatttagtttgaatgaagttttgacaaaaaatattaaaagtgagagataagcttgtaattggttaaaatcaaattgtaaaagtctcaatttcaggctaacaaggtttcacattattctaccacacaatgtaagtcatttcaatattttccacaaatggaagacaggattcacatttctgaacaggaagatgagctctcataattatatacaaaatagattgcagatttatggaggcaactgttaacatagataataattattctatgataatgacattaggtaccaatatttatcaaatgtttaactatagtctatgcagtgtgccagaagagatacatactgcctgaaatgcacacatatttaacattatgtatataatattatgtcatatattatataacaacacattctgaatactaaaattcactaagaattagtgttttcctactggttttcagatagggacattgacttagctggcttaactacatattcacaaagccaatactttgtaacttatttggaattcaactacaaagagaggaatatagaaatacagtgcaaggcaggagggaggtaaattaatgttatgagcaatatggacctgggccaggaaaatagccttatactaagtggaaaagcatagatgatagaagttacatcacttaggtagtcatggctttaaagagagaatgagggggagaaattgaaaatgcctgaaagcttgaaggagaagtcaatatctggaggatatttttgtgggaagacagatggcatagtcagttttcattttcaggtatcaaaataatagccagttagaagaagtttaaaacataaaagttggacttaagggaatgaagaatataggagacaggaaagaaatgacatcttactactgcacattttgttttggaaagtgtgtatattgggatgataattaaagccattatagtccaagaaaagggcatataaaaaacaggcacgggccaaagataaattattgaggaacatctgcatttggagcataagagaaagatgggataggagtatgtgaaagttgagtcacaatgtaatggatgaaaggttagctggtagtagtaaaacagagataacaagcaaatttttaaaatagtttttaaatcatgaaaaataagataatgcaataacttcagagggaaaaactacgagggagttttgtgtttttcttttttgggaaaggacaggagggtgacatgctttacagttagagaaagaactagttggcaatcaaaatattaaaaatgcaaagagaaaaacagaaaattgctagagtgggatctcagaagggagtaaatgagatcaagagcaaagtcacactgtctagatttaaagatatctactttctcttctgagacaaaaaagagtaaactaaaaatatatcagaggtgaatgagggggtggggagttcctgttgaatgatttccccaaccttgacagctagaaatttctgtcctatgaaaagtaggtgaagttggattgttattgagggcttctatttggggtgaaaaggtttgttaagagtatatatgagaaatgtgaggaggaacaatcaaagttgaaataaagaatgttacataatagaacctcacaacttctcttcccctgtcataggtattcagtatgcatagatcatagttcataatatagcgataggactctaatttaggagagtagttttaaaataccactctggtgtttatttgctgtgtttataattcttgttcaattagattaaatttgtcatttaccatagcacgtgtatcatccaagtagctgaggtagtataatttttttgtcaattatattttaatatttttcaatatactgattcattcagcaaataattattaagtgaatttcttcctattcaatcttgtgttaagtattggggaggaaaaatagaatgttactttgatatttcagcatcataataagtattaatcttacatgcaaccacaaaaaactcaatctgtgccagattttactttaaaacctcaagcaaaggtcaatatcagcaaaagtaattgaactcatgtattgaccacttactttgggatacattttctgctaaatatttccatatattctctccttaaccctcaggttaactgtatgatgtagtactattatttttctcattttatagaaaaggaaaccaacaaaagaggttaagtaaattgctaatgataatatggctaaaaatagtggaactaacttgaaccaaatctttgtgattcccaaactggtttattttactagggcaatactaaagaaaataaaaagtaagtaaatctaagaagaaaatttcaaaggatgaatgactctcaataagaataccgtctgagctcaacgacacgtctaaaactaaaatcaaacagacaaaatgacctcacgtgcacaaacacatactacctgaaaaagaaagcatttatctttataacaaagacaaattttgagaatttggaaattcaataacatatcgtgactttataaaacagctacatttaactttaaatattaaaagcaaaaatatggaacacaaggctagccaatatccagacttcgcattttttttcttgaaatgtgatcattacctcttcatcttccagtgatgctcatctgagcataaaaggaattgacaattcatgaagatgcaaccatattcatgtctaagtttctctggcaaattatacagattctctgaaaattatacaaattttcagcctgtttttgtctggtgttgtaagctacacgaaacttttaaagatcgtacatgtttatctgcttctagtgatagataactacatatcaccaacaactttcatatatcatatttgacaacattgttaaatattaatccatattctgatttaaagtgctttttctgtttcacgtaatcatagtgaaaacatttacttaaccattttaaaattgcattcaaattttttttgagtctttccataaacttgggaaacaattaaaatattattaatactgcattgtaccaataaggagagtgagacttgagtgattgagtaacttgctgtaagttgccctgtacgtttgaaaattgagggctgtaattaagaataaatgtttctgtatcatcattcttactcttcagcattgttctttaaataaaattcccggccatattttctgtccttgtacctagaacaaatatctacaggataagaatgttaggttgttccctttacatatcccaaatacccaaaatagtatctgttatgttttatataaatatgtgtgtataatatacatatatatatgaatatgcatgtatatatataaatacaattgtcctatccactagtaattttgcttcagcagatgtagtgtggtgctgacaatcaggtttaaataaatgatgtagttttctaaaagcagaaatttgattagctcttctatatgtacactagactcaacacttctgtgctgagctgaagtgtaatgaatgcagataaaacaaaataagaaaaataggagagacaggaaaactttggtaaagaatattaggggagaaaatcaaactaaacaaaaaaatcgaaacaaaataaccctaatggcctagaaagcaccctaatgtggtcttggtcaatcaatggtaactgcctgttccttctattcctgttgcccattcttgtgtatttgaattcgtagaagtgctgcaccaacttttctctctgtttaattcttgacacttctatgtagacaatgatgggtaagggaatgtggttgaggagaaaggagaaactacctaaagagcaacaaaagttgaagcagccagttgccccaaggtccaaaagaacttgactctgagaaagaaaagacagccaatagtgatgaaagaaactgaactttcctaatcctaaaacaagagagtgatgacgtggtcccaccaagatttcaaagaggtgaataaaagctcacaccctaactgtaatattattatcatttcttcaattattctttaagaaattgatggaatatgagtttaaaatattttgtcttacacaagttaggctgatgagctggttaagattttataatgttttggacacatagaaattaagtcagtttccaaaaatatgaatactcatatgtaggcaggtggtgtaaattagaagttgggtgccaacatgtgcctctctttagtttgcaatgctgtatttactgcaaaggagaaccacagagcagccattatcatcatgtgtgggatcttaacacatgccagagggctgaggaatcatacagagagcacgagtctcagtttcctcaaatcatctgtctgtttgatttttcttgagaagtttctacagtggtgaagttgagggatattttgtagaataaacacagctaatatttctaagattaaaatgagctgcaaaagattcctggataatacaaggcttagcaaattgagtcatgacttaagagaaacaatctggacgctgagctcagaaaagaactaggaaagacagaaaaacaattaaatacaacaaaatctttttggaaaagttagatcaagtaagagagaaacatatcacagttcttaaatttatattttaaactaaaccatcaaattagaaacttagtaagttctgttttgtttatttaaactaataaatattacttacaatgaatcacaaattgtcataggcagcaataaagaaacattctgtgaattttcacgaatagaaaaattgcattagaaataatgggagcaaatcaaatgaatggatcagaataatgatgtttgcagaagttaggggaagataaaataattatacatatatgtatagaaaataaatggtaaaagaagcaagctgtaaatttaaacttccaaaataatgctaatgcaaaaatacattaattaaatacaatttaggataagagaattagaaaaaaactataaataatgctattccttgaaaagaaatgcagatttttttttcaatcacataaaatgctcaaagtaggcacacaagaccttgcctagtgaaagtcctttatcccaaacaaattgatgacactgtaagatttgtttatacctgccttgtatagtttagttgttaaaggcagaaagacctgaatttgaaatccatctctacctgtattttaagctagtgctttatttacatgctgattcttaatgagcaaatacatcataatctgtgttgttaggaaacagtgtttaaagatttaataaaaaatgcactggtatacagtttataactccatgtgtaaaccgaagacctcagtacattgtattcatagtttctgtactagccagattactcccagctaaaagtaagacaatcagtaataaaattagctaaaaatagagaaatttatcatctcatataaaaggaagcagggtaggcttcaggattatttgttttaaattggttatttcaagacctcatcaaaagtcaaagcctttcaactttgtgggcatgagtctcagaccggcattaaaaagacaactgtagggcttggtgtcagattcaggaaaggaggggctgtggtttgaatatgtcccttctagaattcagatgttgccaatgtgatagtatttagaaggtgaggttttttagaggtgattgggccataaggcccaattgtgactgtgcccttataaaaaggtttgactaaggcagtttgtcttttttgccattctaccttccaccatgtgaggatacagtgttcctcccctctggaggacgcaggactcaccagacaaccaaacctgccagtgccttgatcttggactttccaacccccagagctatgagaaaaacacatttttgttctttataaattacccagtctgtacacacacacacaaatgaactaagacagaaattgatacagggattggactattgttgtaacaaatatctaaaaatgtggaagcaagctttggaacagggtaatgtatagagactggaagagttttgaagggattgctagaaaaagcctctattgatataaactgaaaattacgggggatctaccaagggctcagaagaggagaactgcaggggaagcctcagttgtcttagtgattacctaagtggtcatgactagaatactggttgaaatatgaacaataaaggccattctgattaggtcccagatggaaatgaggaatatcttattggaatttgtagaaaaggctatcctggtttacaaagtggcaaaggctaggctgtctgtgtcctaggactttgtgaaaggcagcacttaagaatgactaatcaggatatctgacaaaaaaatatctcttagtagaaaattgctgagggagataccagggatttgttaactgattatggtaaaatgtgagaagagctaaaaaattaaaagacagaatttaacccacttacacctagtgttccattattggaatgctaagcttgtgggagttatttataccctgcttctcaaggtcatcaccaaggcctgatttttgacaaaaatatttgccacatctggcataaatgagttaaaatcaaaaggaaagcaaaatgtaaaaatctgtaaaattcccaggctggccacataaacaatgaaaataaaaatctgtctagcagagaaaaccaagggatgggtcatctactattagataaggagactagtttggatagacgggtgccaggtgctattcatcaagacagtgggagagtgactctgaagacatttcagggtttttaaatgctgtcatgcccaccacaggtccaaagtgccagggccttggtggcagaacagtttcaagtgaggaagagctcaggttacctgtggaatttcagtactccaaatgttcttgaagcccagaactccttcaagtctctgcacccattgtttttgtacagtgctaattggctgcttcagttgtggtgtaggtggcccagttgtgcctgaaatcaatgttccagagggtgcaagcattgagccctaaccatgccaccatgatgctaaatcttcagtcaagcagagtgcatgagctgtggaggcttggatttcaaatcatctctacctggacttcaagtgatacctcagagagcctcaggttctaggcagagaattttgtcacgggcgggagcaccaaagagagtcctcaaagggagaggcatagtgcaggagggggcagggggacagctacatcacagatagcacccactagggcaatgattgatggagttgtggcagcagggccgctcgagaggccaaagcctgggagagccacaggcactgaactccaacccatgagagctgaagggagctgtacccagcaaagccatgctaatagggtcctctggggcatttggggcccaaccttaccccagtgtgtccaggaagtgggccatggagtcaaagattgttcacatgtggtttgcctcactgtgttttggactcacttgggacctattacccctttcttcttgcctacttctcccctttggaatataaacgactgtcttgtgtctgtcttaccattacattttgaaaacatgtaacttgtttgctttcacaggttcagagctggagaacaatttaccccaggatgaaacactcttgagtttcacttatatgatgtttagatgagactttggacttagactttaaagttgattctgaaacaagtaaagagtttttggagctattaagatggaataaatgaattttttttaatgtgagaaaatcatgaatgtgagggagctagggatataatgctatggtttgaatgtgtcctctccgaaattcaggcgttgccaatgtgatagtattaaggggtaaggcctttaaaaagggattaggccataagggctcttcccttctgaatgggattagatgtctttattaaagggcttgatggagggagtttgccccttttgtcccttcaccttctatcatgtgagggtacagcattcctcctcctagtggatgtggccttaccagacaaacaaacctgtcagttccttgatcttggacttcccaacctttagaactctgagaaaaaaaaaaaaaatctttgttttgcttttataaattacccagtgtggtatttcattattgcagcccaaaaggactcagaaaaatagagttcagagtgataaatacactgtattttcttaaactattttttctttaggaagcaagagattacctactgacccaacaagtgaagggttataatgcataaaaataatactttttcctgtgtgatttatttttcctgaatgacaaagcattcctaacagtgagagttgaatgttatttcaggaaatagggaaggaggtaatgtgccccgtcactgacaatgttaaaatgatcaattgcagatattctagagcagactcaagaacttgagacaaatatataaatcttagattactttggcatatttttttgttttctttgtaagttaccatttattaagcatgcatttattgactgcctactatacgccaaccagtagaaggacacaattatttcactttaggcacaaactcaaagtaggcactggagatacaaaacatgaatagatcaattcctgttggcactatttagaaattaaagagaatctagactctaaaaactaataagaataaataaaatatgtcatttacatttaatttctagaatgaaacacagtaaacagacattctaaaaaatacaattatgttttataaaaacctgtgatatgtcatcattttgataaacaccctttttggtgaaatcttatattgcaattattgtatttatatttattaatgcattttatacatgttagttaaatttactacttcatataaatatctaacatttagattccaaattaagctcaaaataatggaaaagatattgtaatgaggaataggaaagaagaggctgataataatagccagtttctctggaggcatgatctgggaggatacagctgctttcctttaagcagtggccagtgtcttcagaaaagaaatgtttttatgtatctttacatgaaatagatagatactatttcaaattacaaattaactccaacatagggaatcttaatataatgatcaaggtatgtaatctaaatcttttaaaaagaactctgatcttcatttaaacttaatttcaaaatgaagagtaaacattagcatgttgagtggataattaaaaaataaattatattcttatagcattatttttgtatgcaattagcattgcattctctgcttgaaggataattcatacaacccattaccctgtcccaaataaaaacttcctgggcatagcctatcttgtctttccttacactgattcattttctggaagaccattttgttcctttttccctttttcttacttgtgaatttttactaacttaaggcccagttcatattatcctctctgtaaagacttcccttgagacccaaataaatttgttgttccctccaatatgttcataatcctactataccatgcatcacagcgtaataaagttaactattcatggtactctgggactttcttggggcaaaagcaagagcaacattgcatttaattttgcatttttaaaaatattatagatacttagaaaaggaggatgctcaataaatgcttattcagtaaatgaggtatggataattatgcaaacagccaaagacattacttaaattttggctgaacggaaggacatcacaaagtttttcataaattatatgaatatgtgtgataatgtaaacaaaatagaagagaaaaatgctccactgatggccatagggggtagccagagtgtgaatgtccaattttttttataatactttggtcatgacctatgattgaatagatatattaagaacgagaaggaataaaattattcatcacatttattctcttaacaattagttaattgtacaccttgctacggtttgaatgtgtccccccaaaggcatgtgttagaaacttaatcccccaaggaacagtattgagaggtagagactaatgggaggtctttaggtcagagggctccactctcatcagtggattaatggattaatgcccattatgaaaggacttgagacaatgagttcagtctcttgctgtatatcaccatttcttttcctttccgccatgagatgatgaagcaagaaggcttttgctagatgctgacctcttattcttggacttcccagcctccaaaaacatgaatcaataaatttctgttaattacaaattacctagactgtagtgttcggttatagcagcacaaaacacactgaaataactattacacttattatgcacaaatcgcactaaagccatactggtttattttagaatgtacaatttccccagataagacaagctccggtatgttaagagtcttagcttagacagattctggttccctactctgtagtatagaaatttgatccacttccaggtaccagaaaatatgagctctgagtttatggtcccgctcacatttcagctcgcaccagcctgtggaagatttgtggcagtatatccctcctcagccactccttctcaagttctgtactctgaaagcaactgcaatttccttgacttttgctgcattcagcaaagtcaaagaatatttgacaaagaatatttgtcctcagaagatctgttaaccaatgtgtaactctagctttctatgtgtttctcaaaaacatatcgtatatttatctaaactataaacaataaacttaaaaaacaagcatattgttaatgaatttagatgaaatatccatctattattttagatggattgtataaaattcaccttgtatgagagaaattaaaaggcactttatctgtgttagcatacctaggaactagttacagcaagctggttttgttttgctttcaaaaaattaaatattcacctaacataattttttgtctttcagatcagacttctgattataaaaacatggaaaattgaaaattaacctgtcacccctgaagataaatagttagacatttttcccatcacagaatcagaagacataatgttattttccaaagagttggaaggtaaaattcaagctaatcaaaactaattatcccctcccaatagaaagaagaaaaatatcataaaggatctgatcttttcagttttaaatatgtgggtcaattgttaatgacatcttaattttttttttttattttgagacggagtctcgctctgttgcccaggctggagtgcagtggcgtgatctcggctcactgcaacctctgcctcccaggttcaagtgattctcctgcctcagcctcccaagtagctgggattacaggcgccggctaccatgcctgggtaatttttgtagttttaggagagacagggtttcaccatgttggccaggctggtctcgaactgctgacctcgtgatgcgcccatctcggactcccaaagtgttgagattacaggcgtgagccaccgcacccggccaatgacatcttaatttttaagaaatcataaatgtatatgaaaaccatagtaaaatgtctttacatatagctatttgacatcatggatctgaaattaaggacaactagctgaagtattagcttagaaagaaagttctgtttctgaagattgtaaaatatctgcggactcatggcaatgttaccttttatttgtgactcttaagaagtatactgtttgtcctaatgatttgtcttacagttacactattttcgttcaatatctaatagttttagcattaaggtaattatctgtcatcttaaatgtaatatctttattcttatcatagtgttatcttggaatgaaatatattatcatgttgatattctgtgatacctagcgcatatgactttcagaagtttgtacccatattatttattctgcttaaattaatttaataagcaaagcccacaagtaaattttaaattaagtataatgtggctacacaacaacacagaaatgatctagataaaatatattaatcactcctctggatttcaaattacttatgatttattctgaatttattatatggctgtcaatggccactgagctacctgtttatacacacacaacacatatatgtaccatatttatctatatacatattcaaaagagcaaaaaaataactaaacatttatgcttatgtgtttgcatgtgagtatagtcttctttggaatttgattaataatttcaaaataagaaaacttttattttctccaagagtaagtttttctataaattgtaaaataattcataatagatatttaaagtacacaatcttgcaaatagaagtaaaatcttagttcctattttgatttaaaatgcaatattttaaacctatatggatcagagaatactttgtactggtcaaggataatcaaaaattgctaacttgttttcttatgctaaccaatggttgtgggccacacttaaagtgaggcaaaactggaaaacattcaaaaagcagaatttaactcttttatacgagtctggttatatcaggatttaccttaattaaagcttctgagaaagtgggcaaacccttaataaccatttgagttatcaagatcttctgttctgatgggcagttgtgggacggggactctatagtagtaatgatcaccactgttgagtggcatgtccatccaatttgggtggtgaaacctgaaacttttcaaagtagcagtgttggaagggattcactatgatcatcatatttcaaggctggaagcaggaattactgaaatcttacctgttggaaaccatattgacctaaacaagagaattccacagtgtaaaaattctctgaccttaaatcaggaatgggaataaaagagtaaaaaaagaatagtttattccgctttgtccaccttaaccactatatagtcgtctttattgttattatttctattttcttcatttcttacaggtgcggttctaaattgtaaatgtggttatcttttaaaaattttctcattaattatcccatatctcaacatctcttctttaccatccacaccagcatattccctctctccataccttcccaggttccgatccaaacctcattacagaaaactaaattagaaattagattggaaaaaacatgtaaatctctcccagaatacagaaaaaaaagagagaaaggtaaaaaattaagatgtgagatactgaaggcagaatcagaaagagcttattttaattgtgttcatgaagaagagactaaaacaaaaaaagacatgagcagatatcagcaatgaagagtttaaagaaatgagaaaaaaatgaatcttaaaatgaatcaataagggctactgattttcaggaaaatttgaagaatgatgcaaattctaagaatattcctcttccagtagttaggcatataaaaaggagagtggtgagaattctaagaatcttccttttccagtagttatgcatataaaaaggaacagagatgctgataattttaacataattcctaatgctttgcctgcttctcagaagctatgattaagacaaattctgagaaactcatgaatactcccaaattgaaagagaaattttaataaagacacaccaagcagattttctttttcttattgagaaaacttgagggagatggaggagaatgtaaaagtggcaagtgtggagaaactagtgaaaaagagaaatcatacaatccaaagcaagttttgatgagtgatatgttacagcgtttataaatgatttagtaaattacgccaattccttagttagaatgaagtgactttgaactaaatgaccagacaaaaagcacaggactctgttcataacccaataagtgtcaagtctacacaaaagtgacaaaacaaacaaacaaaaaaacccaccatcaaaccataggtatcccatatggtggaaaaggagtaatggaacattcatccatagcattttagaacaaatggctgtaaacagaattacccaaatttaacataaccaagaaaaaatatattaaattataaaaatatattaaatactcctaataagatctcatggcaataataatagaaataatgttctgagacccttactgtctaatttacagaactagaactgtaaaatcatgtgctcttgtggttgtgctcttaaaagccaataagtaggcgataatttgtcaatggcagcaataggaatttcacatgtaactgaaggacattttacacactcaagctgtgtccagaaagaaaacagacaggctgacacaggcttgaaagaatggtgggcactctcctggttgttctaatggggttgactatgaactacaggcccagactgttcttccttgttttacatttacatgtctaaggggcagtgagatttcccaatgcagtgagtgacttgagaggcagctagataacatgaatcaaaaaaaaaccaaaacaactacaacaacaacaacaacaacaacaacaacaaaaacacaggaggcaagaaagaatgttaaaaggaattagcattctatattttcttgtcctctttttccatagggaagactgaccatactgtacatattcgaaaactgtgatttaaacatatgcatggacactcacatgcacacatacacacaatctttaaaaacaatgttattattttaagaactcatttagaaaataatatcttgaggtaaagaaaatgtttctaaatatcaatatataatagttttatttttcatgttctataacactaaagtaaattaatttctctatctagttctattttatgacttttttctcatttccctttctactttatttgtatctgcagagagagatgagataaacattgtgaagtaataaccatgttctttatataaataatttgaaataagaaattcaaactaacacataaagaacaaatggcagtagattccttgattatatttattagcaatccaattattacaagataaatattttctcatactattaaacctacatttaaatattatttatcttgtatatgaaaaatgtgtaatatatttaagaatattttactttactgtttaaccctaaccccatgtctatcatcctatagcagccaatatgactaaaggcatttctattttacatatcagctatttaaagtaaaacatgtattctcaccatcttaaccaaaacagaaaggcaaaaatgcaagtagtcactttcaatatataatgaaaatctagctaaattacttatcaagagcagtgagaaaagttgtagtgacaaaaacaatgcatctacatcctttaaggaaatttccatctagttttggagctagaactaatgtatgaatcatatagggaatcatcattaatctgaagggttcttactccaaatacaactgaaattgcattggttaagtgtttaataccctacttccaaaatcaacaggaaaaatagaaatctcctgatattttctgaaagcaatcacattgcaatcttgtgaaatgtcctgcatttttttttcttggagtgttcctgaattataaatgtttaagaatggcagcaggcaaatctattctaaataggacagcaagggggaatattggttactgttcatttgatcctggtgtcttggttaaataaaactattttgtctaataacttgccatcttcttattcaagaatataaatacattgggattaattttgtggtgccccaatataattttgcttgaattgggatttagaaataaacttttttagaaaaccagattttatcatttttctttttttaacttataaacaagttctgcatagaaactgagcagatagtgagcactcattgcttgggccctaaatagaatacaaatacataaatcatcattcttatatgagactgtctcatttaactgaacattttttactagcatacccaaaataatattacacagtgtattactattcatgatttcatttggtcttcactctaccataaggcttattcagatacaaggcgggaagagttagcacagccagtgtggtgagcaagcctttcttgagtatttaagattttagctaggtcttaacaaatggtaagattcttagacatgaagatgagactctaggaaattcagagtgaaggaaaccatgtttataaccctctgaaggaagaataggcatgctgaccttgtagggtggtgacaacaggagctcaacaaattatattgcaaatataaggagtagactacttggagagggccttgaaaacagaattctgacatcatgaaatagaaactattacataaaatattttggcaggatatgacaactaaaaatggtgcttaagaaaaattgataatgaagtggtattggagaggagatgaagtatacagcatatagtgagatcattgcagtaacacgatattatgtaaaagaaagatttagtgatacatattttgctgcaataaatgtattcataaatttggagtaaaagcaagagacattatttatgtattgaggcatgtttttagtcttgtcaaattattccactctgtcataaaataattcaaaatacattagtgttaatggttgttgttttgacccaaacaagtcaaagggatatatatattttttaaattaaaagtcactcaaagtcatgtctatcagtgaatttatgcacaggcactaactggataagaaaatgtagtgctggatcaaagcagtgacagagaagaggccgcctattttttgacataattgtacaaacccatgctatgatctaccttccagtctttcaatataaatttatttaatacattttgatcttttaagactcctggaagccatatttaatttacatgaaaattaaatgtgtggttggtctatatgtgtaagctaaaaataattttacttgtgtgtgtgtgtatgtgttgcatgtcagcccttgacattctgtttgtcttgtctatattctggtttgagaactcattcattttcatgactttgttcattacctctttgctggtaatctaaaataccatatgtgttgctcctaaggaatgtttttagaacctttgttttctttttgtttgtttgtttttagaacttatttttttggtgagagggaagtagattttttttctacgtggaatattgcatggaagccaataaatttccataaccctcctctcaattcctactgtttctttactataaccttattttcaaatttccacaagatttttgtcttggaatcatctgtcctttttttataggtgagatgcaggattatatctggatgcactcacctgactaatttctctgttctctcattgattctcttaagagtatcctctgtctacataaaaaaacaggaaaaacaaaataaaacaaaaggctgggcacagtgacacctgtaatctcagaactttggaggacccaggcaggaggattacttgagcccagaagtgggagaccagcctgggcaacacagtgagatcccgtctctataaaaaataaaaaaaaataacttgtcacagtggtgcatgtctgtagtcccagctactcgggagactgaggcgggaggttcacttgagcctgggagctcaatgctacagttagccatgattgtgccagtgcactcaagcctaggtgacaaagtgagatcctgtctaaatagaaaataaataaataaataaataaataaaataaataaataaataaaagattaaaagaagaaaaaaacactcatagaaacctcttacgtgagtgcaggtaaagactatctggatacttgcttacatagccagttgctctggcaatgtgaaggggagcagaaaagaagagggatatgagagggtatttgaatgggttaaaaactacagacaagatacatcaaagattgaacggtaaaaagcatttgatataaagaccagaaataataaaagagatccagaatatagatcctccaataacaaattgcttgtggacagccactatccatcagctaagatatttaaaagtccctctgatcagacatcttggaacttcaacacctgtatagtgatggagatatgaaaggacatttttgatgtctcaacaaggtgataatgtcccgatgcaggtgacaatctcctcataaacaagaacaactatggtaatactaccaccgttgcagagttactagaaatactgcaccatagtctttcagatgtctttagttttcacctaaccagtttttaagtttacaaatctattctgtgtatgcagttatgtcacaaaagtaaacataactttcaatttgtttctcttctttgaacaattggcaataacctcctagtattagaaaacctaacgcatatgataactttcaaggttttcaacactgtgactccacttattttcagtatttcacaaaatcagttagttcattttagcctagcaatttccctaaaaaacctactacctccatattaatttaacatattatgtcaattcataggaaatcagaggtattgacatacctctacattctctagactcaaagccaatgtaaaaggttcggttcccatgagatctgcagtcaaataaactataattaccttatacaatttagaacttaattatgtactatatgtttattgctcactgtttttatatacataagtctacactagatccttccaattcccattaaaaaattcctagtataagttctccaacattttattttatcactaaacaaatgcttattgaaggcttgccatgtgttaggtgttattcaatgtgctagaaacatagggaatgagcaaatcacaatccccaccctcaatggactcatcctccagtgataacattagatacccattccttccccaaccttatcagtgtctagctgttgaatattgctgaagaagttcacaaaatattatatgtttcatcactgggcttacctgacccgtatctaagcctgcaaaccatactcattctgtaaacacatctcaagtgatacatttttacaaaatctcttctggcatttctctattagatgcaataccatgctgctctaaaaacaccaaatattgtcttactaaactctctgataaaattattacttgtatatttaattttatcccttctccattttgactgtatttcaaagtgttcatgtcatactgatctttacatttcctttgtacccaagcctcatgtcttatagaacgtagatgactcaatatacgttttaccattgattttgttctttattcattttatccaataaacagtttcttaggtctgtgtcagatgttgtggaaaaatttacacttccttgatgtcagtgttaaaataatctataattgaaaatcaaataacttattcacatcctaagtactataataaagcgtgaaaaatatagggaggagaagtctttattcagaagtcaatctgtttcacaagatctttgtgggtacacaatcatgacatacctttttatttacttcaaatgtttcatatgttattcttgttcacatgttcaaattgttttttgaatttactaaagataactgttttgccatttgggttaaagttggccaatatagtttgaccaatactatctacttctttaattctttaagagaacaaaattctgccaatgtggcacatacaaatgaaagataaaattaatgcatgttcttataaagaacagctcatgatagagcattttcacaaaaaagtaatgccagtaatgtcaattggtgatggagaaaaattcagagatactggagataattttccgctatcatcctgaagcaccatgactctcaccacaaaattaatgtcctttttccccgacttttcacttggaaaaaaaaggtagaaatatacagtatagctgtaaaataattgttctccagtaggactcatcaaaacatgtgtgaaactttcccagacatgcaagttttattgcattaaatggtatatattaactttagtgaaattcttgttgacaaattctgccagcctctgtttactccctctctatgtactatgtactaagcatacagagggatttgctcattgtagctgcctcaaattaagcaaaacagatttttactgtgctcaattacaaatcgtcgttttcacttctgccttaagaaggcttgcaaaatacagtctggccttcttggaaggaaatacctgcttgtgaggaaaattgtatctagcagcccaaaagaggagcttcgaagctcctcaggcatatgaaaaacgaaagaaatctcacagatatttcacaaatcccatgtggtgatatctgaatggtgtgtactattgttttaaatatagattaaaaaggtaataaaaatctcttttaactggcctgtaaggctttgggtaatgaaaatttcaacttcattatacattttgtagaaactgacattgggcctgatctaaaggagggactcaaccctaattttggcaagcacataattaaaaataaggttatgaaaaggcagagaataatttacattaaatgatacagatctgagaaaatttccagactgctgactgcattggagttgcaagctcagcaacatttcataataagtagctcccacagcacataaactgaatcacttgacaaaaggcagatgaggaatttgaaaccactttggatttgacatttttgttgaaatttaattgaaaaagttatagaagtgaagataatgtgaggaagcagtgcataaattatggcatctctttcacacagttttatcacatggcctcatcaccttcctaaaaaatcatatcactgatttcccagactcttatatgactagagtaatatagatcacatctcaatacattattaatttaaagtaatgagtttgaaagcaaaaagaaatgactcttttaaaattacatattcatctatattcaatgttgttcttgttagtaaaaacatgacagcttgcagcatttttttaatctcgattacattctagacagtctcatgcttcagttgaatatctaagattaattgaaattgtttagaaaattacatgaaggaacaaaatgttatctgataaatattcatcaaaagtgtcaagttctattgtatttaaacttgaataagctagtccattattagtatggttgaaatacttaatactatttaattcttggtacatagcaaagattcactcatatatagtaagagaaacagacataaatacaaaaacaattggttgctaatggtaattaaaattctctttttaaagtattataagtagaacaaaacatatccattacattgattattactaataaaattatgtaaaaactttgtaactgttgcttaaatgtaaagacttcaatctcattctgaattaaccagatcagattgcatcttaaacttatatattatcctctgcatttgagatattttcttataaaagtaacttctacttttgaagaactcatagctaactggaaagaggaaaaataagcaacaaataaagtgtagtcaggaaaaagtaggaataaagagggggaagtgacaagcactaaggtttggagagatgcaagggtactttaagaggtttgagtaggaaagtatttatggagaatggagaatgagttggggaagttgattgtaggtcacatttttagcatacaattcccctactttccaaaaaaataaatgttttccttctcattttttaatggaatgtcttctgaacctactttttttcagttttagaatctgaagttccatattgaggcttcatcataatttcagttatcagagaaatctagcaggaaatttattttctttgaatattggaaataaaaatgtggacacattttaatcagtaagtaagtgtgttgattgtgttactaagttgaaaagtggcaatcaatagccaaaccttcatcttacaagcaatggcttatcagtactatgcagggttactatttaaataagcgtattttacacattagccgaagaaagataccataaagcaacaggtgctcatcaatactggcactttgaatgctctgatacttcttatatgtttaagaaaaaaggaggagaatcatgaaaaaagtcacttttctaaaagagagttactgaaaactataagataaaggcataaacatatggtccaatgctttaaactttcaacctgacttctgttcaatagaaataattatataagtccagtaaatactttaagaaaaaacaacattttctaaaggagagtcgctgaaagctataagataaaggactaaacatatggtccaatgcattaaactttcaacctgagttttgttcaatagaaaaaactatccaaggccagtaaataagaaagaacagcacaaaaaaatagatatggttgatagataaaataattaataaaccaaataacactttatagaaaatgttatgcctctcatagcattaattgtttttaaaaagttacacaatatcataactgagaaaaataacatatcttaattgcatcttgtgaactctcagtcaagtggtgtggcatggccatttttaacccaaatctgtacttttcctaattttatagatttaaaacacatattctaagccatttttacaaagagttttaattttaaatcagtggatatttatcatttgtttttattaatatatttttatttcaatgtaactgcctctaaacctagaaatgatatttattttacctttcagcatttgtattatttcagtttttggcacagcttaatttttattcatttcagcacagaaatattccttttatgtgtaaggtaaaaagcaagatcttagaggttataaatagaagttttcatgcttttgtgctattttcattcattgtgagtctgtcttgttattcaatagcttatttaacaaataactgtgaacacctgctacatgctaagtcatgctgctctaattgctgaaaaacagcctaagacagagagaccattgctgcactcatccactcaaatttcctcattcttagagtgactttccagggtgagtacaaatgatcagaataaattttcaaatgaaactcttagtcttgtggtcacaaagtcttaaatttttgatgttgtttatatcttcaaaggacccaagctgttgttcagcttgtgaattgcaaaataagttctaatatagcactgaaaataatggcttttatacgcaataggggcattaggttattgggcctatttgtgtatgtcactttcttgaacacagcatgcaacgaacacttcagtcatacagactgtatcttcagacaacatgaaagctcaaatatttccttctcggaaatgcagtgaggaaactgactgttgagctacatctctttttcagaaaaaaaaggaacatcttagtttttcatgattatgggggctgcattcatgaaaaaaaaataaggattatggtaactcctcttataatttaatagtctcacggagaaaagtgcagggctgagaaaaacatgaatagagaactctttcattctttcatatgttaatttattgaacatataactaagtattagcagctatgtggcaggtcatactataggtaataacatattgaccaaaacaaacagacgtggtgactgtacaggttagttaacttataaaacagtgttttcataatttaaaaatctatttgtaataaattttcctaaacttacttaaaaatattgaataaagaaaatattaatgacattcttgtttcttaaataataatatgagttgtataactattttgcatccagcagaagatctgctgacatgcttacattcctggcaattttgcaaaattcaggtaagactattttgcactgaaacagagttttaaaaactctatcactccctttgatttttaattggaaatttcaatggccttttgaatgtatattttgcaattgttgatctattttccaacatagttacaaatatgtttacctggaagtatgggaaacaaaatatttagatagattttatgtagtctattcagtttggtacaattgaaggggaacattatgtccatttgaaaatatttatcaacaattattctccaatgcatggatgtattgtttaacccatatagaaaaaaatataacagtttttcctgagctttcagggttagaagtcctgggtttgattctcagtttagccacttgcaagctatgagattttggccaactttattatacattatgggttagtaaccttaatgacactaataattgtatctaattagatgttttaatataataacaaagtaccttgtacattaaatgtccaatatatttcagtaatcactattaacattctctatgataaatttaggtaaaagtgcatcaaaacaaaacaaaacactgtcctatgagcttgtgtcctatgagatgttttaatataataacaaagtaccttgtatataaaatgtccaatacagttcagtaattattattaacattctttgtgatacatttagctaaaagtgcatcaaaagaaagcaaaacgctgtcctatgagctttatttccctgtatttattccaaagctgtattggcatatcctctacattgaggatatatcctctacttcatggtttatttttctccttaaaatcccttcttatctcttttatatattgccaaaaggaataactggcagttcctgcgtaggcagtctgaaaatcctacagtacccaaagttaattcaagtttgcaaggacttttcatattgcaaattcatgatgaaaattcaagaacttctcatactgcaaatttcttcaacttaccatgataataattaatatttgtagtactgtcaacatttaatgcagtgattatcagtaatgtttctaatagtatgaagtgcttttccataattttgcttcataattttcactttaagaaaggttacatcactagaatttcatgccatgtaactactgctaattgtgtacaatatcccatatacttatggtgatcatacatcttactttgcttgaaatcatctggatttacacctttttctttggtatagtctcaattcccagcactgtgattgagggtcacctttcatatattaaataatgcaattattataatgatatattaaaaatgcaaacagaactatttaagaaataaccaacttccttacagctcaactgcattatgaggcaagtaatatcaagtggaaatgttatagcatacagaaataggtatagtctctaatgtagaagcatttaaagtcagataattagattcatgaaacttttgttatgactgcattaatgtattttaatatagtaaacagtagcaataccattcttcatttctattagtttgttttaaaatatttattgtttaaataatttaatccatttatttgtaccaggtataaaatgatacaaaaaagtataaattaaaagtaaatctttcttattcccgaattccagttatcctatttttctctcctgtcctaagcacttcttaccagtttctactcctttcatttcaagtttgagactattgtctgactttcattttaactggaaataaaatcatagatgtttatagcatacagaaaccgtaacaatcactgaccacaaccctcatcatctgccaaagagcatagtcataaaaatgttaaatgatttgcccaaagtcagatagtgacagagctcagaattttcctggaagtgtattcaattgtttctcacacttgattgtgatcatttgttagtaataagagaaatttaagcatatgaacacacagccagaatacttgggctccagtgctcatttggtttctcattatgtttctggccttgggaaaatagactattgcctcactcagcctgcttcagagatgtatatatacccatagatagggtggagcaaatgaaaaaataaatgtgaggatactgtaaaagataagaatttgtaaaaaataaaaatgtcacaaagtcacagtaaaaataggcagtgactttatcaaaataatcgatacgatttttttttttttttgagacagactctcgctcagttgctcaggctggagtgcagtggttggatctccgctcactgcaagctctgcctcttgggttcaagccattctcctgcctcagcctcccgagtagctgggactacaggcacctaccaccacgcccagcttatttttttgtattgttttagtagagacgggatttcaccgtgttagccaggatggtcgcgatctccttacctcgtgatccgcccaccggcctcccaaagtgctggtattacaggcgtgagccaccgtacccggccaagaatcagtaggattttaaaagtatatgaggctgggtgtggtggcttatgcctgtaatcccagcactttgggaggctgatggaggcatataccttgacctcaggagttcaagaccagcctggcaacatggcgaaaaccccgtctcatacaaaaaaaaaaaaaaaaaaaaaaaaaaaagctaggcatggtggtgtgtgcctgtagtcccagctactcactagggaggctgaggtgggaggatcgctggaacccgggaggcggaggttgtggtgagccgagatcgtgccactgcacttcagcctgggccacagagtgagaccctgtctcaaaataattaataataataattataagcatatgaaagtacattaacaaaatatcctaaggtcaagtctttagtggctcatcacaaatgatatttggactatttaattatagcaatttaataaatctgtcgtcaaaatcaaaagtgactatggatacataaaccttaatagaaagagcatcacagtaaactcaggctgacatagaatgaaatttgacatgcaggagcaaagactgaaattgaacatttcagggaaggactgtctataaatgttgacattgtttaaatgtaagcaaccacgttggtgagagacaaggaacctcatctctaaacgtacatgacaagaacctagcattcaaatagcattcacaaaaggacatcataatcctattatatgtggctgacaaatttcaaaccttccaaagtctataacctacaagattaaaaaaatctttcaacatgatttttttattcaagacctcacatttgactgtcagcctaattggaaactactatagaagttcatatgatagatatcttagcacaaagtagtgctctgaaggtctagaaggggttcaagtctcaatttcacagcatttcatttccaattccacttgtataaaagcatgctaacccagcaccgacagaagcagagctacatcaagacggtacatgagtaggattcaaataaaccctctgacaggagaaatcactctcttgttcaaagtatttgtggaaaatatttgacttcaacattaacataagggacaaaagtgtctttattaagagaagagaaatgctgcaatcacatgcatgtatattcacagaaacttcgttgaatatactataaatgctgggatctaacatggtgaggcaataaacttgatctcattggctttgtattgtttgaatttgaattctggctgacttatttgctttttgattatttgacacattcttggttactctgagcctcagtttctttatgtgcaagtacaggtcataatggtacaagcacctcacagagttgatgacagctaactaagaaaacacatggaaagtgtccagcacactgttagtgttcagaacatgttaactattatcatgaagatgttcaacaatttcaaataagtgaaataatcattgcttctcttcaaaaggcattagtttcttaatttacctagatgtattttattcccttaatggccattagagaaaagcgaagaaaactaaaaaccatgagcagtgaagggaataagaagtctatttttaactttcattttaaagtcaaagctacatgtgcaggtttgttatataggtaagcttgtgttatgggggtttgttgtacagattatttcattaccaggtattaagcctagtactcactagttattttccctgatccttttcttctgttggaaggtttatttaaatcctactcatgtactgttttgatgtaccttccaccctccaccctccaatagaccccgtgtcttttgttcccctctgtgtgtctatgtgttttcatcatttagctctcacttacaagtgagaataggtggcatttagttttctgttcctgcatgagtttgctaaagataatggctttcagctccatccatgtgcctgaaaaggacatgatctcattcatttttatggctgcatagtactccatagtgtatatgtaccatattttcttttttgaatctactgttgatgggcatttagtttgattccatgtctttgctattgtgaatagtgctgcaatgaaaatacattttcatgtttctttatgactggatgatttatatttctttggatatatacccagaaatgggattactgggtcaaatagcttttctattttataggtctttgaggaatctccacactattttctgcaacagttgaactaatttacactcccaccaacagtataagcatttctttttctctggcagcatttgttattttttgactttgtaatagccattctgactggtgttagatggcatctcattgtggtttgatttgcatttctctagtgatcagtgatgttgagcttattttccctatgcttgttggccacatatatggtttcttttgaaaagtgtctgttcatatcatttgcccaatatttaataggggttatctgttttcttcttgtaatttgtttaagttccttatagatgcttgatattacacctttgctggatgcatagtttgcaaagcttttccccattctgtaggttgtctgtttatgttgttgagagattcttttgctttgcagaagctgttaagtttaattacatcccatttgtcaatttttgctttttctgcaattgctttgacgtcttcatcatgaagtctttgcccattcctatgtccagaattgtattgtttaagttgtcttccgcagttttataggtttgggttttacgtttcagtctttaatccatcttgttaatttttgtatatggtgtacgaaagggatccagtctcaatcttttgcatatggctagcctgttatccaagcaacatttagaaaaataagtcttttaatgattgattagctcgttaattggagatgcatgtaagaagtagtaactcagatactcaacaaatgagtacctgcagaagaaacaaaccctgaatgatattagtcactagacaactgagcaagcttacatgagtgccttttgctatctgaaaggagaaccacactagccttcgtatatatccatctgcttacccctactgcacattttgaaacaacataatactcttcttgcgtgaaaacagggtgaggttgggtgaggtggctcacacctgtcatcgcagcactttgggaggctgaggcaggtggataccttgagtccaggatttcgggaccaatctggacaacatgttgaaaccttatcccttcaaaaagtacaaaaattagccaggtgcagtggcgagtgcctgtagtcccagctacccaggaggctgaggcaggagaattgcttgaacccaaacttgggaggtggaagttgcagtgagtcaagattgtgccactgcattccaacctgggtgacggagtgagcccctgtctcaaaaatcaataaataaaaaagaaaagaaagaaagaaaggagggtggctcagaaataaaatatagactggcaaatatatgttttgttttgataatgttcaatctaaagaaaaccatttctaacttaaagataaggaaaatagtataacttgaagatgtacctttcattcatactcaaatatattaatcagcgcccttttacatttcttcccttctccattgtcacaacgctaacccaatgtaccaccttgcaaaaccctcctaaatgcttctactttagttggcttaccatctaaattccgcatacgggtcaaagcattcacttagcaatttaaatctcatgatgtgattcccctgcttaaagaccctctattaactttccactgtaatcagaaaagagaaaaataaatgaacaacaacaccaccattaaacattaaagccaattaatattaaagtctcataggtatcaatcctttcccatttgtctgatttcatctcaaaatactctctcgctctagtttattatactccatcatgatcattatagtccagccaaacaagtctttttattcttcagaataccttgtaagtttttgtaccttttattaaaatcctattttaatgaaaatctgcttctcaaaattttcattgagttaccattaacttgcaatttaagtaggtgctcctcatagaaattcttgacttcaaaatctaagtttccattttctctctctctacctcaataagactctgtttgcttcttcattgtttttaatcactatttgatttatttttattttgttttattattattattattattattattattattaatattttgagacggagtcttgctgtcttgcccaggctggagtgtaatggtgtgatcttggctcactgcaacctccacctcccagattcaagcaattctcctgcctcagcctcccgagtagctgggattacaggtgcatgctgccatgcccagctaattttttgtattttaataggaacaagagtttcaccgtattgcacaggctggtctcaaactcctgacctcaggcagtccacccgcctcaacctcccaaagtgctaggattacaggcatgagccaccccgccttgccatttttatcactatttgaaattacatttatacaataatttgtttatcattattgttcagcatagcatcccctatatttaatcacaattgattagtaagtttccattaatatattattaaatgaatgaacaaataggtctgaggaaatgaagtaaagataaatagattttatattgtcggctaccctgtgctatcgtcagacaagggcctacactgtagagactcctgggtccaaccaaaatctcagacaactttttattattccttcttttaatttatcatttggtctttaatcttttcagctacttctttcctttagtggttgtaatttttttcccttgatttctgtattttggtattccatgcaattgttaagaacaaaacaaaataaaaccaaaagaaacaaacaaaaacaccctgatgcttttcttcctgtaatactactagttgagaataaatttgaattttgtcattattttatttccatttttcaagttattaataaggttgaataatttttcttatgtttctcggaaatttgtttttactcaagaagcaatttgagccctgatttcctttcctggttccctgacagcacactctacaagttgctgtgggaagcttgaagactggcatacagaaagcatggttgcagtgttctcagaactgaggcccaaccttttcttcctaacctcttcccctattctgaacgctagaatccctttcttctcctctcccctttctccatgatataagccattgacttaaaaccttgtcctaccaacttagactgctttactttatatttctccttttcaatcctcctactggagaaattcaagccaaaagaactcaagttgcattcacgagattctacttatctttcctcatcttattgttatacctattttatttttatttgcattccattctttaaatgatctttcatttattaacatatacacattttaagcttattatcaattaatgcttgttctttatattttagggctcatattaccaggttttaaatgttttgttttattaacttgggccttttattttatttatcttaactacatcttctttttaatcgtttgcattctgtacatttcatattttaactcattcaagtgtcttaataattatgaaaggtatttaaaaagatgctagatacaaaataaaaattacatattcattcaaatgcatccatgtgtaattttgttctttaagcaataattatctttaattatattttgttctgtattttattttttattttattttactttatttgagacagggtctttctctgtttccctggctagagtgcagtagcaaaatcacaacatgctctaacctccacctcctgagctcaagtgatcttcccacctcagcctccagaatagctgagacaataggtgcacccacaaagcctgattaatttttgtattttttgtagagatgggattttgccgtcttgctcaggttgttctcaaactcctgagttgaagtgatccacctgtctcggctctcaaagtgctgggattacaggcttgagccaccatacctggcctatttagtctactttaaattgcaaacatccacttatcactctcccttctttgttctaacgtgtaccgtgtagaatattacaaaacacagagacacatacaactgaaattaatacacataatgtatgtttttttatctttttgttatgtatgtatatacatttcaaattcgtactaatgttatcatatttggcaggtctgaaaatggaaatattctctcctatatcatattgcatcgtgtgtgttctagaaaggtcacttatggaggctagtattcattttagaaagcatgctatcagtgttcttcattctgcctattggatggattgaacttcacaaaaccctgtctttcacttaacactagttagatacaagattaaattttgataaatgtttgattcccagagtagcttgtctatgagaacatttcagttgacagcatgaatcactcattaaatcaggtattgaatcacataaaaccacaaagcagagcagtttccaacggtaattaaatcacggtccgtgaaatcacgttctagagctggagctaattactgctttctgtgactactgctgcaacatggtcactggagcacaggaataaagtcaataccggatttacccaaagttagatggtttttaagagttaatatgtggaaagttctgaaatgtgtggctgaagaccatgtgactatataaaaaaaggaggccatagtactttaaaaaccttcctaccaacccataaaaatatgaagtgactgataactacaaatgttgtcatttataatatatatattttatgcccactttacgtccactgtctatgttgctcaaagacaatccatatttcacttttctatctgccactacattaattctatggagagaatataataaatgccaagttattatctaacaaatggacaactcaatatatgccattatttgaattttaatccattatagttgcctacttagcatcaattgtgctaaacaaaatacattatttgagaaagcaaggggtaactcagatgaacaatagataaataattaaaatgtatatctgcaaagtcacaaaggcttattccactgtatgtctcttgccagctgtgtgaagatcttaggaaggctgaatgcctgtttagagttacaaattttcttgcttataattctgatattttctgacattactgacattaatctatatttgagagagatgtaatgaagtttaagaacataatgcctgtaaaatacttagcaattgaaacacaggcactgataaatattgctggacatacaataagcacctaataaatgttatttaatgatcttgttgaaacaatcataatattgcatgcgattttaaaattatagacataattttaaatagaatagatgaatagaaataatatcataaaactgaggctaaatatccacttggtaatgcaaatgtttctgaatgtattgtcatacaaaaaattaaaaaaaaaaattagttgaattggaacaacttattcctgattacatattcccactgttcagctctactgcagattgtatcaccatagagttcaatgtaataatagaatacacataaaataaagcactacagtctcatatgattcgtgaaaatattatgctttttagaaatttccttttcaattttctcacctattactacattaaatagtctcagtttattgatctgggcaaggagggttaacccaagcactgatatcatatatgaatcattactttattcaatgtgcacaaaagtatttattgatattattaatcaaatggcatttttcctaaattgatttggtttataatattaggaaggtttaggtttgaaaactgaaggcctacacttactattgctcacttactatctgcataaccaagtgcaatgccttagtttccacatctctaaattgaaaggaaaacacaaacatgtagtttgggtttatattcaaagtcaaatgagctaattttgtgaaaggaccaagtattatgtataattaatttatacaatatattatagatcacaaaattctaagaaatatatagataattcatatttctctgaatttcatataggtgccagcaaaaataggtttaatgaatacctttcacaagaaaaatggataataggggaagcaaaataaaatgagaagaaaattagaaaacaattgttttcaaaaaaacgattttatatgctaagaagtttctcatggactaatagtatttgatagtgtttttgaaaaataaaactaattgtagttgatacaggagaaaaaacaatacaatgaagaagtgatagccatttcaacttagggcatatagttatggagtaactgaacaccacatcaaaaaaaaatggaatctaggcacaggccttagactttcacaaaaacaaaataaaaattaatcacagtcctaaatgtaaaatgcaaaattacaaacttcctagaagaaaaaaaggagaaattctcgataactttggggttggcaatgattttttagatacaaagccaaaggcaaattctatgaaaaaaattgatgaactatactatattgatattaaaattttctgttctccataagacaatggcaaaaaaatgaaaatataagtcacagataatatttgagaagacacatctaataaagtaatgttaggcaaacatacatagaaactttaaaaactcaacaaaaagtaagacatccaatttataaaaagcgaaaaaccttaacacttcaccaaggaagatacatagttgtcaaataagaatatgaaaagacattccacatcatatatcacaaaggaaatgcaaattagaacaacaagtagatgctactatatacattttggaatggtcaaaacccagaacattgattatgctggcaaggacatggagaaacaagaactccctttcactgctggtggaaatgcaaaatgttatagccactttagaagacagtttgacagctttttacaacattaaacagccttcaccgtatgatctagcaatcacactccttggtatttacccaaaggaattaaaaactttcattcatagaaaacctgcacaaagatgtttatagaacctttattcataattaccaaaatgtggaagcaaccaagatgcccttcagtagattaatggataaactgtgctacatctagacaatggaatatattactcagggcactaaaatgaaattagctactggccagatgcggtggcttacgcctgtaatcccaggactttgggaggccgaggagtgggggatcacgaggtcaagagattgagaacattctggtcaacatggtgaaaccccgactctactaaaaatacaaaacttagctggacatggtagcgagtgcctgcagtcccagctactcaggaggctgaggcaagagaatcacttgaacccgggatggggaggttgcattgagccaagatcgtgccactgcactccagcctggcaacagagcaagactcattctcaaaaaagtaaataaataaaaattaaacaaaagataaaaaagaaattagctactaagctgcaatggactaatctttcttctccaaaatgtcaacattcaaatattaaatccttaccccaaggtgatggtattaaaaggtggggttttgggaagtgatcaggtcatgagtggagctctcatgaatgggattagtgcccttataaaatattcccaagataactcttttgtcctttccaccatatgaagacacaatgagaaagtactctctatgaatcagaaagctggtcccactgacatcaaatctgctgttacctttatcttggactttccagcctcccaaactgtaagaaataatttttgttgtctataaactacccagtctattgtattttgttatagccatcagaatagactaagacatgagctatgaagagaaataagcaagtatattactaagaagccaatatgaaaatgttacatgctgtatgattccacctatatgacatgctgggaatgtcaaaactatggagacagtgaaatgatcagtaattgcctgaggttgaagggaaagatggataaataggcagagcacagaggatttttagggtagtgaaactattctgtatgatgctataatggtagacacatgtcaatataaattagtccaaacccatataatgtacagcactgagaatgaaccctaaggtaaactgtggactttgggtgataacgaagtattactatagactcatcaattgcaacatatgtaccactctagtggaggatattggtaatagtggaggttgtgcatttttggggcagggatatatgggaaatctctgtaccttcctctcaattttgatgtgaatctaaaactgctttaaaaaatctttaaaatgatagtggccaatatttttggacactataataaaagatgtatgtgaattgcctcatttatccccaaaacaaccctatgaaatacatatcattttgaatctcatcattatgagccccatattggctttacaatacctcagtttcagaacagctattcaaattgtccaagggaacatttggtaaattgtccactcaaacttgtgttgtgtgactccaaaatccatacttttaatctctataatttactatgcctctattttttgttaactgaaaatgtacataagtagactctcctaataattttctgaataatactttctacaacttaaaaaacctggacgttttataaaatacagtttctcttagccagtaaaatttttctagcagtgtcatataaagtcattataaagcagtggcatagtatatctcaacattcctaatctctctattttttcctctcacatttcaattctgaaacaatatatctgtcacttgtcagggtggtagtgagaatacaattttatataaacattgaaactctctgcagaatataattttattgtgccatttttccctcatactagttgtaaggcactaaagaatggacatggggagaattaccatctttatctgtatacatggggagaattactatcttttttctgtatatgtgtgcatgtttgtatgtatttctgttgaagagggcatatttcttgtattattaaaattaattggcaggtttactgaaaagtagaaccaacagatacgcataaacattataaatcacattaacagtattcaaatcaacctgtttatttcattttatgatattacaagtcaagctccccataaagctgtccaaattatttctgcattcacacatacttcataatctgacactcaaataaaaagattcatgcttctgggactccaaagttatcagaaggtaaacaaacaactagtagaaagtatgctgtttatcctgtgataaaggctgttggcttgaatatttcacattttgctgggatcaaatcaggatattaaatattttgtttcatgcctttagatgaagcaatcctgagtcaagctatgcagcatgatcatgttatgtacaaggaatagttcctattttgccaggtttctacagttgtgagaatctaagcagagaagcacttccagaaagcaatgggaaaatattagtcaccataaatacatatggaaaaatctcctaatgaaaagattctcaagcaagtgttctattagagattatttttgactcttcttagggcctgacatacaagtaattatctaggagttactgctactagcactataattactaccactactgctacttgtgtaaatgactggatttactcatcaaaataacttaattgattgacactttcaacagatttaatagattatctgacatcctgtagataaatgcaaagtctgctgctacctttcctttcagccatggtagtgacaatgtaacatcatgcctgaaatcccttgcacgtgcctgaaaagcacacatgtgtgcacacaaaggtactcatattaggttggggcatataatctctattatatgctgagaaaaaaattgaaatcattgtcatttaattaataagtgtctagtttctgcacctctgattcttaaaatataactttttttttcactgaggggatagctacttatactaaaatacctaaatctgttagcagcatatttttctcaaaaaggtactatgagccaaaagacctaggatgtcaaaagcaaatcaagcataatgtagttacgagttttcatttacttctaattctcttcatcagtaaagctttgtgataattttgatagtaccaatttatacttgtgaagcaaatgaaaacaaagacattttaactgtgagtgaaaataacaaaggtgctaaactattatcatttgagacatcataagcacaaacgattatttttgggtgactttttaacaggctcccaaatcattatcacaataaatagaatattttaaaaaatctcaatgagatgttatttttctttatcatctgtcctctccttgcagtttaatagcaaaatatctggatgaaagatgaaaatattcagccagctaattagaagggctgtccacaggaagctcagcaataggacttgtctacagatgtgagacacaaataagaatcacaatttaaaaatagaagacaaataatgtcactcccctgatttcttgctacatttaaaataaatacaaattccatatctagaaataaagtttcctgtctatagctctgatcttatctcctaccatctacttccaatccccattcttatcctctagcacaatgtcctaatctgttcctcaaattattgaactccttttcccctttcatctaaccagaaaatgtaatgctcaccctttcccccagttatggtaatgttgactttgaatcattcaggtttcggttcaaaggtcccctccttagaaaggtcctgttgtatgactctacagtaaggcaacctcagcactatccagtcactatcatgtctatcactttgctttgactttcttcaaaacacatactgttggcttaaatagtcttgtatgtatctgtttacatgctttttaactgttttaccactctatgaacccaggagagtagatactgtttccttaccaatgcccttctgcccagcatctagaagagctcctagaacttttaagaagtcaaaattatttgtgaaataagtgaaataacaaaaatagtggattcttagtatactgttaataaaaactaaagctccattagaatagttagaccagtttatttatagtctatgctgtttgtttagttttctacaagttctttggcttgtctttctccttcttaaactttaaagttctctagacaatgctcagatacgtgctatttcataccgactaagaataatttggttaaatggagattaaaaactatgtcgtgattgtgattcagtttttattactgttattgattgctttggtcaaaatacaaaggccactttatacatacaagtcccactattccccaaacacagtattttccataatttattaatttttatttacacatttatttttgttcacatatgtcaggaattttttttgctttatttatatgctatttacttatcacaaaaattgtcagcttattatatttttaatcgacgtataagggtattttcttaaaactttttttttcttaacagcagttctctcttatttctcccttaatatctgtttctttcaccaggataaatgtgtgtgattttattttaatttttaataaaagaatcaattctctggttaatcagttctacttttttaaattaattaatttatatttaagttttttactgttctcttgggattgatttgttttattctaagatctgtaagtgaatgcaaaagtaacatttatttttttttaatttgagttgtttctaattagagattggattgttaatttgatatgcagtgttctctgtatcacattttataaatattgttcctttctctcaaaactatttttttaagttttcacaaattacatgaggcttttattttattttattaatttataaatttatagtcttatttgtgagtcttgggattgatttattttattctaagatctgtaagtgaatgcaaaggtaactttttttttaatttgagtatttgagttatgtttctaattagagattggactgttaatttgatatgcagtgttctctgtatcacattttataaatattgttcctttctctcaaaactatttttttaagttttcacaaattacatgaggtttttattttattttaatttattaatttataaatttctagttttatttgtgagtgaataaagttctaatgttcgatagcagactacagtgactatgcttaatattttttatactacaaaataactaaaatgagaacttgaaattatactaatacacaaaaatgataaatattcaagctgttgtataccccaagtgctctaacttgatcattacacattctatgcatgtaataaacacatctactccataaatatgtaaactattatgtatcaacaaacgaagaaaagagagacatgaaagaggtgatttctctcttgaccatgtgaggatataataaaaagatggctgtatacaaaccaggaaaggtataattatagttactctagtctgctatcaaacattgtaacttatttcttctatctaactgtatgactgtactcattaaccaacctcccttcatccccacaacacttctcaggctgtagtatctaacattctactctgtgtgtccatgagatcaagttttttggttctcatatatgattgagaatatgtagtgtttgtctttttgtgcctgtctcatttcacttaatataacctccagttccattcacgttgctgcaagtgacatgattttattctttttaacaacagaatagtattccattatgtatatataccacattttctttattcactcattcatgggtagacacttaggttgattccatatctttgttattgtgaatagtggtttgacaaatatgtgagtgcaggtttctctttggtatattgatttatttttctttgaataaatacccaaatacccagtagcggaattgctggataatgtgatagttctatttttttttttttttgagaaacttccatgctgctttctatggtggttgtactaatttacattaccaccaacagtgtataagagtctaattttctccgcaactctgccagcatctgttactttctgtctttttaataacagtcattgcaactggggtaagattatattttattgtggttttcatttgcatttccctgatgattagtgatgatgagcattttttcataagcctgttggccatttgtatgtctttttttgagaaatgtttattcgtgtcctttgccaatttttaatgcgattatttgttttttactgttgacttgtttgaatttcttgtatattctgaatattgttctcctgtaaaataggtagtttcaaaatattttcttatatttaaaaagttgtctctacagtctgttagtttggctgtgcagaatctttttactgtaatgtagtgcattttgtccatttttgttttatttgcctgtacttttgaggtcttagctgtaaattctttgcctactctaatgtcctgaagagtttttcttatgttttttgttatatctttgcatcaacataatacttgtatagtttcagatcttatgtttaagtttttaatctattatgagtttatttttgtatatgatgggagataggggtctagttttattcttctgcatgtagttatccagctttccaagataaattcattaaagagactgtcctttccccagtgaattttcttggcaattttatcaaagatcagtttcctgtaagcatgtagatttcattttgtgttatctattctcatttatgcatacatttttatataaatgccatgctcttttgttcaccataggcgtgcactatgctttgaaataaggtagtatgattccttcagctttgttttattttgctcaggatttctttggctcttctggatatttttttgtttcaaatgaattttaggatattttttatttctgtgaaaaatgatagtgctattttcatagggattacattaaatctatatatttcttggggcagtatggtcattttaatattaattctaccactccaagaccttggatgtctctccatttgtttgtattctcttcactttctttcatcattgtgtgtgtgtgtgtgcgtgcacgtgtgtgtgttccctacagatctctttcacctttttgattaaatttatgagtaagttctcttttttgtagctattgtaaatggaattgccttctctgctccttttttggttattattatttttgagacagagtctcactccaacacccaggctagagtgcagtggtgcagtctgggctcactgcatcctccacctcctgggttcaagcgattcttgtgcctcaccctccgaagtagctgggattacaggtatgttccaccatgtccagctatttttttttttttttgtatttttagtagagataggggttgccatattggccaagctggtctcgaactcctgtcctgatgtgatccacccaccttggcctctcaaagtgattacaagcattagccactgcacccagactgtattatctttttgatgttctgttagatttggtttgctggtattttgtttttttttttttttttcatgtttaaaataacaattttttttttatactttaagttttagggtacatgtgcacaatgtgcaggttacttacatatgtatacatgtgccatgctggtgtgctgcacccattaactcgtcatttagcattaggtgtatctcctaatgctatcccttccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaaccgccacactgacttccacaatggttgaactagtttacagtcccaccaacagtgtaaaagtgttcccatttctccacattctgtccagcacctgttgtttcctgactttttaatgattgccattctaactggtgtgagatggtatctcattgtggttttgatttgcatttctctgatggccagtgatgatgagtattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttcttccattctgtaggttacctgttcactctgatggtagtttcttttgctgtgcagaagctgtttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacctatggctagccagttttcccagcaccattttttaaatagggaatcctttccccattgcttgtttttctcaggtttgtgaaagatcagatagttgtagatacgtggcgttatttctgagggctctgttctgttccattgatctatatctgttttggtaccagtaccatgctgttttggttactgtagccttgtagtatagtttgaagtcaggtagcgtgatgccttcagctttgttcttttggcttaggattgacttggtgatgtgggctcttttttggttccatatgaactttaaagtagttttttccaattctgtgaagaaagtcattggtagcttgatggggatggcattgaatctataaattaccttgggcagtatggccattttcacgatattgattcttccttcccatgagcatggaatgttcttccatttctttgtatcctcttttatttcattgagcagtggtttgtagttctccttgaagagtatccagccaaactaagcttcataagtgaaggagaaataaaatactttacagacaagcaaatgctgagagattctgtcaccaccaggcctgccctaaaagagctcctgaaggatgcactaaacatggaaaggaacaaccagtaccagccactgcaaaatcatgccaaattgtaaagaccatcgaggctacgaagaaactgaatcaactaatgagcaaaataaccagctaacatcataattacaggatcaagttcacacataacaatattaactttaaatgtaactggactaaatgctccaattaaaagacacagactggcaaattggacagagtcaagacccatcagtgtgctgtattcaggacacccatctcatgtgcagagacacacataggctcaaagtaaaaggatggaggaagatctaccaagcaaatggaaaacaaaaaaaggcaggggttgcaatcctagtctctgataaaacagactttaaaccaacaaagataaaaagagacaaagaaggccattacataatggtaaaggaatcaattcaacaagaagagctaactatcctaaatatatatgcacccaatacaggagcacccagattcataaagcaagtcctgagtgaccaacaaagagacttagactcccacacaataataatgggagactttaacaccccactgtcaacattagacagatcaacgagccagaaagttaacaaggatacccaggaattgaactcatctctgcaccaagctgacctaatagacatctacagaactctccaccccaaatcaagagaatatacatttttttcagcaccacaccacacctattccaaaattgaccacatacttggaagtaaagctctcctcagccaatgtgaaagaacagaaattataacaaactgtctctcagaccacagtgcaatcaaactagaactcaggattaagaaactgacttaaaaccgctcaactacatggaaactgaacaacctgctcctgaatgactactgggtacctaacgaaatgaaggcagaaataaagatgttctttgaaaccaacgagaacaaagacacaacataccagaatctctggaacacattcaaaacaatgtgtagagggaaatttatagcactaaatgcccacaagagaaagcaggaaagatgcaaaattgacaccctaacatcacaattaaaagaactagaaaagcaagagcaaacacattcaaaagctagcagaaggcaagaaataactaaaatcagagcagaactgaaggaaatagagacataaaaatcccttcaaaaaattaatggatccaggagctggttttgtgaaaggatcaacaaaattgatagaccactagcaagactaataaagaaaaaatgagagaagaatcaaatagacgcaataaaaaatgataaaggggatatcaccaccgatcccatagaaatacaaactaccatcagagaatactacgaacacctctacgcaaataaactagaaaatctagaagaaatggataaattcctcgacacatacaccctcccaagactaaaccaggaagaagttgaatctctgaatagaccaataacaggctctgaaattgtggcaataatcaatagcttaccaaccaaaaagagtccaggacaagacggattcacagccgaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagacaattttagaccaatatccttgatgaacattgatgcaaaaatcctcaataaaatactggcaaaccgaatccagcagcacatcaaaaagcttatccaccatgatcaagtgggcttcatccttgggatgcaaggctggttcaatatacgcaaatcaataaatgtaatccagcatataaatagaaccaaagacaaaaaccacatgattatctcaagagatgcagaaaaggcctttgacaaaattcaacaacttttcatgctaaaaactctcaataaattaggtattgatgggacgtatctcaaaataataagagctatctatgacaaactcacagccaatatcatactgaatgggcaaaaactggaagcattccctttgaaaactggcacaagacagggatgccctctctcaccactcctattcaacatagtgttggaagttctggctagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaaatcacaagcattcttatacaccaataacagacaaacagagagccaaatcatgagtgaactcccattcacaattgcttcaaagagaataaaatacctaggaatccaacttacaagggacgtggtattttgttaagaatttttacatctatcttcatcagggacattggcctgtagttttctttctcgttgtgcctttgtctggttttgatatcagagtaattccagcctcataaaatgagttagagagagttcccccctcttcaattttttataatactttgagaagaattggtattagttattctttatacatttgggagaattcagcagagaattcatctaaccgtaggcttttttgggggggagaatttttattactgatttattctcactacttcttttaagtactacttttcctaatgctcttgctcccccccatctcccccgaccaggcttcagtgtatgttgttcccctccctgtgtccatgtgttctcattgtttagctcacacttgtaagtgagaacatgtggtgtttggttttctgttcctgtgttagtttgctgaggataatggcacccaggtccatctatgtccctgcaaagtgcatgatctcattcttttctatggctgcatagtattccatggtatatatgtactatattttctttattcagtctattattgatgagcatttgggttgattccatgtcttcgctattgtgaataatgttgcagtgaacatacacgtgcacgtatctttgtaatagcatgatttatattcctttggttatatacccagtaatgggattgctgggtaaaatggtatttctggttctaggtctttgaggaattgctacagtatcttccacaatggttgaactaatttacatttccatcaacagtgtaaaagtgttcctatttctccacagtcttaccaacatcagttgtttcttgagcttttaataatcaccattctgactggcatgagatggtatctcattgtgggtttgatttgcatttctctaatgatcagtgatgttgagctttctttcatatatttgttggctgcataaatgtcttcttttgagaagtgtctgttcatgtcctttgatcactttttaatggggttgtttatgggggtttttttgtaaatttatttaagtttcttgtagattctggatattagatcttttcagatggatagattgcaaaaaatttctcccactctgtaggttgcctgtttgctctgatgatagtttcttttgctgtgcagaagctctttagtttgattagatcacatttgtctattttggcctttgttgcaattgcttttggcgatttcctcatgaaatctttgtccatgcctatgtcctgaatgctattgcctagattttcttctaagatttttatgtttttgggttttacatttaagtctttaatccatcttgagataatttttgtataaggtatatggaaggggtccagtttcagtttcctatggatggctagccatttctcccagcaccatttattaaacggggaatgctttccctattgcttgttttagtcaggtttgtcaaagatcagatgacgtagatgtgcggtcttacgtctgagttctctattctgttccattggtctatgtgtctgtttttgtaccagtaccatgctgttttggttactgttattctcactacttcttattgatctatttcaggttttctattttttctttatccaaacttggtagggtgtgtgttttcaggaatttttccatttcctctagggttatgagaatatggtgttcataacagtctctaatgattccttgtatttgtgtggtatcaattgtgaggctcaattttgtttcttgtttatttgagttttgtctctttatctttgttagctctataacagattatcaattttgtttaaattttttttttttttttttgagatggagtcttgctcagtcaccaggctggagtgcagtggtgcaatctcagctcacagcaacctctgcctcccgggttcaagcgattccccagcctcagcttcccaaatagctgggattacaggcatgtgccaccgtgtccagctaatttttgtattttagtagagacggggtttcaccatgctggccaagatggtctctgtctcctgacctcgtgatctagccgcctcaggctcccaaagtgctgggattacaggcataagccactgtgcctggcctgtttaaacttttcaagaatcagctttttgttttactcctcctttgtattttttttttcagtctttatttcatttacttctgctctgatctttattgtatcttttcttttgctaactttggatttgttttgttcttggtttcctagtttcttgagttgcatgattagatttttatttgaagtctctttatttttgatgtaagtattcagtgttataaactatcccttatagtactgcttttgctgtatttcacaggttttggtaggtggcattatcattttcatttgtttcaaaataatatttgattttcatgttaatatctatattgaaccagtggtcactcaggagcatgttgttttgtttctatgtatttatacagtttccaaggtttttcttggaattgatttctagttttatttcatcgttgtctgagaagacacttgacatgattttatttttaaaaaatgagacttgttttgtaatctaacatatggcctattctagagactgttccatgtgctagtaagaagaatgtatattttgcagttgttggataacatgctctgtaaatgtctgttatgttcatttgctctaaagtccaatttaagtccaatgtttctttattggtttatttcctagacgatctgtctattactgtattgaagtccatctttctctttagttctagtaatatatagtttagctctataaatctgggttctccaatgttgagtacatatatatttagaattatatcctcttgctgtgtttttttttttttatcttcttggtgactctttttttttggagacagtgtctcgctctgtcactgagcctgtagtgaagtggtgcgatctcagttcactgcgacctctgccttcaaatggttcttgtgcctcagcctccaaagtagttgggactataggtgcacaccaccatggcggctaattattattattattatttttggtcttttagtagagatggggtttcaccatgttgcctaggctagtatcaaacttatgaactcaggcaatccactcactcagcctcccacagtgctaggattacaggcatgagccatcatgtgtggcctgtgacctttttttttttttttttttttttgagatggagtcttgctctgttgcccaggctggagtgcaatggggcgatctggctcactgcaacctctgtctccttggttcaagcgattctcctgcctcagcctcctgagtagctgggattataggcatctgccaccacgactggctaattttggtatttttagtaaaaacggggttttgccatgttgatcaggctggtctcaaattcctaacctcgtgatccgcccgcctcagcctcccaaagtgctgggattacaggcatgaaccaccacgccagccaagtctttttatctaatataagtatagctactactcctttttttttttggtttttatttgagtggaatatctttttctgtcactactttcagtctatatgtatctttacaattatactgtttcttgtaggcagcctataattgtatcatttttaatccattcagctcatctataacttttaagtgaataatttaatctatttacattcaaggttattggtatgtgaggttttcttcctttcacagtgtatttgtctggttgttttgcatgtgtattcaatgttcttttctttttatcttatttttttgtccctatggtttggtggttttctctcttccttccttccttccttccttccttccttccttcctttcttccttccttcccttccttccttcctttccttccttctttcctttccttccttctttcctttccttccttccttccttctttccttccttccttcctttcctttctaccttcctttccttctttctttgagatggaatctcattctgtcacccagcctggagtgcagtggcacaatattggctcactgcaaactccacctcctgggttcaagcgattctcctgcctcagcctcccgagtagctggtattaaaggcatgcgccacacctggctactttttgtatttttagtggagacgcggattcaccatgttggacagactggtctcaaacttctgacctcaggtgatccacctggcttggcctctcaaagtgctaggattacaggcgtgagccaccgtgcccggccagtggttttctctaatgatatcatttcagttttttctcttctttatttgtgtcattactttgcgagtgagttttatacttttgtatattctcatgatggcaactcttgtcattttacttccaggttcagaacttctttcagcatttcttgtaggactggtctggttgtcatgaatccatcagcatttgctttcagggaaaggctttgtttatttttcatttatgaaggatcatttttctggagttagtatccttgggtagaatttttttatttcagcactttgaatatattaccccattctctcctggcctgtaatgtttatgttgagaagtccactattagtcttatgggagtgtttttgtaaatgactagatgattttctcttgctagttttggaattatctctttgtttttgacttttgagagattgactatattgtgctgtggagaagatattttggcattgcatctgtctgggggattgcttggcctcctgtatctggatgtctaaatatattgctagacttgggaagttttcatctattattcatcaaataggttttccaactttttcattcttcatcctctgaaatactgataatttgtatatgtagtcactttatgatgacccatatattatgaagtctttattcgttcttttttattcttttttctttatttttgactgactgggttatttcagaatacctgtcttcaagttctgtgattttttttcttttgcttgagatagtctattgttgaagcccttgaatataatttgtattcttttatttcaatagttttaggggtacagctcatttttggttctgtggataaattttttagtgttgatttctgagattttagtgtacctgttacctgagcagtatacactgtaccaaatacgtagtcttttatccctcacccccttcccaaaccccccgtggatccccaaaatccattatatcactcttatgcctttgtgttctcatagcttagctcccatttatgaatgaaaatatatgacatttggttttccatttctgagttacttcacttagaataacgacctccagctccataattttcattctattcaatgagttcttcgcttccaggatttctttccttttataatttctctttggaaaatttctcattgtttctttgtattgtttttcagaattctcttgtatctcactgagcttctttaaaatcaatatttagaatccttttttattctgggattttgggactttcttttttattgtgatgtgttgctagagaattattgtgttcttttgggtatatcccacttccttactttttattgttttctgtgtctttatgttgatatctatgcacctgttgtaatgctcacttcttccagtatcctgaatttgctttctttgggggatgtttttgtgaagatgaatccatgttttgtagggtcatttagctttgattctgcatgcattcagtaatgtagtctctgtatgatttctttggccttaaacatcacctgtaactgtgatgtccttggtgacttagaatgtggttattaatggaggctctggtaaagtgtaaagtgttgctgggaacagacattgcaggtagtccagtctttagccccagtcatgacaactgtgggctgatcatgcctgcccttgaaccccagtgtagcttattgataccaccattaggtggtccaggcaggccaattctcaggcctccagatggcttcctcagatgccagtagtgacaacagtgggccaggtgggcaggcaggctcttaggcccctggacagctagtgtggcatgggcaatggcagtaatgggatgactctctgggttctaaacagtgaacgtttgtgttggcagtggctttaatggactggagaggttggtccttaggcttctatatggtgcgcgtgagtgatcctgtcttcaggttcatgaggaaagtgtgctgatgccagaggtggtgcaatagctggagtgattcccaggtcttcagaaggtttgctcaggctctggtggggagggactggtaaagataaactgatggtgtttgatctcaggccccaggtagtgtgcaggggcttaggctctagtaggtagaacaggggattctgtggtggtgggtttgaagaatctggcctcagggctcaggctacaacatagcagtcctgctatttgtgttggtggggttgtcttcagcagtcccatgcaggcatctctcaggttctagggagtgcacactttgtctccagcaggagccatggccacagcggtgtgcacagggaacctgtactcagagggtgcactagagcaggggttcccaactccttggctgtgaaccagtatgggtccacataacaggaggtgagcaacagactagtaagcattaccagctgagctccacctcctgtcagatcagcagtggcattagattctcataggagtgcaaaccctattgtaaactgtgcatgtgagggatgtaggttccacaccccttatgagaatctaactaatgcctgatgatctgaggtggaagagtttcctcctagtctgtggaaaatttttctcccaagaaacaagtacctggttccaaaaatgttgggtaccactgcactggagtacagaggtcatgctgtgtgagcagggttggcactcccagctccaaataaggtgccatctgggagtcctgggtagtacattatttggtccctggctgctgcagtaattgcagcattgtttggagtccaggagggatctcgtcctttgcacacacaggcataagcatggagactgtgctaccagagtgggtaagatcatcacccacagtcccagacaggcagccctccagctcacccaccccagtccctggcagcatcaacagcattatggctacagtggtatgcagaagcaaggaagggaccctgctcactttctacatgtgagccagagtacaaatgctgctctggtatggagggtggggttgctgctcccagccccagacagtcagttttcaggcttgcccacctccactcccagtggcaataactgctgtagcagtatgcagaaagggaaaaggaacccattgttagataaacccaaacagaatctgtgctgctgctgctgggggtggggtcacttttcatagccccagacaaggagctttgggggtctccagatcagtgcccatgctagttttagtattcatgtgcacagaggaggcttcttatggtcaggattgcagccgtcaatagtggaatgcaatggggatccccttcaggctcccagctgatctcagccaagctggccactttcttccatctccttctctgcctcagatgtttcctatgttgagcttcagtgttctcttttagatgttctagttgacgtatgattatctcttcacagttttgttctttttttctggagagaaagagatctgatgtccctagtcagccagcttgaaacaatctcctcttgtctcttcttatagagatgctaatctcatttatgaaggctccactctcatgacctaattacattccaagtgccctacttcctattaccattaccttgggaggtaggatttcaagatataaactttggagtactttcatcttaatgtttgcttactcccaaagtgtatacattgaaatcttaaccataccataccagttaggaggcaaggcctttggaaatgattaggtcatgatgccggagccctcatgagtgttattagtgcatttataaaggatgcctgagagagctcccttgccctttcgctatgtgagtttacaaagagaagatgttcatctttaaagaagaggttcttccccacaaacctaatatgcttgagccttgatctcagacttcctggtttccagaactgtgagaaatatatttctgtcatttataagctacttaatttatggtattttgttatagcaggctgaatggactaagacaaagaaggtcactatataataataaaggggtcaattcagcaacagtatgtagcaattatatatgaaccaagtactggagcacccagacatataaagcaaaaattattagagctaaagagagaggcacacccctacatgataatagttggagacttcaacacccccacttttagcattagacaggttatccagacagaaaagcaaaaaaagaaacattggaattaatctgcgctatagaccaaatggacctaacagatatttatagaacatttcatctaactgctgcagaatacacaatctcttccttagcaaatggatcatcctcaaggatagacaatatggtaaactacaaaacaggtctttaaaaattcaaaaaattatatcaagtatcttctctgacaacagtggaataaagctagaaatcaaaaacaagataaactttggaaactacaacacatggaaattaaacattatgttcccaaaggatcagtgagtccatgaaaaaaattagaagaaaattaaagtttctacaaacaaaaatgaaaacacaacatatcaaaacctacaggatacaacaaacacaatactaagaggaaattttatagcaacaagcaatcacatcaaaaaagcagaaaaatgttaaatacacaacctaacaatgcatcttaaagaattagaaaagcaaaaccaaaccaaacccaaaattagtagaagaaaagaaagatcagagcagaaataggtgaaattgaaatgaaaaaaaaaaaaacacgcaaaatatcaacaaaaagaaaagttgctttttaaaaagataaaattgacaaatcttgaattaaactaaaaaagaaaaaagagagaagactcaaataaataaaattagagatgaaaaaggagacactataactgatctggcagaaattcaaaagataattagagactactatgagcaactatatgtcaataaattgggaatacattgataaatgtctggagatatatgactaaccaagattgaactatcaagaaatccaaaaccttaataggccaatagcaagtaatgagatcaaagccataataaaaactctcccagcaaagaaaagcccaggaactgatggttgcactgctgaattttattaaacatttaaacaagacctaataccagtcctactcaaactattcctaaaaatgaaagagttcagaatacttccaagctcattatacaaagtcagtaagtatagtactgataaccacaaccagaaaaagatacgtcaaatagaaaactatagggttatctccctgatgaatattgatgaaaaaatttgcaaaaaaaaacactagcaaacaaaattctacaacacattaaaaagataatttatcatgaccaagtggaatttatcccagagatgcaaggatggttcaacatatgcaaattaatcagcatgatacctcatatcaacagaataaaggacaaaaaacatatgatcatttcaattgatgctgaaatactgaaaaaatacttgataaaatttgacattattttataatttaaaaaagctgcacagagtatagaaagaatgtacctcaatacaataaaaaacacatatgagagactcacaggtagcatcatactgaagagtaaaaaaatgaaaatgaaagcctttcctctaagatcttgaacaggacaaggatgcctatgttcactattgctatttccataatactagaagtcctaattagtgtaatcagacaagagaaaggaataaggggcatataaattgaaaacaaaagagtgaaattatccctgtttgcaaatgaaataatcttataagtgggaaaaacctaaagacttcatacaataaaaccaatgagaactgataaacacattcagttaagttgtagggtacaaaattaatacaatgaaatctgtagcatttctacatgaaaacagcaaacaatctgaaaaagaactcaagaaagtaatcccatttacaatagctacaaataaaacaagacacccagaaataaacttaaccaaacaaatgaaaactataaaaactacaataaaaactataaaacattgacacaagaaatcaaaggagacacaacccaaaaatgaagagatattccacattcatggattgaaagaatcagtattgttaaaatgtccatactacccaaagcaatataagataatgtaattcctatcaaaatataaatgacattcttcacaaaaatataaaaaaaattctaaaatttatatgaaactactgaagacccagaatagccaaagtcatcctgggaaaaaggaaggaaactggagaaatcacattagctgacttcaaattaataccacaaagctattgtaaacaaaatagcagctattgtaaacaaagtggtagacaaaaaaagacatagaccaatggaaccaaatagaagacacagaaagaaatccataaatctcatttttgaataaggcgccaagagcgtacattggggagagaacagtctcttcaaaaaaaggtgcttagagactgattattcatatacagaagaatgaaactagacccctatctcttgccatatatgagaatccaataaaaattgattaaagacttaaatctaagacctcaagctgtaaaaaaaaaactaaaagaaaacttttggaaaactctccaggacatagatcaaggcaaatatattttgagtaatattccataaccataggcaacaaagcaaaaatagacaaatgggaccacattaagttaaaaagctcctgtacagcaaagtaaacataagcaaaatgaagagacaacccacaaaatgggagaaaatatttgctaactatccatctaacaagggattaataaccagaatatataaggagctcaaacaattatataggaaaaaaatctaacaatctgattaaacattggctaaagatctgaatagatatttctcaaaagaagacatacaaatggcaaacaagcttatgaaaaagtgctcaacatcactgatcatcaaagcactgcaaatgaaaattacaaaggtatatcatctcagcccaggtaaaatggctttcatccaaaagacaggcaataacaaatgcagatgaggatgtgaaggaaagggacctcacatacattgttggtgggaatgtaaattagtacagccattacagagaacagtatggaagttcctcagaaaagtgaaaatagatttaccctatgatccagatatcctactgctaggcacataccccaaagaaagaaaatcagtaaatcaaagagatatctgtactcccatgattattgcagcacaattcacaatagccaagattttgaagcaacctaagtgtctttcagcaaacaaatgaataaagaaaaggtggtatgggtactgaaggtcattgtgttaaggaaataagccaggcacagaaagacaaactttgcatgctctcactcatttgtgggagctaaaaattaaaacaattgaactcatggagacagagagtagaatgatggaataagagtttgtggtggagaagtggcaatggttaatgcatacaaaaatatagctagaataaataaaatctagtatttgatagcacaacagagtggccaataacaatttattgtacacttaaaaataactaaaagagtataattggaatgtttataacacaaagaaaggagaaatgcttgaggtgatagacacctcatttaccctgatgtgattattttgcattatatgcctttatcagaatctctcatgtaactcataaatatatacatctactacatacccatataaattaaacaaaaaaattattaaactgtttttatgcctcaaaattattagaatcctatgagattttcatatatatagtcaaattaagtgaataacaaattggtctgagcaagtttagaagtagttacagatgaaaagtccttttcctattgaaatacagcattgagtttaatcagctgataatttgtttataattacatcaagactattaattaaaattaggtaatttcaatatccatgtgtaactataataataaagacacaataatatatgttgatgactatttagttatatgtatttgaataaatattcttatatcatctatcaaggagtatgaatgttgttctagccttgtctcttaatattcaactattcttaaattatatacatatgcaatctttaaaaaattgtaatttggggatatatttaatatgtattatttttatattttctaaaaagctggaagatatttaactcaagctaaaaattaccaaagatcataaatgttctgatttaatttacctggcaaaagaaatattaatgctaaaactttccagggaataattatttcactgcagtacttcattgtaatcactctcatagtttgaagtgccatttaattatttttagatgaaaactatattaaagtgtattttctattggtacaacatataagagaaatatatatgtatatataagattgtctgaattttgtgtttcttacatagttctatgatcagtaaaaagtgataaacaaatcaaaaatgtaaagtaaattatccatagtcaaaaattatcactataaaataacataggttccctcttctgttttacttttatgtttgcaagtcctggtataagcgttagcctatgccccagtctatagatatatcttccactgagcacacatctaccagagctaaatctgttgtataatgtgagcagtcagactttaaaggttgaagccaaaggaaagagcaatgagaccagtcacagaaccagcagactttttaaagaccaattgaaaggccctagactccatggaattctgtgaacatgaagactttcccaaaatgacacacagtcaatttcctgtcatttctaataaaagaaaaactatatcacacatactttaatatagataaacaaataaatattataaataagtaaaagtttgatatttagatggttgtattattattcatcagtattaattttctgattttggtggctgtttgtggttgtgtataagaaagtacttgtctatagaaaatactctctgaattatcttaggataaagagacgttgtgttagcaacttctcgaatggttcaagaataaaaatgttctttgcagtatttttgctagttttatatcaattataaaatcaaagttttacaaaccaaaagaaagctactctctcaagtatttaagatattgcttggtgccccatataatatacatgagtaaattacttgagtgctaatctcatgaaaatatacttgttaaaagaatgtgatttttatatggtgtggagagactttagatgaatgccttcatttattttctctgaaaatggaagaatatttagtcaataatttgctcacatatgaaattatatgttactttgacattcagaatccaaatgtgaagacagtgaatcaggaattctaaaaggaattcttgactatgccttcaaagatgtgtcttcaaggataacttggtagaaagaatatgaatacatactaataaggaaacataactatgaaatgtgaaatgtttggctgataagccagataagttctgcttagacataccaggttgacaggtgctatttttggtataatgaaatggaagaaagagatggagagacattgtttgtagagtttggagaacatcaataagaatttgtttcagtaaaacaatggattttttatcctgctgggtggaggcttccctggattattgttggcatagctaagaccagagaacagttacagactgttatggtaaacaggtattgtggagatgaaagcaggtggtaatggttctcaaagggaaaagacagtgtgaattttcaattcttcaatggcagaaccagaaaatattggatcacaacaggatatcttaagccccagaagtcagaacacagagtctgccagtccagaaacactttatagttgcaggaaaaaaataacaaattcatagtgtaattctacatggtagcctaacattaaaatctaataaaatacatgagtgaattagattaaatttagagaataaaagatttatagatattactaatattcactattaaattaccttacatgtgcatcataatttataatcaagttaattatctacacatgttataaaaactggaactaataacacaatgtacacgattaaatgctttatgtttatattataaaccaaatattaattgtctggctttcttaattctaatacacataaactactcttgtgttatcttgaattatctatgtctatcatatgaaattgaccaaaatgtaaaggtccttacatataggctattccaggtcacctaaatattacattttattattatacaagtattaagtgattggtcatcaattaataacactactatggaagcatgttttttttttttgagacagagtcttactctgttgcccaggctggagtgcagtggcgtgatcttggctcactgcaacctccgcctcccaagtttaagtgattctcctgcctcagcctccccagtagctgggactacagttgtgcgccaccatgccaggttaatttttttgtattttttttagtaaagatgtggtcttaccctgttggccaggctggtcttgaattcctgaccctaagtgatatgcctgccttggactcctatagtgctaggattacaggcatgagccacccctcccagactaggaagcatgaatttaaaaataattttgtatagctggtgagatactcatggaacagattgccacaaaagagcaatgtacaggtagaatttatatgtgtgtatatgtgcacatatatttgcatattcattattttataagcataaggttaatgagcctatttttaatacattacatataatataaacacacaatttaaagaataccttcataaataaaaatatattgaccaaaagaactgaaatgatttatatttctagttttccaaagagaatcactttccatttagaagttaactcactgaaattcatatcagtttgaattttaaatatttagcaccctaaaacatatatatttgaatttgtatgcagggcccaaagcatttctttaactactgtttgggagaaatatatattctagataaactgataattcttgttttaaaaaaagatgttatgtttctctaattagttatttagcctggtgaaatatgaagaaagaggttaagagctttgaatacgattatgtgactaaaatttctatttccttcaagtatttttaaattgtccagtagtttaatgtttcataaaaccaaataatcacataattcgtaagacaggctcattacataattaaagcatgttatttcacaatacaatcatcgaatcacaacttggacctagtttataaaatagtttgtgaaagggtaaaagaagcagtcacaagagacttcaactcaacccttgttatcatcttgcaatagttaataagaagttgaataatactaagtactcttacagataaaatcgagcaaaaataaaaatatcattttctctacttgatatctgtctaatgtaatgttaccacatttttttcaagtgtctagcaaaaattcaaattaagaacagcaaaatagtcctacaatctgatgtctgaaactaactgtgtggctctagaatcttattttgtatttccccatgattgagatttttcactaaaataaacaaattccgcttcttacataataacctgaagaatttgtatcattacaaattgaaagcaactgggattctgttttccacattgagtctctgtaaaattcaaatacaagaatatctgaggaaaatatttagagaacacacatcttatttcagaacttgtaaaatggggctgtaggttaagccctggtaaatgcttccatggaaatcccattagaacatcaaagaagaaagccccatgcctttcctagaggccagtttcctggaaggatatttattcgggaagttaatgttcctcttacttccggttttctaaaagtaataagcatttttttcacaatacaccccttacaaaaattgttctaacttttagttaccagtgtgtggggggaggtataaaacctatatttaataatggaggttattaacttgttagaggctaaaataataaagttgcatttaatgagtagttaaaagattaaaaatattaaatatttttgagaaaaataatgtctgcaagaaagttatgaaagtaatggtaaattctgcaatatgctgaataataatttagtttatttgaaaaatattttactaggaaaaattaatgttatagaaaagatgaactattcatcagttatcaaagaaaagcattaaacttttaaatttttattagttactggggtcttcagtattaaacttaaaaaataccaaaacaagaattatacaatattcatttcagcacagagtagagccttagggaaaaatcctgcaataatagttatatattttcgttgtcatttaacaaaaatgaatagtcttatactcaggcttgctcaagatctaactgagaagagggctaggatcacactcttttagatctcaccctggagctaaatctgtatttaacagcagggtaaaattgttgtggctgtagggagcagcttaaaagtgcacattaaagtcatatagacctccttccataagcggtaggagactagaacgactcaccttcaagaagagatcctcctgttccatgcacttgagggaaaaataatctaccttattctatcaccacattcagctctttgacatgacacacttcagcacatatatcaacaaacacgcaatgtgagaatcagaataaagcatacagagattttgaagaactgtgaaggtcaggattttccacgttatttctatatactgcaggcaaaaaagttctgcactgatttggaagacactgcattttatatccttttcttagaaattcagacattagaatattaaaagttgctaaggcattctaaagacatcattttaactaattaaaatgtactatttcttttttttggactaaagtacttctttatagtagaatatctattagcatcctgcagaactgtgctccatgaaacaatgtctgagatcatcatagatactgtttactttatgacgttatttattttttctactattgtttcataattttcaaatgcaaaagacagttttaaaaataaaatactacaatatttcttgaaataaatccttgcagatcaaatttgtagtaaaattattgaaacataatgaccctcaattatacttcaggtgaatgaaacagttaatgatcctagttgtatgtagataatttaaatagaaatatatttaagtatttaagtagactgtaatatatttaattgtattgaatactgaaaattatcttttgtcaagtaaagtctaaagaaactatctgggatttcattaaagcgaactatggcaagttttgcattctatagagtttgctaataacattttacaccagtttctatagttttcccataccaggagtcttacaatgcacttttaaaaaatgctaatgctatagtagaggtctaaagtgaattaatccttgtgggtaacaatttaagtagattaagcactcagtgatgcataactttcaagagttaaattaccaagggtacaattactaaaacaaaacaacttcatctctaatgacacatataagtgttgaaatgtttattttcctacttctgtgaaaggtaactatcatttaaatatgaggaatagttatgctgtttattatatttgttatgcaggcatatctactcattcaggatttttgtcaattatttttactacacatttcctagggataccagccaacacaaaatgtaattcttaaaattcttgttttactctcatttattacctaacttggtaaggactcctgtaattttgatacaaatccttaccaaaaaacaaacaaacaaaaaacatttattagctgagaaatgtatagtgtactatttatcttaccactaggggtcggtgtgagtgcatgccagaaactgtgggtaaaaccaagattttggtttgctatgttataatttgatattaaaatatgaaaataactttatggcattctccctcattccatttttcacagaaatctattctaatatggctcataagagtataaagaaaatgttccattgtaaattatctctggaaaagctcaggtactaaaatttttatgtattgccagtgtagaataattgtcttaattttccttgtgctaatattaacttcaaaagaaataatggagatggaaaatatcaaaatcagataaccttccctctatataaactcaccctttacaaataatagcagcacttgaaacaaccaaaagcaacacagcttccaaccagagatggtaaagctatgtctcctcaggttctatatgaactctgtagattacctattttttctttttaagagcagcttgtgagacttcacttatctttcatgaaaacttgaagaaaacatgctattctttaaagaattcccataatgccaaaggtatttagaaaaaaattatgaattctaaaccaagggtgcatgaaatatatgtcatatttagaaaggcactttaattaatattgttaatattaatatttagaaggtagttaaaaagagtcctatcacatttgaataaactgcctttttcaccataaaacaaaatggctcaatatggtcttaattgacttgagaagaaaacaaattaatgacaaacagactagaatgcaccaataaaaacttacaccaagaactgttttagaaaacatgcttattgctctgtttgtttctattctctttgtctcatattgtatttcaattttgaaagtaagtttatgtaatataaataagttgatcaattaacaaaatacataatctagactcacatattaaaacaacaaaagacacacacacatcacaagtaagaaactgttaaaaacattctcatatctaatgcagatgttactcatttttaatacatatatctgaacatggattaatataaaactaaaactaaaacaaaaacaaagcattctttgaatgtgagatgctattaataaattaaatcttacagatatatagcacaatgaagatgaactgtggtaccagataaaataccactgaatcaaaatttattttagatttcacagaaaatgtaaaaaatatgaaatactctacagactgaaaatacatatgaggtattatatggtatccattatagtttgggctgtcaatttaaataaaaatatccatcaatatttatttatctgaaatttaacttgaactggggtatcatgtaatttatgtgatgaacctagctactacataatgtgtcacaaattgtaattatgaatagtttgttttttcagttttacctatgtcaaataatggtggtttttttcaagatgccggaaaaagtctttaaaaattaggtagcattctggatattagccctttgtcagatgggtagattttctgtagtttgcctgttcactctgatggtaatttcttttaatgtgcagaagctctttagttgaattagatcccatttgtcaatttcggcttttgttgccattgcttttggtgttttagtcatgaagtccttgcccatgcctatgtcctgaatggttttgctaggttttcttctagtgtttttatggttttaggtctaacatttaagtctttaatccatcttgaattaatttttgtataaggtgtaaagaagggatccagtttcaacaaatttacaagaaaaaatcaaacaaccccatcaaaaagtgggcaaaggatatgaatagacagttctcaaaagaagacatttaagcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggagtgtaaactagttcagccattgtggaagacagtgtggagattcctcaaggatctagaactagaaataccatttgacccagggaacccattgctgggtatatacccaaaagattataaatcatgctactataaagacacatgcacatgtatgtttattgtggcactattcacaatagcaaagacttggaaccaaccaaaatgtccaacaatgatagactggattaagaacatgtggcacatatacaccatggaatactatgcagccataaaaaggatgagttcatgtcccttgtagggacatggatgaagctggaaaccatcattctgagcaaactatcgcaaggacagaaaaccaaacaccgcatgttctcactcataggtgggaattgaacactgagaacacttggacacagggtggggaacatcacacacaggggcctgttgtggggtagggggatgggggagggatagcatttaggaggaatacctaatgtaaatgatgagttaatgggtgcagcacaccaacatggcacatgtacatatatgtaacaaacctgcatgttatgcacatgtaccctagaacttaaagtataataaaaaataaattaaaaaaaattaggtagtattggcaacctggaaataagtaagttttttattacaatttacaataatgttttaagatgaaggcttatacatatgttgccaaactgtatcatacgtcaatgtttttagcattcatagttttatttcatatttcaaacctaatgaaggaatagagattaattttcccttctccttctcagtctctacaaccagcactgtgatcagtgcttacaaataatttcattcagtccttaaagcaacccagtaattgggaattatttcttatatttacagatgagaaaaccaaatatctgataagttaatatacccaaaatgacatgatgaaaacacaccaaaaaacaaactctatatccaaattcttttttttttttttttttatctcactgtgtcacccaggcaagagtgtagtggagtagtcactgctcactgcagcctcaaccaccctggctcaagggatccttcaacctcagtcttccaagtagcgggaccacaagtgtatgccaccacgcctggctaattttgttgttgttgttacttttataattattttttgtagagacgtggtctccttatattgctcaggctgctctcaaactcctgagcttaagtgatcctcccacctcagccttccaaagtgttgggattacaggtgtgagctaccacatctggccactgtggccaaattattcaaatcttccactatattatgatgtcaccttaataatttatttaaacatacttatcttaaatatattaaaaaataaaattaaagtgttaaatatattaattttgaggaaaagtttcaatatccaaatcattttctctcaatttagtggtattttatatttaattttgaaataagttatacaaatttgtatttgggttgttacttggattttctctcattttctctcatattctcaaatacaactaaaatcttccacgctcttgtccttcttttctttctacctcaaaataaacccagctgttgcaagtttagatattgtagaggttttggaagaattgttaactattttacaatttcccagtttttaagattatttaattattatgaatttgcaaaagattaaaatagctttctaggccaagtgctgaaaacatgacctgaagcttcccaataacatttttgacatttggttttactttaacagtgataacaggtaaaaaattgtgctttatttatcatatgtcattgaaattaatatcacaggaagtcatataatatcaaatcttcaaattgtaaataccttgaaggattcatggtacctatatttttatactcgcaaaagtagttatagatttttaagtgattaattgaaaaatcaggagctgtgggtcctattctgattttctttagctagataataggatcatgtacaaatccattgaaataactgaatcataatgaccctatctgaaaatcaatgtgtgttgggccttgatatatttagcaatctccccagttctaaagccatgtgattatttgattggaaacaaaaacaaaaacaaatacaatccttgggtctgattttacaagtcaactatgttcaatgcacatcaaaacatgaaaaaaaattctataatttccattttgcctgaataattctgatgacaggaaaccaccatcccatggggaaaatcagctgttttccaacatctgtgatagttaaaatgtattttcttagacattaactcaattggtctctccaaattccattcatgggtttaggtctgacatctggctttatgcttgttacactcaatcagtataattttcaaccatgatttttcagactgtacaacatgatgttttgatacacatatatatagtgaaatgattaccacgatcaagctaattaacatatttgtcacctaatatagttagcttttgtgtgcgtgttgtaacaatacttaagatctacttttagcaaatttcaagtgtacaatacattgttattaactgctgtcatcctgctgcatattaggtctccagaaattgtttctcttataactgcaagcatatgtcctttgatcaacatctcccgatttcccctaccacccttccctggtaactctcattctattctctatttcaatgagtttgacttttttagatttcacatataaatgagataatgcagtatttgtctttctgtgtctgacttatttcatgtagcataacgtcctccaattaatacaactttttatataagtaaaaatttattcatttggatccttgatttttctaaaacttttaaaaaacaatatagattgtagaactagcaaacttccagtatcagttaaatttacacatgaaaataaaacaaatatttcaactgacagctcacatatcccaactgaatattggaaggtataattgctaatacctgtcacaagaaaatgcacacatctcattacagtttccctaatacctaagctattgggtgatctgatacaaggaataagaaaactatactgttatgcctctttaccaaataaaaaagttgtcaactagtgttttgtaaggatttattatgtgtccagtactctactaagcaaagcacttactaaccaagtataaatcacatgtattttaattataaactaatagatttaattattcttgttttgtttttgctatatcctgtcacggtgcaaaacattacatgcaacttaattcaaataacaacattataaggtgggtgttttctaatcatgcctgatgataaattaaagcttaagaagtaaagtaacctgcctgaaggtacatagctgggatttgggggagctaggaagtgaaagtgggtctttagccttctgacatattcaataacattgaaccattaaactgtaaactcaagctcacgctaagaacaagagatgtcccaacttctgagtggtcagtcctctccagtgggggttttgtattgacaaaatatacaattctataaattaaaggatagaaaactaacagaagacacattcctacagtgcacttacagacagttgtatttctgtattgtaaaacccagagcacacttaagattcacaactaagcacaattaaggttttctggaagaggtaagaagtcaccagatagatagatagatagagagacagatagatagatagatggatagatagataaaacagaatcctgaagagtcacacctgtaatttttcctcagaaaattatcctaagtagaaaatagcagttgttgaactcattgtagttgagagggaaacactctgtactttaaagactgactttcatcattttttatttacagaaaaattgagttcttggtaacaagtgtatttacagcatcctaaatatgatttcagcactcaacactacccttagaagcagacaagataatgaaagaagaaaatgaagtttccaaaaaagaaaagaggcattgcctagtcatgcatgacaaataattttacaaaaaggaagaactggaggtgaaaaaacattgcatgatttttatacattgattatactgatatcatttctgcatattatttaacaaagtcatatatagaatttacagtgcactacataactaatttaaatctcacaaaaaccttctaaggaatactgtattatcaatctcatttccagacgaggaaattaagacacagaaagttgaagtaacttaactctgaagtagtggagggccatatgttattaaatggaagaaccagaatcaacctcaagaagtctggttttggtataggagttaaaaagaaattatttaggtaaatagtgaaggtaaggaagtccttggtaaggttttccttttaatgaaaagcagcccccaaataattttctcttctaaaaaagagtagcctgtgaaatccagctgcacacatagacaagcaagctggaagctttcgtgggtgaatgtcagcagttgtgccaataggaaaaggctacctcagactagacatgttcaaaatggtggctccatcttccctctatttgccaagccacgctttcagtaaggagaagacaatatggagccagccagacaatgaccccatttgcataagattagggtggggtgaccagccttccccgcatgctatgtaaacgtcacacctggtggaaccaatttgcgggctctatgtaaatcagacaccgcctcctcaagtctggctacaaaatctggtataatttgcggtgggctggtttttcactttcggaagcgtctctctctctttctctctctctctttgaaacagagaatacagataacacttttgagttccatgtgttctttcattaaaacttcaatgagagagagagagagagagagagagagagagagagagagctcttatcctttctctttcttttgcctattaaacctctgctcctaaactcactctcttgtgtgttgcgtgtccttaatctatttggcgcaagatgatgaacctcaggtgtttaccccagacagtgatgctgattcagttttagtgtctgtattctttttaaaaatttttactctatttcatttttttgaagagatgttgctcacgctgatcttaaagttctggcctctaggggttctcctttatgttggttttccctatgtagaaaatgtgctacacatagccactctttattgttaattcagtctacttacagcttcttcaaatttcatattcattattgtccaaacacacataagtagaaaaatatatataatgtaaagatatagaaatttgagaagatgcaaagtcaatgctgattggagaaactggacttgactatcataagctgctactactaaaatacaattactaaaagaaaaaaatctgaactaaatgagaaatgtcacaggaaaacaataaagaattataattatataatatgtctcatccttggtgaattattgcagtgtagtaatcatctgataaaatatgttccaatcacaataagcatcaacttttgaaggatatattggaattatcttcattccacattacagcaggtaaaaattagaacattttctattcatattccttggtaagattaattctggataacagaaccatgtcagtaatatccataagagttgtttgattattgtgaaattttctgttcatgaaaaaagttgcttttcagccaataaagtgaagtaacaagcaagagaagaagaagaaaagcaaacttgactgccaaaaaaaagacagatgactattatttttaactttcttattatcagctttcttcattactcatagcagtggatatacacaaatccatttaggggtaaattctaagtgacatataaaacaaacagaagagataatgaatcattttcttcaaatattctatatttcaaaaaaaagtataatcctcaatttacaaactcctaagcagtgttacctatcataatgtcttacaagaggtaaagaacacattcaatacaatttcctaaaaattaacttactatgtgcctagtgaatacttaccaagagcatttatacagaaaatacaatgataaataatcactgtgtctcatgaactgctactatcttagcaagaattatgtgattttattcttgtattttcagatcagaaagttttatgcaaaagtatttaggccacttcctaatcatgtgttttagagtccctaaactacatttctttagctttcaaaaaatttaatataattaaattgaaagctttctttagatgttcaatacatattttaggaacatttaaacattaagcaataagtttattcaaataaattattcctaccgatattttttatttagttagcaccgtactcttgaatccacagtgtcttctctgctgtgtgctgctataaagaaatacttgaacctgggcaatttgtaaagtaaaaaagtgtattagtttatggttgtgcagactgtacaaaacacatggcaccagcatctgcatatgctgagcttcaggctgcttccactcatgttggaaggggaaggggagctactgtgtgcagagatcacatgacaagagaggaagcaagagagggagaggtgttaggctctttttaacagccagctctcatgcgaactaataaagtgagaaatcatgcatccccactactgccttacagagaaggcataaatctattcatgaggggtcaacctccatgacccaaacacctgttgttaagccccacctccaacagtgaggatcaaattttgacatgagttttggaggggaaaatatctaaaccttagcattaaagttctcccttctgtaaaggtagtaggaaatcaagatctggaataagggaagtaggacaaagaaagagtaattcactgcaattcctaaaatagaaattatcttcctcatctatggtgtattgtgtatacttttcctaagaattaaagtctcttcagtccaattgtttactttttttgctaatcatcacttatatgttattcagttccttaatttttatggctcatataatgggattaaaatatttttatgggcttggcatggtgactaatgcctataatcccagcactttgggaggcagaggcgagcggatcacctgaggtcaggagtttgagatcagcctggccaacatctcaaaaccctgtctctactaaaaatagaaaaaatagctgtgcagggtggcacgtacctgtaatcccagctactacaccggaggctgaagtggcagaatcgcttgaactcaggaggtggagtttacagtgatcagtgagctgagattgtgccactgcactccagcctgggtgacagagcaagattccatctcaaaataaaaaaaaaaaacttttttttttttatggccactcctcttatctaataaatattgttcctccacagccatgcaaaatagacaacagcctccagcaaattctcagtctgggctacaaaatctaatgtacattctggatgtgggaataagtgtattttcgactacttaaatttgttgtagtaggaaattttcgtcacctaggtaggcttaacctttactggcatataaattttttaaatactggaaattaaattttagatctagtttgtaaagtatgattatcagagtttagatcatttaaaaatacaatgtgatacaatagtatagatgaattatatatagaaacatatataataaatatattttgcatatatatatttcccttaattttcagtttcttccactgactaccagaaagaacaattttaaaaactaagtgcattttcatcatctttgaagtagatctatatttttcttacaactatttatataattatattgttagatatcaatatgaaaaaataattacatttttaggatataatgttttataaaatgttatatatctattttcatgtattaaatccactgcgatgaaaagtttgttagttgcttttctattcttttaattttattttcaacttccttatatttttgagtatgttttaggactatgatgctcatctttattgtacattgctttttaaaaactatacatcatttaaaagcatacttaaactcatatatttttctgttttttatgttaatagcttgtataattaacctttgttttcagtatgttttttccctttactctgaatttgaggttttctcttttcaagttcttggatatgaactttatattttctctgtttctactctgagtatcttagctgttgactttacattttagttttattgacttctttcagagagcccattagagaggtctcctgttatccacaagggatatattctaagactctcagtagatgcctgaaattatggatagtactgagccctatatatactctgtttttttaatacatacttatgataaaatttaatttataaattaggcagagtgatggaataacagcaataactaatactaaaatagaacaattataaaaagactataacaaatgttatataaatgacccctctctctttctcaaaatatcttgtatactgtactgtactctcctatttggcgactgtaattgactgcagataagtgaaagcaaggataagggagaaattacagttgacacttgagcaatgcaggggttaaggcactgatccctgcagagttgaaaatctatgtataacttttggctcccccaaaatataactattaatagcttattactgaccagaggccttatgtgtaacataaacatttgaataacacatatttttgtgttatatatgttatataatgtagtcttattttaaaaactagagaaaaaaatgttaagaaaataagaaagaagaaatgtatttactattaattaagtgaaactagatcattataaaggtcttcatctatcttatcttcatgttgagtctgctgaggaggaggaagaggaggtgttgttcttgctgtctcaggtgtggcagaggcagaagaggtggaggatgtggaagaggggcaggcgaggcagccacactcagtgtaacttcatagaaatatatggtaatttctctctgatttttctttttttttttttttgcttttccatttctctaaaaatgtttctgtatcatatgaatcctccttctaccatttgtttcagcgccagtgatatcatggtaacatccatgtcataaaaggagtcaaaagcagtgttgaataattggaacacttctgccattgtctaatatcaatttattttctagcattatttcttctatgttttcttcctcctcatctggtgctggttcagaagcactcatctgcatcaagtggtcttctgttagttcctctgttggggtatctgttagctcttgaatttctccaagatccatattttgaaaccctttgcctcaatgcctcacccatgatgttttttgttatatccacaatctctttcatgattttcttgattggttttgttgtaaatcctgtgaagtcatgtataacatctggacagttttctccagcagaaatttgtattgggcctcatggcttttgcagctatttctatagcaatgatggcatcttcaatggtgtaatccttcctgattttcatgatattctctttaatgggatagtcttccatagtgctgtcagttctttccatatagtgccatgtgtaatgaaatttacaggtccttatgactccctaatctagaggctgaattagagatattgtgtttagggacaagtagaccacttgaatgtcttttgggttttaactcatggggttctgggtggccaggggtattgtccaatatcaaaagaactttaaaagacagttgcttactgacaaggtactttcctgacttcaaggacaaagaatcaatgggaccaatcaggttcctgttatttaggttttcttgttttacaagcaaaagactagcagctagtattgatctttagtcttaaaaacttgaggttagcaggtttatagataagggcagtcttgatttaaatacccacacatatacatacatacacacacacacacaaaataaacaaaacaatttcgtttgcataaaacagtagaattagcctataactttctgcccgaaattctgatgttcacttttcttctctagtaataaatatcctttgtagcattttttttttcagaatagggcactttcttatgcattaaaaacccattcatacaaatatctttttttctcagtgattttcttaatgatgtctgggaacttgtctgctgcgtcttgatcggcagaagctgctcctcctgttatcttgacatttctttaagccaaacacctttctaaaattatgaaagcacactttgccagcattactttctcaagctttagatttttcaccttccttttgctttaagttgtcacataatgagtttgcttttttaaaaatcaaatttgagtccatgggtatgcttttcttacagcaatcctgcatccacataaaagatgcattttcattacaagaaaaaagaaggttatttcacaaaaagtacaaggttctgtgtcttttggtgtagctgcagtgatgacttctttactttttaaaaatggtcctaaaatgctggattcatttatcttgaaattgtgggcaattgaagtaggtactactgtacctcaatttacagtactatcaagctattcaattttttcttataatttcatgacttcttttttgtttcaaggaaaaaatccggcatcactagtagcactttgtatgggtcccatggtgttatttaaggtttatgatactgcactaaacatgatgaacaatatgcaagaacttcaggagatcacattttactgtgatatccagtttactggagagatgaactgctcatgcagagatgattagcctcatggggtgttttaagcagatacgcacagcacttgagctcatcccaatagcaacaggaggtggccacaaaattattacagtactatagtatgtactgcagttaattttgtgcagttatgacttaatgctgcatttttatgtttgtttacatttctctctgctgagaatggtgtcaggtatggtctgtaagtgtttgcataagttttgataaattgtaactttttataatagatttgtgcttaatttgtagtagcacatgataaaatagtatctacgtacattttatgcattcatgacatgccaatttttttcttattttttaaaatatttctcatatatgtgattcatctttttacaaattgttgtaaatctccaaaaagttttctaaatacatttattggaaaaaaatcacatattattgggcctgcatatttcaaatccatgttattcaaagatcaactatactgtatttctagggttttaaaaatcacaaaccatgcatttatttactatggcaaatactaatacaacttaagatgctttgtatcatgagtaaatgcccacatttgcttttgtcacaggaacttttttaagcccgatattttacgtttatttaatattacaggaggaggatcctattcatcctgtggttttccatatgcagggtagatgaattctcctctattcatctggctgttttggaaaacttaagtcataagcagcaggtatgtttattgtttaaagctcataacaaaatgtccattgctttatttactaaggctctcctaaacagaagagtgctcttctgttgtgtgtttacctgcatgtgtaacaatacatttaatattggataatgtatggtagttagacattttcttcttgaaaaaaaatcaatccataaaaaagtgattttttcttaaatggatattctgagatgcacataaaaagaggaaatcctatgagccttcaatgactacatggaatgagtaatccaaatcattttatcctgactagctctcttttaggtgcaggattccattttcaatgacaatactcctggaagctaggatattattcatctgtattataagtttttttttttttggttgttacaacttttctgttttaatcagtgtgttgactatttcaatagaaacaaggcacaataaagtttgtaaatccagtgacatgctacagctggtttacaagataggattgaaatattttcaggaatttatcaggctggttaaactctttgtaacttgaaattagccatggttggagtatacacatggatattggaaaatactataaatcagaactattcctggttaatatgactacatatgaagaccaaagcacagtaagggtttctgttgttagacaaaatcaaacaaaagggaaatgtttttgacataaactatagaataagaagatatgaaacaaacataaatatacattgcatataataacaattattattactatttttgagaaggagtctcgctcttgtcgcccaggctggagtgcagtggcgcacgatctcagctcactgcaacttcagcctcctgggttcaagctattctcctgcctcagcctcctgagtagctgggattacaggcactcgccaccacatccagctaatttttatacttctaatagagacggggtttcaccatgttggccaggctggtctcgaactcctgacctcaggtgatccacccacctcggcctcccaaagtgctgggatattacaggcatgagcaaatcttctcaactataataaaatggtccaaaatggaaatactaattctcccaacaaaaaaaggggaacatcctagattcttatcctattattaaatctatttccaatccaggatttatttgtgaattccctaggtcagctatggatatagctcaccatggttaactcctcaacttaactcctcccaagaaatcccataatacaatgatggagaggaaacagaaaattctagtacctttggtgaagggcagaagaataaagcaaatggagtaatctttagtccataatttatgaaagactaatttcttttcaacatagaaagcaagatctttgcctttgcaatggattttaagtcagtttgattgatttaggtttgctctcttgttagatatatttaaagtccacctcttgaaatatatgagtgcatccagaagaattctctttcagaggctgcagcccattagcagtatactttctattggtatacacttaaaggtctggagattaccttagttgttaattaaacccagacctaattaccagtgttgtttcctccaatgacatacatttcaagctgcagtctgctgctggttgattacatggcatcaatggccataagttggatgagatatggaaatgttaacaacaggcttatcaagacacttttattaggtcatacatgaaaatttttacaacatttaagcaataccagatggcctatgaatttttaccacaaatattcatagaaatagataaaatacaattactgtattctctttcctttttttttttttttttttttttttgagatggagcctcgccctgttgcccaggctggagtgcaatggcacgatcttggctcactgcaacctctgcctcctgggttcaagcgattctactgcttcaaactcccaagtagcttgtattgcaggtgcgcaccaccatgcctggctaattttttgtatctttagtagagacggggtttcatcatgttggccaggctggtctcgaactcctgacctcatgatccacccccacccccctcagcctccaaaagtgccgggattacaggcgtgaatcaccacatccggccttacagttactgttttcataatgatgtaaaagaatcaatttgctttctgtttacactcttgctattcaacttatttagtaaactaaatatacttctgttatagactgactatacttccctgccagattcacatattgaggccctaatgtgatggtgcgtttggagatgagacatttggaaggcaattgggtttgaataatgtcatgaggatgaagctcccatgatagaattggtgcccatataaagggatgaaaagcccagtgttcaatccaaacaccaggtgaggacaaagtgagaaaccagccatttctgaacaaggaatcaggccttcatcagacaccaaaattgctgatactctgatcttatgcttctcaacatccagaactgtgagaaatcaatgtttgttggttaggctgcccagtctatggtagtttgttatagctacctggaaggactaagagaacttctgaataaattatccaagatacagaaaggccctaagtatgcatgtgctcattatagcattatttatattcaaataatagtatttaaatagagttacgggttatggatttattacattttctaagcattttcataatgtttgtgtaggaagtagaaaatagactgtaaaatatgcaacaaaaagcagaacacaaatgactaaatatgcaaagttgcagctatgtaaaatatgtgtattgataggaacacagactagaaggacattagctatactgtgaatagtattatggtgtgtgattaggtatgatttttatttgttctaaaatatacttttctgttataatttattttatgatatcaaaatataaactgtaactaatttctaatatgtttcaaattaatataccagtaaacgtaaagcattcctaattggctaggtttccaaataaaaaaaaaaacaataaattttaggtagggagaaatcatggctagtctatagtttcaggcctgaaatagtacttccttcataattgcttgaaaagaacttagtcacgcagtcacacatacaatcaagtactgcctggaaatgttgtgacatgcccaagtataattacattattatgaaagaaaagagaacagattttagaggatagacagcagtcactaccaaaatgatgatccccacgttcaagtacttcatggaaacaacagaatcttgtgccttaagagactaagatgggtagggcaacagtgtatacttatcagtaaccagtaagcaaagactaatgattagtgactgggcacctgttgctttggtgctacctaatactccagaacactcacccaactttatgcccagtgagtgagaatgaattttccatgagctcagaatcataagcttcattcagatttatgctaattaaaatattcactgaatatttgtatttaggaactaagattcataaccacttcgtggagtttatcgaagaatgtgtagtttgccaaagtagtttaaacttcgcaaatttcttaaatttttaagcatttgcttcttaatcccttgcatttctaatttctcaatagggtacaactttatccaataaaacttattaccctaaattaattctaaaatctaattctaaattaacatgaagcatcataagtatgattagaaagattccacattagtttgcaactccattgcttaaatgtctagagaagttttcagccatgagattacagagaaaagggaaatcagtattaaatgttttgctgaaacaaatgaaaaattgctcattttacctccattctactataaaaataattccactctatccaaaacagtgaggggttataaggtcggtgaaaaatctcaaaattattttcattgtctaataaatccaagcctgccttttccttctgcttcctatgttaattttattgtacaagtatgttgaagttactcctatttttgattcattcagtaataaagaaatttaggggaaataattgtttccaaatatacatatatggaataaagaaggcagaaagcaacagattgagctttattctcgaaatttattatgactttttccaaattaacaaaattacataatgtaaagaatgtggaaatttccccaaaatcaaataagcagaagaaaaataagcacttgcaagtcaacttattaagagataaacagtataaacatttaacataattctttcacatattgaaatctatgcataaaggtatatatatattatttgttgtattaattgtagttactattgatttttaatattatagcataaagtttattaatattctaaataacattttaaatgcctgtgtaatattataagacatttctaaaaattacttaatttcttaaagagccaataagatgtagggaataagggctgtatatgttttgtgtccttgctctgccctcttccatgttatatcaggtaagttcattatactttctaaggatacagaaatcacaacaggggtttgtgaagttttaataagatattcaatgtatattggaacagtgtctggtacatcaggagtatttaataaataatagatgttttcattaagaacctatagttacagaatagctgattagccttagtgagaatgtagtcgtttaaaaagccgcattgtattagtgcatgtttaccagaattaagtctcacttaacctgattctaaggtcttcaaactttgcttgcaaccagttctaattccataacaatcagatttacatggattcaaactttcagttgttaggttagtcttctgagagttctagagtaattgtatctactaataaaccctcatttaaatacgattaaaataaaaccaccaaaataacaatgaaaaaaaaaaaccaacaagagggttcctgttccttaaaagcaaagacagcctaactaaaatataattctgacctaaaaagagtttaacaaggatctgatggcattcatttggagaaaatgtactcccttattgccccatgaaccaagaacaaaagaattagaaaagggataaactgtatgaaaaaacaaacaaaatattgttagaaattcagtttctgtaattatgacaatgttgttgcaggcattgacttattttatatttatttacttcttattttttaactagtatatcagtttatatcctctatctcacaaaacagagtttccttttcttatagcaattagactgtaaatataaatgagtttaaaactttgttttgcctaaatttagtaacaaagtcaatgtcaaacatagtctatttctgaaatgactatgaaataaaaacctcttctttataaggagcaacatttgaaattcacatgaagcagtagaataagaaaacagctctgtaggttggtaatatttttcttcattaatatgtgtctgaagacttttcacagaaaagtggtatagattaattaatcatttattaaggcaatctataaatcctcttaaaacaaaaacaattagataatttacatctagtctaatgggaaagtgtacattgaccatacaactttttaaaatgaagatagatttcttttaattagcacaaatgaacaaaataaatttgtcttctgaatttacagcctgagtgaataaggcaagcttattttaagaagaaattcaggctaataattaattggtacttcaattgaaaagttcatttaatttaatcctttactattttatgcttaactcaattgggagtccagagatactatttaaaaaaaaaaaatttaaaaaagttctttttgacgggtgcagtggctcacgcctgtaatcccagcagtttgggaggccaaggcaggcagatcacctgaggtggggagttcaagaccagcctgaccaacattaagaaaccccatctctactaaaaatacaaaattagccaggcgtggtggtgcatgcctgtaatcccagctacttgggaggctgaggcaggagaattgcttgaacctgggaggcagagggtgcagtgagccgagatcatgccattgcactacattgcactacggcctgggcaacaagagtgaaactccatctcaaaaaaaacaataaaaaataaaaaagttctttttcaaattgctgtttcactgttatctgtgtttcacattatgattacgtgctgcattcaataaggtatgcaaataataatacataatagtatattgataatgatagtaaatacacagtaacacatttattttttagtaataaactttttaggaacttttttagatttacagaataatgcaatgagagtactgagatttactgtgttattacacatcctggttttcctactattgatatatttcattggtatatgaaatgaactgaatgtctgtgtccatgcaaaattcacatgttgaaatcctaaggcaaatgtggtgttaggagggtggggcttttgagaggtaaattgatcataagggtggagccctcataaattgcattagtacctttattaaaaagaaaaacaaaaaccagagagttttcttgccctctgtccaccatgtgaagattcgatgagaagataaaggcagtctgcttagtacccataagagggccctcactgagacaggagaattgggaaagcgaagcaggaaaataggaaaaatgaggcaggaagaaagcaaaaggaattaaaagttgaatacagggcagaatgagtaaaaggagagagagaaacaaggtaaaggtgtaggtgagcaagaagcaagataagaggcagaagttaagcagtcaaaacacagagaagtgagtaaggaccccatggctggtgggatccagaccaaaccagtaaggcgcagttcttcaggaacaggcatgtgcattaaagagaaaaagtagccttaacatgatcccatatgacgatcagcatgttaaagctcatgcatatggaatgcatatcaggcacctacttaaaattatgggatagaggcaacaagcaagtgcacagggaccaaattaactaagcaacacacttatcaatcaaaaggtagatagtagctagaaattagccagccttgggaagagaaggaaaacaacacataaaaagacccaaaatataccaaactcatgctgatctcatgtctcatctcacagaggtcagtccactcttcctcttcaagggcgtaatactgtgcttaaaaaacttttgctgccttgctttgttatctgtgtgtgtctcatccatttctttgttcgtgacaccaagaacttggaactgcatggcatcatcctgtaacatcaccagaacccaaccatgctggcacccttatctcaaatttccagtctccaaaactgtgagaaataaatatctgtcatttccaagccactcaatttttggtattttgttacagcagcctgaattgactaaggtggtatggaacacttgttacaattaaggaattattatagataactattgttaaagtccataatttattcatattttcttggtgttttccctaatgtcctttccctgttcctagatcttatgcaagacactatacttagttatcatatctccttgggctcctcttgcttgtgatgtatgttaatttttaagagcttaggtttttacatgcaagttccatgctaaaaaaaaaaaaggaagaattatattctcctttctcatgcaaactaattaaaatacatggaagaaggtagtcatcaaattcccaaactgatattgtaactgagtagcttagcttcaaaatgcattttacaatttttttcttttctctagccttagccttgaaataaactttgaaactctttgttttcctccacttccactggagactccttatactgtgttaacttatctaattatatgcatgcttagaaattccaggggctaatcttgaaattcatcaggtatgaagatctagctgcagaatcctcccccatctagagattaccacaaggcagttaatctaaaaccaggccatttttgagatagcacaagcccacagtcctggtggacaataacccaagatagccatcagagagaggtatgtagatcttgtattatcctgcacctctcccacatactgtcatgccaagttttccctttttaactccctcattcagctcaaactttgaacaagtattttgttttatttatttttatttttatttttttgagatggaatctcactctctgtgtcgcccaggctggagtgcagtggcacgatctcggctcactgcaagctctgcctcccaggttcacaccattctcctgcctcagcctcctgagtagctgggactacaggcacccgccaccacgcccggctaatttctttttgtatttttggtagagacggggtttcaccgtgttagccaggatggtctcgatctcctgacctcatgatcctcctgccttggcctcccaaagtgctgagattacatgagtgaaccaccgtgcctggccaaaaaagtattttaaaggcatgagcctggccatttcccaattgctagcctttgactaataaaactacgttcttttcacagtatcttgctcctcctgttttgactcccagtgatgagcagctagatttgcattcggttacaatatacctatacttccaaaaagtaaggaagaatgattaatatggtaaaagccactagctttctttcacttgccatctctccttccatataatagatcattctgacttttagctaagcacacagctatctaactacggtctggattttccagctcccttgtagctatgtaagacaactatgactaagttaggccaatgtggtatgaaagaaagtaacgtggaagcaactttcagtttagctccttcaaatccacactgtgatgtcttctttgtccatggattaatgaactccctgcactcaataaggataaagacacaaacctaggaaatgaaagagctacaagatggaaagggtctggatttcacaacttcatagaacagattttcccaccatgctctgtactatccatctccaagctattttaaaaggaagaagtaaacttctatgttatttaaacccttgtaattctgggtgtctgtcattgcaatttattatgcaccataactgatagatcccataaaatagatggctagatattcacattttaaatacacaaattaaaaagactacatttaaaaatattaatgagcatattggcaataatgaaatagttaatgttaagttatatcaacagcagtcattttataatgcttggttgaagagctttgaaaaataaattaatttttatgtagaacctcatatctaaatttctgtaggtgataaattctatacttgaaccatttgttttcctcctgttaattataaatgaataaaacacaaatttattatgaaatgaatttcaaaactgccttgcttttttcagtgaatttgaaagtggctgcgtctaaaccattatttgccttaaagtaaaagacatttttaaaaaatcttaatgcaagagaccttagaagaaaaggcctttgacactggtagcatctatgcagctttctgtaacagcagtcttctgttacttcattaaatgtttaattttcacaatatgctagtgaaagcattcagcgttggaacaacaagaataaaaatagaaggatatttttgtgcatactatttggtggactgtattgtgactgtgtcttagagctgaaaccacttgaacattccttgtcattttgatcttggcactgtccctgaggctacttaattggttgtataaccaaggtgtcagctaagaggttcctgctccttggagaactagttaaaatgggctggaaagtccaatttttatagtctgtataaagccttcctgacaacctgcttgtttctggggactttataacattgagcttaatctgctgctacagtttcatcttccatctgccatgtcactataacaggaattttagctccttttctagatttcaaaataaatccaattgcattttgttagttttatcacattgttaaaagggttgtgagaattaaaagaaatcttgtattggactgaatagcctaaacacagtagctccatctttcttttcactttgagaatatatagtaatttagctatcactagctcaaatatccaatttacattcccaaatgcatcaagattctcagaaagaacaatagtcctacaggtatctacaccccttagaaagtagctagagtcagatataataccccgacctttaccctatttaaataaatttgaggacactgtaatcttaagggatttgttggtcaggaccagtgactttaatgcaagaatggacattatgataggataggtaagtggagtagctaaaagattgtttatgagccaatcttagaaccaggtgaataagacgtgcaggtaaataactaatggcttatatattactgtttgatttaacaaaaaatctttcaaccattctgaattcagtaactaaaatctattaagattatttacaataaccaggcatgctattttctttctttgtttatttgactcagctatacataaatgtcattttgaatatcaaaatgtttaaatattagtaatttcatatagttcaatataataggtaagcaaaatttttctcttctcctctctcaatttattcttatgcttttactaacctgtaggtatgccacgaagattcattgcccaagattcagggaaaagttggagatatatgcatcaagtgagggtaaaattcaagatgataaggcacaaaaattggcttaggataaagaaatatggtgcaggcaatatagatgcttgccgtgattctgctacttaggaaatcttatgtaataagtgctctggcaagcttccacaatagaatcatggaaaagggtaatgaagttcaggacatgctaccccaaaatatgacacgtgggcatttgaagaaacagcagaagcaggaaggtcattctctgaccttctccatcccttgtcctctgaagtagactatgaaagaattaactggctttcctctgaagtggaccataaggtcctcattccagaagtactttccacataatgagagaaaagaatgccctaatctctgaagacacatggaacagaaagaatagtctaaactaacaggccttgctaaatgccaccttcccaccagcttattaccattaggtgacacttttgttgtcttctaataatccttcttcacaactatcaaattcttcatcaaacttagcataaaaatacacagttttccctgttttgggggtcttcagttctgaaggttcttgggtcatgtaaaacttacactaaatacatttgttatgcttttctcttgttaatcgatcttttgtcacaggtgtcttagccaagaacctagcgatgggtgaagaaaagaaatcttcactcccctacaagggaaataaaggctgttctttttaaatatgaaatcataattgttcctgtggtgaatctgcagagtaaccagccttctgctgtattcattagaacctggctctaagtcatgcaaatcattaacattatccagagtgtttttaaacaggcaaaaagctatcagcctcttttgtcaacagaaataccaaatattatgcttcataggccaaaggaaaacaagagttcttgcaaacatagacaagatactgtgggcttgaggtattacttcctaggcatcaaagaaagtcctttcattttctagggaatgtaaaaagtccatccaattgctttctgacagtgtccccatttgaaccgtgatgcccagagagaaacaaaacagcctgtcccactatttagactcaatattcagtctggaacaaacctcagaacctgacaccagaaaagacatccagggaaataaaggaggtcatttgtacaggctctgtgaggcaagaaaatctaaaattcagagaaaaacaaactagaacttatgagaaatcaacagaagaagtcaagaaacaccattacaaggtaccataagttgctctacagaggtcaattttggtttttattttttctctcatttgggaggatgaatattcagcttaaattagatctaagcggaaagagaaaatcaccatggaatatatctgtgctgtgggtctcattactgaaaaagatgccctgaaaagtctccttcagttatgcaaacggaggccttgtggagtccatttgcttgagagaaagctataagaagaagtttgatgtctaagtggcttgccctaaaagaatatgatggataggaaaacaagtgaagattataaccttctggaaaagaaggatctgacaccccagctgccatttctgagattagaagttgaggaacactctcatatagacaaatattatcttaaccaagacagggagctcagtaaaaccagactgagaaaggccatagggctgtttcagggatgaaattcaaaatacaaaaaggttaaataaaaaatctgggtcctctaggtagacactgttgaatctgtgccagttctccttatcttactttataatctgtcaggcgaatgtaagttgacaaagctggcttctagctgttgcatcatgagggcgtaccatttttggtgcattgagtacttactctccaggaagactggactatgacattcaacttcccttacaatgactttcaactttgactgtatattaaaattttctgaggggactttgaaaaaatcccagtgcccaaactgtcttagaatttgtgcatgtgggactcagtaatctgtgtttctaaaagcacccaagtgatttcaatgcaagaagaggttgaaaaccaccattttacaatagtcctactcagtatttgaagtgctaactagccaccaaagggtcttgtaaaaatgcagattctgattcaataggttaagggtgaagcccagaattttacattattaattggttcccagatgatacctaagtagcaaagtctgaaagaatctgttgtgaacttcacctcttcagcacctgtgagaggagctggttcagtggacttagactctgatgctatgtttccataccagccttcaggtgacgacacttataattgacttacgaagagatttcaaaacttgactatcaacctactgtggtatagtaagttttcgtttgccaccacatagtgaatcccttactgatgtcttgcggttgcttgaggaccatgctccctctgttcaatgggcagccagttctctcatgggccctgcacctggcacgtctcctggtttaccatcacatcctttgcttcaccagctgcctctgtaggtagaaattgcatgtcctttgatgcatgtttcattgtcccaccaggcttcacttaaaaacaagacagaagtctcaataattttaaaatgacgatggcagatcattataccaaatacaggtcccttctcagtatacgaccatgtgagattgcataggtcacacacccaggaagctgaccctattcttcagtcttcagtggcaatgtttctaacctgaccttcgactttttcctagttttattttaaaactagcttaagaatctttcctcctacattttgctggactgacacacagaaaggcctaattctgataaactatttctactaattatactactaattctgagatctacattttttgcactactgagacgaggaagttagtccttatcattcatacaaaaaaaaaaggtaagcaaacctaattaattgcacctggaaaaggcagggtattgcatattccatattgcatctgctgactcttgctgttttccattttgaacttcttcctcttcctctgaccctagcaagtttctgccctctgacaggaattgagtttacagatcttatttgacaacacatatgtcaaagaacgatgtattgcccaaatggcctgtaactatgttcctctcaggagggaagtaatattgggaaaatacattcatatttcacttgaaaataaatgaaagcttaggttatgaacttaagcaggaagcaagacatcaaagagaaagtttgtaactggtaacaggtgacaaaagataggagagacttagtatatatgtgtgtggctttgttagctaagatgaagaatttggattatttttaaaatatgcaagaaagccactgtgaagactacagtaacataacttgtcttaaatgtttttttttttaattgctctgactgttttcaagaagagtgagtggaaagagactgtcaagaagagaaccagagagaacatttaaggcaaaaatatcaatattcagataaaagatggtggcttaactgaaattgacaacagaggaaacagggacaagagattccactccagttgtggaggtgaattaaacaaaatttaaatgaataaaatatgaactaaggaaaaaaactggatttcttgtgtatatttatgggtggatgatgagctattttctgacatcaggaagagggaagaaagatgagacctggtgtgaaggaagacagaaggaagaatatgatttatttgataagtaaataaacctattgcattaccacatggtaataccatgtaggcagttgcatatttcagtttggaattccaggagatgagaagaccaggaagagtcccaattccttgggactagacgtagtgatctagagggagtatatgaataaaaaaaatagaagccccaggactgagatctggatcattccaattttggagaataaatagaagagatcccggaaatgtaattaagaaagagtgaacattgacatatgaggaaattcaaagatgtggcatcacaactaccaagagaaagatgtgtttttagggaaacagggaaacatgatgagattaaatatataaataaataaaataataatctcatgtcccttgatgcattatctcacctcaagtatctgctccctcattcttgtgcagtgctctttggtctccccagttgtgactgaagtgggctcagatacagcttgggatatacttgccagaaagcagaattagtaaatcttcatggcgtttgcatactgccaactctgtaggtgcatagagtacaaaagctgtggaggcatggctttttccatctactttgcaaatagtgtctcatggagcctcaagtgtgaggcaaagaaccatcacagtggtggggctgccctttccaatgtttaatagagctgtggatgcagtgctgcccttgagaacccaaaactgtagaactacaagactgcaacagcagcctgggagagctgcaggcactcaactccaacccatgagagctgctgtgtaggctgcaccgaactcatggggatgcggtgctttagagccttagggttggaaacccttctccagttgttcagaggcaggagtacatggagtcaaagtttattttcaaaccttaagatttaatgttgtttaccttgttgggttttagacttgggatctcttaccctttgtttttctgaatttctctcctttgaaatgggaatgtctatcccataatattttagaagtgtattacttgtttggtttcacaggctcagagctgggggggggcaatttgccttaggatgacttttgccttgagttccaccgatatctgctttagaagaaactgtagatttagactttgaagttgatgccagaatgagttaagacttttagggctattgggatggaatgaatgtattttgtatataagaaggatattaattttgagggcccatgggaagaccatcatggtttgaatatatgtgtctctctaaaatttataagttggaatttaaaccccaatgtgatagtattaagaggtggggacttcaggaaacaattcattcataagggtggagcactcatgagtgggattattgccttataaaaggactggagaaagccaactagatccttctgcccttttacccttctgtccttttgtctttctgtctttctgttccttctgccatataaggacacaactttcatcccctccagaggacccagcaacaaggcatcaccctggaagcagagagccagccttcagcagacagtaaatcttccagtgctttgatctcaaacttcccaggctcagagctgtgagaaataaatggctgctgtctatgaattgcccagtccaaggtattttgttatagcagcagaaacagactaagagagattctcatgactttcattttctcagtgaagtgtaaggcaaggtcatcactggaggaataggaaaaagaaggagttatgaaaaattaagggaaaggataatctttcccttcttaatttgtcattttagagaatgttaaagcatattacaaggatgtattaagtattagactctgtttagtgtccattttttatttatgtcattaattttaagtgagactggccaatatggtcatgggattttctttccaaatctgttctgctaaaacactcaggtatttggtttaactaggtaaaagactttccagaagtatgttgtgaaagataagtgtaaggaagtttagacattttcaaagcagaagttagttataactacgggctagaaactttaagttgtgtaaggataggagagaagtgtgggcaagatggggatttttgacagtaataaaataattgagtaaatgagtttgagttatctgtgtggtcaaagacttgctaagtttaaatatatataaaagcatagaattgagagtttgaagggcacaatataagattaggcatgtaagatagaaatgagaaaaaaatggctatttgagtgataagatcagtttatggatttatcatcgactggaatgctgaaatcacaaaagtcaatgatagaaaacatagttggaaataaaagagagatgttgtgtgttaaaattatccatgaacaagtgaaacctcagaagcttggccagtggtaacaataaaaatattggtagctgaacaaatcttataaaatgtaaatctaaactaagcttttgggacaaaaataggtgacaaatacaaatatgtatgccattaaagatgcagatacattaacagagtaactcaaattccagaaaattaccctaaagcaatacacagaaaggaacataaagatttatgtatattcatgctcaatgcaacattacttaaggtaaaaatttagaaacttaaatgttcatcaaaagtgaaataaaataatttattccattgaaaatcacatttcctagattattcaatacagagagaaaatgcttatggcatggaacatggaaaaaggtaggatatctatctctataaacaaataagtttcaattttataagatatatttaattttaaagataaatatgaaaccatcctacatttggttagtaaaattaattttcctgtcttatattctgtgttatctaaattatgaaaaaacatgaatattatagtaatttttaaaataaagttttaaaattatggagtacaaactaataaaataataatttacatacattcatttctctcaacatttcattttttaaagatactatccacttttctggatttaaatttaagaatcagccttctctaatataaaaacaaaatttttttaatgatacagtgataaaaatagttttaattaaaattcaaatctgattttatgaaaagggtttcatcaccatctgagcacagtgttgtaaatatatttgaccacattttctattatgtaatgataagaagggacactactcatggatgatttttaacccttctgccttagaaactgaggcaaagctgaatagtaaacattttattttgaagagtgggattctgagagaatgattgtgagatgggaagctaagcagacatgaaggagagccagtcaaaggtgcattatttaattggtcaacaataggaatgacttatataactcaaatcccatagaaacacatatggaactatatgaagtgtgtctcagaacttcctctctgggaaaattgaggaggaatggttacccatgggctcctgctctccatttgtcagtttcatccacgatattatttacatttctgaacctccaggcttgtacctagataagacatccccaaacatggatttccctttggcatcaacagagaagccctgaggcaagaagaaagagacatggggcctgaagcaggctggagtctgcagaactggtaaccatagcagtgtctggggtgagactgatgtaacacgtatacacatatacttcctaggtaaattgggctgcaaggagcttttctttaacccctgaagacactaatacaaatcatacctggggactagtatcagctatcatttccaaaaataattccaaatatgccaatcatagacaaccatttagaaacacacattttattaaaaggctatatatatttaaatagatgctttatattctgtcattttcttccaagagcagttttaataaaggcacagaattacatagtgtatctcctggtcatagattactagatattctagagctctctgaggtagggttgatatgtcagctatttgctggttatatatggataaaattctaatgatccataaagtaaacagccattcaagatgatttcgaatgatgtaaacatgcacacacacacttcttgtattagagctttttaaaaactttaatagaataatttaatagaatagagctaaacccacagcatatattgacagctataaatggaaattttgacactgatcatttcttctttcaactttgatcctctccctattttgcctgaaattttaaactatagacacaggttcttttcacaagaccattactttattctctgtcagtgtttctctatcacatttaaggtgaaaatgtattaaatataactaaatggctggaccttgaataatactagaatttctaggcaatatattgataaaaatattctgtatattttacctgccttgaaatgcctaatgcctaacccaataaattgttgatcaaattttatgtacccttggatagaaaatatttcaatggcaccaactgacaggtgtaaaaactaagatctagagaggttgtgtcatcaaagatcatatgacacaatagaggtagagttccaaaaataagtcagatatcctcattacaaattctttccatcaggactctaggactttaggtgacacaaaagccatttaaaatgctctctataaaaaaagacctattggctcttaacaacttaaaggccctaaaagtgatactgatgggactaaatttaggcatatctagaaccagccattaaatattatcagtcaatttctcagcagaaaacacacgaaacaatcaaaattaggatactttttgaatttttttttaattgtgtgtgtgtgtgtgtgtgtgtgtgtgtgtaagtttaacaaaaatctgtgttaggcaaggcatggagaaatcccaagaatttattcagtggtacccaagtaccattactgcatctgaagttattgaaagtagtagttacagaatcacaaaacagataggaatgtgtaaagggtttaggcattaactttagggacacactccatcccagggtgacgtctccttctctggagaggcattcaattaaaaatacctaacctgatttacctcccttctctaatgacctgtaaagtcttctcattttacaagtggaagtcagagggtaagggatcccattggtataacccataaaggtcagcctcctaagggaggtgaagaagattacagaatgtatccggagaaacaaacagaagatatctagtgttgaccagtagtagtcttgtctattggatgaaaaatctatatccattacgagagaaaaaaagcaaaatctcatcagctaccaggtcttcatggtaccaatgtcaccatatcctagtcctatccctgaaaactaaaacagcatcagtttttttgttttgtttgtattttccatatagagtagcaagaggcaaggggttgaatagcagtccccatattaatgaagcatagctgctataatccttgctttctgcagcaggttggcatagcttggtaggcatagcttctttctttcgccatccatttcatgatcttatcctgggtcagaatattggctaaacggtgttctttaccctaatcagctgacccaagtctcaatgcatatgatttgtgtggggttctgtcttcattaagttgcaatgtatttccattgaccaagatttttgagtaaggggatactcacaggtccccctgggatctaaatatagtcatcatttcccccatatggcaaaactcagccttttcctctccctttcctgctgcaactctggactgaccttcatgctggttccatgtatcttgacttcctcttattcctgctctgcttcttctctcacaccattgctcttcccttttgttatcccaccctttcctaagcacatctttctcactggacaatactccctcataagttttataaagtaggtggggatgatgaataacccatagtcggaatatttataaaccttgtccaaaatctgattcttcataactatccctgtgaactttcctttaagatttattggcaatgaatccaactgtctaaacaatccatctctgatttctgagattgcttaactagcacattccaaatatactttggtctcaataggggtgaaaataccacagctgtgcaatcttcttttttggtgaatggtcttaaatgtgacttgacaggtttagttagaaaatagaagataggattgcagacagttgactctgaattacaagaccttgctgagaaaatagaagatactttgactcaaaaaaacaaaaaaaagaaaaattgtagaccaaattaataacttcttagattgaacaaatagataaactcaaaacaaaggataatatttctagacatagatatcagttgatatttgatataaaaggaatactaggagaaaattatcctgtctcagaaagatataatctaaaacacaaaggacaaactttgtacaacatgacatccctctaagtatatctatccagtgtagttttcctacaattgccttaaatacaaaaaggagacatttttctggatttgcaaaaaaaaaaaatgttttatttctagttgataaaaaggccatactctctaccagaaaccctaatattgttccacattcctctttccttcaggtgtccccccaccccacacacaaaaactagtagaacatacttcaaatatcactctgacaatgcttttgtcttagctactttctgactctgcaactaactgacaatctcactactcatgtgcttttctgctcgattatcctattccagtgaatcaattgacacaagatctactttgtaacttggatgccaccattaaatatgccagaacttcccctttctggaattgcagaagagaatctctggccaattatttaatcatggctcagattaaccactacttgatgctttatcattttataccttaaatatttttcctattgcctccaagccaaatatgtttcagatgtggaacacttactggaggctgaaccaactggtttatttatgcccttattgtagtcattcaaaagccaaaggaaagagaggctcttaaagactttggactatcatatccacatatctatagaatggactcataatcttcgactgaccaagtaatacccctgctctacccatcaaatagacaaatttttgctgttattattttgtacataatgtaggacccattgaaaagactattctttctcatttctctgcagtcctttaccctaatataatcctatgttcgatcccaaagatagctgctgaatttacagtgtagatatgtatgctctggattctcttgcatgcagattaaattatctatttgtaatcaattgagaaaatcaattagacagttatgattatcagattttgcagcaatatttcttgcaatcatttacgtataaccttggagacattccattttttaggaccctaatcttacatatgtggctgttgtttcattatactttccacactgagaatctgtggacatgcttctatttgcttacagtaataagaaacaaaaaaggcaaaatctttaaagataaacttcacttttgtcagtcccaagtggttttcaagattgtgaaatctataaaaagcaaagtctctttctcctcagactggagtatattcaagactttccccaggcaataatctaaagacagcttagatttagagagtgtagatactggattcctaactgcttccaactggaagccactttttatgatctaacgctgtcataccttgcccttgaaagatgcactaagattttcttttgaagctcaaagctattcctctcaaccctcactcccaccttatatactcagacttccttactaccatccttttttttctatttgcatattaaagattgggaaaatgagaatatgaggattctaactcaacagtacaatggccattacagactcaatgcttatgggtcttactctcttacttgatctataataaaagcctgtttgttttctagtagtgaaaatagccataattaacagcagagttaactgagacctatatgtacttaattcttaggctccctacttaacctcatgctctctcatgtagcttagactttaatttagaataaaatcatctaccatttttatgtatctaaaatgatcccctaggaagcacttctctttttgctcacacatatttctatcaattgttaccgcaccttaacctgttatttttcttcctttggtaaaggagggcaaatctcctgactgtcatacacttattcagaaattttccttgcctcactctgccctcccttaaactctgtgttctccatccaatattaaatgctatgggtagccattcacttgacaaacaatttagattcaattataatacaaaggtaaaattgatgagagctgtgaaggcagtcatcaatagagatctgagacttcaaccaacactttcaagaattttgaagtatttgaggcttaacgctacttgcaagcatcaagttagcctgccagagtttcatggataattgcagtaaatacagaactcctgggtcaggaagaaaggacagaaaggattatccacatcagtagccatgatctgtacatcaatatatttgtgttagttcccgttgcctgatgtcccatgggattaagacagatagaatcagatggttgcttgcacaattaatagttcctttataggataggatctctgaatttagggaatcttaatcttttgtcagtggacagtaagcattcttgctctctgctacagaagaagacactccttcttccagtatttgctatacaaaagtcattgaaaagagtgtctagaataaatgtattaaatgtcccacttgtaagatttgcagagaagcaagagaaactcatgagcaattgtctcctaacaaacacgagaggtgtatgtttagagatttaaactaaaattaggtcacaaaagagtctttcccaatgccagagaagaactgtgaaaggcagtaaagggctgagaactttctatggcaatttctgtaggtccttgtcattgaagttcttcctctcaaactcttgtgtatgactttaaaacctaagtttcctctcatctctcttaataaaatgcaaattaacaaagcttcgaaatctacatagtcaattcttctctcttatgacaatagttcttacccaactttttgcaaaatgaactgaactttgggtatcttttcctgctaaaaccccagataattaacctcctttccaaagttaggatagtctttctgtacctgtcagttttaaagaaagacttatgctaatggtactctggttgattttattaaacactaattttatttatttacttgataaatacttattcgttgatttaccagatatttatttgcccaacttggttccaggcattgaaaatacaaaaatggataaaacatcaaattttttattcctaaagtttatttatatatcagttgaggagatagataatattcaaacaaatgtgcaatgctatataatatacaataaatgtgaggtacattcctggctatatattgaaattacctggttaatttagaaaattccacctgttcagtcactttggtaaatatattgattcagcattttaagggttggctctaaaacaatttgccatctttttcagctgctcaggagattctcatacagatgaaggttgagaacaatagaaataagtggtatgaaggcaagccaagcagtatagtggaagtaaatattgattggagtggatgtagatgagggaaggagtgttgccctagggaaggtaaacattaattggagtggatgtagatagaaggagtgttgctttaggtaagtggtcaagggaagtctgaaatttgaggagactctgaaaggatgtgaaggagctagtcatgcttgtatctggggaggaagagtcaaggcctaaagaatagctaatacaaaagctgcaacacaaagtttgctaggaatatttgagaaaggaaaaggaggttacaaaagaacatgtggctggatctgaatgagactggtagaaaataagaaagtaagtcaggtgaaatactatcacttagtagtttagaacacagcttctggagttggactaccaggggtcaaagctcagctttgttattttttagtaacataatgctgggctaattatttaaccttcttgtaagtcaatgtctactcataggtaaggtggaaataattaaagtaacaaaccctttgtttgttacttactttaaacctatggcttaacatgtataaacacacatacacgtgtgtgtgtgtgtgtgtgtgtgtgtgtgtgtgtgtgtgtgtgtgtatatacattaagccataactaggcacttctaaggaggaaaaataaaattagccttttcatagataacattgtactaattgatagccccttctgcatagttcacattaatcaaaaagttcaaaatttgacttattcttggtggaaaacaggaggaattattataaaaaatgttatcttacttctaagtaaatattttatatggatcagtgtgaatgaattcagctctaaaaagaaaatttatattgattctatttcaagtacagttgtgagaatgttaatttacaacacaacatcctcctttcttgacttaaaaaaaaatgcccgaagttcatagttcacattacagttcagtctcagtatttgtacattctactggtttagaaaaatgtattatggcatgtatccaccattactgtgtcatacagaatagtttcactgccccacaaatccttggtcctccatcctttcatccctctttccccactacccctcaaaacaaatgaccttttcactgtctccatagtctccatagttgcaggcatgctgtctgcaatgaggcaggcagcttccactgtgggcactgggaaataaagtggtgcccagaagcttggagatgccaggaactgcagagccccaaagagggtgtcaaagccctggctcagggagctccttggtctgggttccctgaagggccacagctcttctctccttcttgtcacccacaacgtggtgagtggcggtggaggtatgtttcagccctgtttgtgttacagctctttcagtcctgctgtatggcaggtcctgagtttttgtctcatgtccaggaataatgaggtatacagacaactggagcatgagcaaggtgaagagatgctttattgagtgtcattacagctcttaagagacccaaagtgggtagctcctttctgcaggcaggttgtgctggtgtctatgcagctctcagtggagaggagaccaggagtgggtagctcctctctgcaggcaggtcattccatcatctgcctgagcatggttgactttgtggtttttatgggcttcaaaggggagaaagtacatgctgattggtctataggcagccatggttgggcccagaaaaagcaccatgaattctcactttgatctgcagaactgacagcctggtccctaggcttcaggctatccctggcttgaaggtggggcttcaatagggacctacccctttccccccaggagcctgtctgcatcctgccaccataaacccattgtccacagcacccacagtccccaagctgttcatgtggatgggtgcctgcagctgtacccagaagggcaaggctcacacttcttcaacttggaagggggaatgagttcagccagctccatggagtgtgtagccccagccgtgcctcccctgatgcagcctgtgtcttcacaacagctgttccagatggcccaccactgccatcacaattgcttgatcatatggctaacttcttatacttatttgtttgcaaaacactcacaaaaggctctgttttattgcataattgcaaaacagaattattgcactgaaagtttacaaaaattggggaaaaagagcgttatatcctttggtggctataaacaagaaaagtattcatcagaataaatctaattctccttttgtaaaatagtaattcctaccattgcctaatgtaagagagtagtagcatttggggttttaaaagaaataaaaagcacgtgcttcccactgattaatgtgagatagcactaaagtaagttcctgcaaactatttatatgttcctagatgtctgaagcattagtgtatacaacttcatacttacaaatttataccccaatttgaaagataattaaatgttcgttttcactcaaaatgtaaaagaatttaaaaaaagcagaaacatggaaatacaaatccaagtattttatgtagtttaatacatttatatataaaaatacatccattcaaataattcctatactgaagtacatagagtattgtactttactcataaatattgttctgaaacattgtagttatcctcattttactctacatattttggttaagactgtgagcatttacctaacagaataaggtttggagagttaacactgtctggcgagaaatttaaggacgctttaaacttataaataagttcttcctaatttagttgtttcattggttacttggttttaagccaagtgttgacaagtaaagcatggaaacatttctggtgaaaaaataaactgtaaaatcttttgccactcttaggagatattttagcacatgagaaatgtgtggactttgaagactgatagatctcgatttgattgatgcttgatcattcactggctctgtgaacttgaaaaaggaactgaagctattagaatttaagtttaatcatcaataacagttattaaaaatattaaatgaagtaatatatagaaaagctggctctgatcaaggtcactattggtgtcaaggtcattgattactttcatgttgctaaatccaatgagaagttcccagtcctcatcttatttaaactattagtgacttttgacatagccaaacactctttcctctgagaaatcattccttaaattctaagacaccatactctaaacgttttccttcaatctaactggccactccttcccagccttcttttctggtattgtatcttcctgataaataatttcccagggttactcttcctttttttattctccatctgatttacaacccattcatctcagagctttaaaaaccatgtctgtggctgatgaacctctattgtacatctctagccctgacctctttcctgatttctggattcttatgccccacctcctttcacacaagtttaataggtgtctagtagatagctaacaatcaatattgtcaaaatataaattatggatcttctttccccaaatatgctccatctgatgccctatctattttggtttttggcaacttcagtattgccattgtccaagctaaattgtagagtcatttttagttttagttttttcagaaaccacatctaacacataaagaaatcctgttagagaccattggctctatcttcaaaatgatctggaaccttatcacttccgagcacctccagtgctgacctcctatccaaccggcatcattactcactaacattaatcttttatcctgttcccctatttctgctctgatctcctttagtatattataaacatggcaattaaaataatcctttaaaaatttaatataaatcatgtcattcctccactatatatcctgcaaaatatattcattttcttaagaataaaagccaaattcaatttaatggcctgtaagtccccacataatactttctctcatttcttctcatcttttctccactgctctgcctgacatttacagtcctccagctatagggggagccttgctattcatccaagtcaacaattcatttttcaaccttgaaacctttggactgatttgtccttcttcctggaaattctttctctagttgcctgcacagctaattatctctgctacttaaaatatttgcccaagtattattttctcagtaagacaaattagtgaccttcactcctcttctacccacttcagatcccacatagcctcatagtataatattgactccttattatacattatcttttcaaaggaaaatatatactgtactggtgatatctgttatggctatagaagagagatatgtgttgtcaccagttccgtgtattttgcctgtttattttcatcatcatgcagcttgtaccttgtgatgtcctactccataattaggattagtagaattttgcaaatacaattttatcttctggtttttgttgtcttttgttttctgattggaaatctaattaaaaggtagcattaggtaggttatcatttgatatcatatttacgttttgtgagaactttaaaactgttgggtgggacttaatctcaacagttcatgtgagttttccatgatcagctcagcagcgattgagtgtttatgtctgtgatcaattttaattttagactaatccttcttaaagtataacttttgttgacaaggccacagataggatttctccaggtatgattcttgaaacaaaaatttagaatcttcagtaagatagatttggtgtgtttactagccccttcagaaaacttaataaaaatgagcttcaacataacattacttaaagaacaagatcttagttttaaacaacagttgtttatgtgatcactcctatataagcgccatcaggaaatttggccttttgttatttttgataatttgaaaagacaatcatcatattaaacaaccattgagtttctttttttgcagcttcctaatttaaatttcataatagattaatatgaattgtgtaatttgagtctatcatcttaaagaactcaactagtatcataataagaattataaataatatgatcagagggataacaacggatctgactctatttctggtgtttatctgctaacttttatcaagccccaccactccatcttcgcctctgccttacatctaagtaagcagataagaaagtcagggcctccattttttggacctcatgctaatttcaaaccatgaaagccccaacacacatacagacaagaatcctgtccccagctccactccctaaacacaataaaaacgaagctagtttcctttctctgctgtctcaagccattttcagacctgtttgggagccttccctggtctccccagaaacattataaggcaagttataaagctttttcttttctttcttttttttttttttttttttttttttgagacagagtcttgctctgttgctcaggctggagtgcagtggcactatcatggctcattgcaacctccacctcccaggttcaagcaattctcccacttcagcctcccgagtagctggggttacaggcacacaccaccctgcctggctaattttttgtatttttagtagaaatggggtctcaccatgttggccaggctggtcttgaactcctgacctaagatgatccgcccacctcagcctcccaaagtgctgggattacaggcgtgagccactgtgcccggcataaagctttttcataccttcttgttgaatttgtatatagcatcttgaatctgaatcaaattacgtgtgggttgggtgcaggaacagattcatccttttttcatagtgtgaccacacaaaagcaaaatacataataatgaagtacaacaagtggtctaaatgaatttcatatctgggcttatacatttgtaacaactatagagcaaataaaactgagtaacattatgaaaataataatcctagtatgttagagcacaaaggcatttatgtaaatataataaatgaaaattattctagtatggtaaagattcaccatgctgtaaatttggaaaactctaagcctactgctgagtagctctatgactttgggttagatactacatttgctggcaaatgttttgttttctgttaaacaaaggattggattaacaccaagtttctttccagttttgtgagtaaatatatatttttttattttcaaggagaatacattaaaacaaagcaaaacgaaacctcccatattgacaatgaaaatatttccgcctatggatatttaaaaaacaatgtacttctaagaatgagggtgtcatttcctttctaaaggaaaaaaaagagtattatagaagatgctgtatctggcatataaaataggcagtttcatacgtgaatgaaccatactgaattgaatatagatcaatcaaagaggggtaaaggaagtaagtgaaataaataagttcctaggaagcattcaggcttaaagtttcaagagaaatttaatttataactgcttcagttactcctatgagccaaatttcgtgaaaaactaaagcaaagtaatatttcaatcagaagaccaaacattgaaagaaatataatacaatgcttcaaatactataaccagtttaaccagtcatctctcttgtctttacagaaagccttagataagctaaaataaacaattaggtgtttaataagaaaatggaagaaaatattcagatacggacttttcctccttcagttctgcaaagtgcctccaatacgcagaaaaatatcagcaggattgtgaaaataaaggtagtcatgttgaagtattaactatatttgtgagaaattatacatggttttggcttatttaaatttaatgatggttacatttaattccctaatgtattttagaaaatgtgaaaattaacaaataaaactgcctcttgttatatagtactctcaaatatctaaaaacatttttatagatatctttacaattacagtcatgtaccgcatgatatttcatacattacaatcatgtacctatgatatttcagtcaacaacagactgcacatacaatggttgtctcataagactatttgccatatttgccatatttttactgtacattttctatgtttatatgtgtataaatacacaaatacttaccattgtgttacaattacctcaaataatcagtatagtaaaatgccgtataggtttgcagcctaagagtgaaaggctacaccatgtagcctaggtttacagcaggctatatgatctaggtttgtgcaagtacactccataatgtttgcccagtgagaaagttccccaattacgcatttctcagaacaaccttaagtgatgcatgactgtaacagattcgggttttttttttttaagggtaaatcactgagaaataatttctatgtaatataaatagaaaattgacaaatttattcaattaagatatattaattagttgaaacaggtcaaatattgttttatgtgctgaatattaacaaatattatatgttacttactgaggaaatagcaagtatatacccctcggtcaggaacaagctttaaaagttcatagacaataaaattatgagcttacagaagagtgaacagggtgagggttatagaaaatgagataactacaggagttaggagaataaaagagcagcctttagtcctggtggaaattttggattttactgtaggtgatccaaagctactgggggcaggagggtagtaacgattggttaaatgaccatccattccaacccacacgtattatgctttagtataattcaaggcctgaaaacctgtcacttgtatttattttattatttttcttccctgcaggtacttttctagatgcaggtaagttttgctagttagatgcacttacttgagatttgaaatttgtaaataaggagggtattcttgctgctatagctgttgtaagtctgatcttggagtaggtttgccaaatttagcaaataaacatataagacaatcagttatactttaaacaacacatttttagtataagtacgtccaatgcaatatttagtaaatacttataataaaaaatgtattcgtttatgtcacattccaatataagtaggggttcttttacgtgtttaccctctacttgtagacattgagattttctatgtcaaatcataagctatatgtgtgatgagaaatagttgtcaagtataacaggggccttctcttcccttatttgcaactctaatagagtattcttgaagtaattcctgtggcaatcttgtgactgtggccagtatagccacaacttgtagggaactctgcgtttcccccaatgttgtgtcctgtaggagctcccttgccctgccagttcagcatccttcattcgggagtcaatctcagaggccaaattaaaactgtctgttctaggtcttctgatgacaattcaaattcagttttattgaggcaaaaattatataaaatacactgcaatgatttaaggtatcaaatttgatgagtcttgatagatgtatacacttgtaaaatcggtaccaacaagatataaaatatttttatcacccccaaaattgtactgtgtcctccctcctccctataccatcaacctgcggtcaataatttctccagtttctgttattatagttttcattttctagaatttcatgaaaattgaattacacagtatgtccctttgtatatttttttaaacccagtataatgttgagatttatctatagcgtcatatgtattagtaatttgttactatttactgcagaataatattccactgtataggtatgttatactttgtatattcatttagccatactggtaagtatgaaggatatttccttgtgattttagttggcacttcctcaatggctaataatgttgaacatgttttcaagttcttatctgccatatttatacccttctcagtggaatgcctccttatatattttgctttttattaaataattggttttaaatcttgagtttttagaggtctttatatattttagataaaaatcatgtgtgagataggtgattgatttgtcttttaatcctcttatcgaggtatttgagaaaaaattttacttttgattaattttaaaataatttttcattcataaattgtgcctttggtggcaaatcaaagaactctttgcctagccctagatcttgcaaaattttctctatgtattttcttaaagtcttatagttttgtattttagatataagtccatgctccattttgagttaatgatgtgaatgaggtatgagacctagtttgaggttcattatttgcctttagatgttcagatgttccaaatgtttccacaccatttgttgaaaagctatcttttcttcattaaattgcttttgcaattgtgtcaaaagttagttggatatatttatgttgttctatttttatgtttttcattctgttccatcgatctgcagatctatttttgtgccaatcccacatagtcctgattgctatacattaagtatataaatgggttgacaacttcctccctctttatttctatcaatattattttgtaactattatattttctttgcttctataaataaacttgggaatcatttaatctatataatataaaatcttggtattttagtatgaatttgtcaacatacctatcaactgaaagagaagtcacatctttgctatgttgattcttcaaatctaagacattgtgtctataattatttagatctttgatttcttccatcaaaatttcattattttagcatagtaatcctgtatatgttttgctagaattacacctaagaaaagaattttcttagaatgatttcaaatagttcattttcaattttgatattcatgtgttcatttctagtacagagaaatgcagttgattttttaaatgtttatttggtctcctgtgacgttactgaattcacttattagctctaggatatttttcttttcaattttgtagattctttaagagtttccatataaatacatatcatctgcaaataaggatggcttattgcactagctagaatttttggtactatgttgcatgaaagtattaaaaggaaacattcttattttatgttcaatcttaagatgaatgctttcaatttttcatcattaagtctaatgctggctgtggaatttttgtagatgtctgtggccaagggtcccgattaagccttttttctgactttttctcataattggttgtaaaattttgttaaattctttttcatcaattgatacataatttttcttctttagcctatgtatatattagattacatggattaatttgcacgtattgaactagccttacattcatgacatactgttaagaagttttattattttttattttttgtactgtcttgaacaggttttgatatcagagaaatactagcttattcattaaatgaaattgtgctctcttgatctattttctggaagatattatggacaattgatatcaattcttttttaatcattgggtagacttctccagtggacctggagatttcttgtgggggatatttttactgatcaatttcttttagagttattgggctatgaaaatattgcttttatgtaagttgtggtggtttgtttcttgagcaatgggttcatttcatctaggttgtcctattgacatgtgcatagttgtttgcattatttccttgttatccttttgatgtctacagaatctgtagtgatatactctttttcattcctgatactggtaatttgtgtcctttcctttcttcatccatgtcactggataattgtcacttttatttttccttttttaaattgatttctttgggtttatcttgctctgggttcacccacctccttgagtctataagtttgtcttctgcaaaatttagaaagctttcagctattatttatttgagttttttttaagtctgctcttcttcttctgggacaacaacattacaaatgaattacaaatgtagcagctcaactaatgttgtcaaaacataggtgtttatttagtgttctcatctttataactttttctctaatgctcaaataagcctaatgactttagaactgcttctagaaagatgccaaaggaaaaagataccaagcaattgaaaagaactgggttagagtcaaattgctgcaaaaagcaaaaagctgcaaaaagggatatatagccattctctttctcaagaagtgacattttaatattttcttaagatttctgagaagtaacttagaaagtttttctcttccacagtgacttttgctgaagccatctttggccaaagtagaaaacattttatgttgtctgcattttctaatactaattaaaataatttcaaatgacaatgctagatatcattatcattcatctggaaagtaaaagttattccaataggagacagtaaaatgcttttatattttaagacagagtcttaaaataatttgaaataagtacaccttaactgttaattcagtacattacaatttttgtaagctgttcaacattaaaggaaaagacagatggttatgtaaattgcacaaaaggaaatgcatttgaacaaaagtaagctcattaaaagagctgttttcaccttagaggagaaatctgttctttaaagcaaaaggtttattatttttttttacattctttaatttttttaaggtacatcttttgtggacatcaaattcagttttaatagcatcacacagggaagtaattattcaggaaggccacattctgagactttattgaattcagaggtttgattctttgcacataaacataaaacttcattatctgcacaatatatggcagaatgtatttgttagagaatgagatcattgtttggaaacattcattgtgactgcagctgaaagtaatgaatgtgaaagcaaaccaccaccaaagtaattatgatctgtgtctctatatctttgtctcagagcttattgactgatgtgtctcctatcccaccttcttccatttttctaatggttttatcatcttattatagaaaaaaagaacaaaactattgagtctggcaatgacccaggaccatcactagaaaatgataacattaatagtttagattggctgaaaagtaaacaaaaatataattatactgttaactttatcaaatatagagtataagttttcctaccaaaattgttaatatggatgtagattcagatatagctataaatggataaatagatggacagcaacatagatgggtatatatgcacatataagttaaatatattttcaggtattctcattcacagatattttaaacagcaatgtaattgtaatgatacaattttataggtacatagattgtgtgtatctatagttttttgcatatactacagttatttttatatattttcataaatatatttgtactcctatgtagatatatctctaaaaagatggataatttaatattaacctgagaatatttccaagcatttttctcagttggtccactgaataaaactcaggttcagcaaactcaagtctcttatttttcaaccctctgagaagtatcttgccttcttttgggtagctgtcatgcaaagtcttttgtgactaggggagcaggataagaaatttgagagatggagtgaagaaataaatgagaaggaataaatgcaaagtgagtgatatgatttggctctgcgtccctacccaagtctcatttccaattgtaatccccacatgacagaggagaggcctggtgggagatgattggcttatgggtgcagatttctcccttgctgttatcatgataatgagtgagttctcaggagagctgatgattttaaagtgtggcacttcccctgctcgcgctcgcgctctctctctctcctgccaccatgtaagtggtgccttgcttcccctttaccttctgccacgattgtaagtttcctgtgaccccctagccatattgaactctgagtcaattaaacctttttttttttaaataaattacccattctctagtagtcctttatagctgtgtgaaaacagactaatacaatgaggatgaaaatacaatatatatgtatacctgataaaagagaaatagattgacttaaaaatattactacagaagttctactttcacagtttttgagaaatagatataaaagtaatttaaattattttgagttactaaataacatgagataggttctggtcactggacttttttcttgacacactcaaactgtatcatgacacatccatctatcaatactttagattaactttatcgttttccttttgaattgagagtgtattttcaccatgactgctgatttatcaccgtgttttgcaaaaataaataaataaataaattgctgaagagatagtatggagatcacattaacatttgaatttttttttcttagggaggagactacagatgtgagggttctatatttcaagtagagaccagtaattgcatagcactttttgagtcccctgacttgaattaacctatgaaacaagctgctaaaattatcagccagaaatttgttttcaaccctgggtcaaacactatttattaagaagttctacctagtgggtactactacaggagatagtgattcaaatatgttgcaattaattcaatgtacttgccaaattttacaagttgaaaccaatgcccctgggatcttagccctttttactgacctagttagacatatttttgaattactgaaacaaattttcattaggacctagagaaatttcagagtcctatcttgggtgtaaggggaaaaaaaacacacaacatattgtgttgcagataaatattccatgtagaagtttgatgactgggcacacttacatgtcagaagatgttgctatgtataaaaatgtttttaagtctcaaactgaaagattgtcaaagccaatataactgattttcttctatctacgactgactcatgacctaagaatggatatatacaagcttgtacagtgagtcagattctatatgacaaattctactcttgtattacggctgagaaaaaaaaaaatccactgtgacatacattatgtgaaggaaaataatagaacaagtcctagagctcaaaaacatctcaactttgtctgcatggaagcaatatacaattaagaattggtgtacactactggctttcttgctgccttgatatctcactgttaggaagcctaattagggtaagtataacacagaggtggatctattgatctgcagaacttcctaatgagattcttatctgatagaggaaattgacttggacaaagaggattgatgcagacatggctcttctccttgaatcagtccacttgtaaaaataaggttagacccagagcaggttttagggttaagattgtgtaatactgaccataagaccaactgatatagtcaatgattaaaaagtcattgttttttgcagactttactataaacatggtatgatccaaatctgtgggagtttgtaattgtcacaagtttcaattttaaacaaacagggttatataattacttgctcacatttatttttatttgcacgatgcatattaaatatactttttaaatgattttttatttagacattcattacagtgctccatattttatttaaaaaataacatatagcagacttcacatatttttttccaaggaatatatccagaggcaagtgagaaaaattacagccattcttaataagagaagaaaaaagaaaaaaagaaatgcatttggattataactacagaaattctctattaacatgacaaatataaatagtaggcatctttttgtggaagtctggaaaaaacttaccttggacaactacaacagagtaacacattttaacacattattctttccagctatttcctctcatggacacttgaaatatatttagatttgtgcaatttatttttccctctaattcccagttccccatacaccatctaccattaattgctcagaggaggaccaggttttgcaggatatttaagcttgcagaggggcatgctctggcagaaagggagaaaaggtattcctgagataaacaggctatgctcagaaagaattttattcaggaaatttaaataaaaagagttgaggtttatgacggatagggaaaaaattggaataaatatattgcaggtgattttatgtttctttccttgtgttcaagaaatgttagagaagagtgtgaacattctgaacttgcatattagccctcaaagcatgttctttgattgtgatataacttatgtagacccataattgtaggagctataaactttttctactttattaatatagaggaatatatatatctttgctgagagaaaatcaagctgttgtgtgttttggaagtagatgacatcctttgtttcttgggcagtgtttatatcattagtcatatcattctgcctaaatgtaaatcatcagcacaatacgattccagaaaagtgatatctcaggcaagttatcaacaatttcctaaatcagaacaaaaaaatattattttcctactgaataacatttatcactgaggtagattcccgagattcataagaaatcactgcttttaaaaataatccagttaagtacttgttcttacaaactcttgactgtaagtcaccctatcaccagacagaaaaatagacagatgtaaacaaacatactgaccaaaggtaaagtagaaatatagagtagctacaaaccatacaaccataaacaggaatatctttccaatttcacttagcaaaccaaagaaattttcgaactcagctttttttctgtataatcagctgatagagtaggttttacggaaaagtccgcttcttttttggctgtgccaagcactactaaccactataccttttgtacttattaacataatcttggttttgttcacggcagcaatcctcgtggttaacagccctataacttagattaacttgcaacttgtttcgccaaatgactcataattgggcaatgagttctaagcaagaggtccctgtgaaaactactgtttttgactgaaagatatgagctcagctggcagtaagattttgcccttttgttttctcctttcttcttatccatgattcatatgtgatactctctagtataaaaccatcttatgagtctgaggaagaaagccacacattaacaatggtagaggcaaaaggaagatggaatctggattctcaatggcagcctacgcttagttgtcttgttacttagaaaagaaaaaaagtttcctgatgtagcccctatactcaggtttctgctatagcgttctgtaacacgtgataatttgtaacaagacattaataaaacaagtgttgtattaagttatacatgaaagagcttgcaagttttataagcaccaaaagattacataatacagttaaaagtttactataacttctatatgttttatattaagtgaaagtatcatggccattattaaaatagacattttgacaaaatttacattgtgtttatgagatgtataaatattttaagcaatttattattgactaaaaaactacaaataagcaattatctcaaaagaccaagtgtgcatatgtacttttactgacttatgattacaaaattatatgagctgaatgttaaaaggaatttgaagtcactctgtgtgtatatgtggcggggtggggggaagacctggaatgcaaaacaaagaaataatctattttaaaaagaatctattttattactttaaaatttatttattttaaattgttttaaaacaagaacaattaccaattgagcaatttatttattagcagttgttattagaaaataaattacaattttaaatttagatgaaaatataatgattaatgaaagaagatatatttaacaatataaatagaatatattatatgactggtgtgtctagacttttaaaatcaccagtggtcaattgtactttctggatttgctatgagttgaggataaataatcccatggcttataaaattgacaaaaaaaagaaaagaagtaaaattaagtattttcatagctattttagaaaaaaattcttcacatatatgtagtgtaccattgtataatgcagaaaaatagataatagtaacataacatataattcatcaaatatacaatgttacatcttattttccataatttttaaaagcacctaatttcaatttttaaaaaaaatttttttggaatgaaaatattttgcacgtatctagaaaatacaaagtcctgtaaaagtgttcagtttctggactttagggtagacaggttcaaataagttcatatatccttcttttctttctttcctccttatgtctctctttgactcctttgtctaagtctccttttctccctatctttcctcttccttttttttttaaattttattattattatactttaagttttagggtacatgtgcacaatgtgcaggttagttacatatgtatacatgtgccatgctggtgtgctgcaccaattaactcgttatttagcattaggtatatctcctctttcttcttatgttcctcctccttctcctcttcctcctttttctcctcttcctgtctatctttctgtttaagccctcacctccactagatactcttcaattttgaggattagattttcatatttcatttgcttctcccttggtaactcagtagtaattactgctttctaaaatatagtttcccaaaaggggggaaaataccctttcttcctcaactctacctgtattgtcttttgctccatttaatcatgtcctgtaaatatgcttaaagctaaagaaaatattttaacagaaaaaaattctgtatcttacaggcgatgatgggctttctacttccactatcacatagtactgaaaatgctacttaatatcccctgtttcttgtacttcaacattctcccaaacaaaatttcttactacatgttaggaaaagagtggcaaaacattttcgtttgagttgaggtattaatatttatgaacagattgagatttcctcaaaatgtagtaagaacatttattaactggcccagaagatagtaagtcacaaagtaaccataaaagtgaggtacataaatcaagtagagattaaagctcattgacaaattcttaacatttttctgacgttgtggactaggacctatgggattcgtccattactcaagagaactatatcatcatattaactcatttaaattaatagggactatttcagtttacaacccagggaatggttgaccttctttgcaagatccaccccatgatttcatcgtggctggttaagattagtattaaaatttaacctttcagatctacaattaaatgtaagttacagcacttaagtttggtagcatataaagtttcactatgaaaaatgtgtttccacattttattggaaaatctatgtcatttaattgtttgaaggacaaagcactgataatgtctgttaagatttcactctttttcccttaagcaaaccttcaaaagtcaaatcttatatataaaacatgagaattttatacagcagtctatttcaacaaaattatatatattatataaatatatattatatataatgggttttcagcaagatttcttgaaattgaaactccaataaagttaatgacagaattttaagacaaatactgattacatcttagacactaaagaggaataaaacttaggggaacttgcctgctatattcacatcaatgtaatctttattatcttagatgaaaatgcagggaatatctagcttttgacattaaatctcaaagactagaaatgatagatacaaacataaaatgtagtggttaaaaaataagcaatattgcttaaacacatttcaatatgtctatctagtttataataacttaaatgacagaaaacatgattatttgcaaagtattagaaatggagcagtctttcaataaatgcttctaagttaattaaaaataaatgttaataaatattcaaatacttaaaaaatattctagcacttatttaataatttttacataaaacatacattttctttattcaatgaaagccttaaaatgttggtaatattataaatattaccaaaaacgtataaccttttaaaaaatatatacttacacatatagtatcaatttgaaaattagaaggcagaatacaacagtaaagtaaaatcgttttatgcatatttaacaaaaaggatgacttgttattacatggggggaaacttatttccatctataacagttagaaatctatgttgacagtgacagaaataaatgattaaaaccagtttggacagtcaaataaatttatggcttcatatactgaaggttcccatagaagtttaatatctgatatccaattcttgagtcgttttcaggttttcaccagggagagatatctttttctcttcctttctcagatatgcttctttggtgttaacctccaagaagacgtcaacctttttttgagctacttttaggttctattctagtttcaaaagccccagaaattctgaccaattgactgtgaccatctggaaatacatcatgttcttaatgttctcaatcttaaattatggtcaagagaatggtatgtacatattggattacaattattaaacactgagggccttcacctgaaaattgggagcattctcacccaaacacatgctggaaaagctagtccaacttggtgggggagggagacagagacagcgagagtgagcagagagagagagataaagaagagaagagagagagagaagtgaagaggagaggagggggaggggaggggaggaaaagatagaagacgagaggagagaagagaagaggagagaagacaagagaagaggagagaaaatgcactgaatggatactctggagaggcaacagccaatcggccaacctgaaaatctgccaattcaatttgacagctgccaatccaagggggttcaggaaaaacaaaacatgttttaatgagaaaacaatgtcagttactgaaaagatatacacaagataaatggcctgcaaaaacagaatttctgaaagctctgtgatactatcagccttccaatttttatgttgtttgctttttggcaccagcaaagtcaaaataaagagtaattgaaaacttggttatttaaagtccaaaatagagaaataggggttctcccccgccaaatattgtgtattttatagttacagtctatttatacaaaaatatattccacaggtgaatgattcaattatttgcacatactaaaactataaatttgatatgatttcacaactggagggtaaaaattatggtctgtttaccagcaacttatgtaaccatataacattgagaagccagtataatgcgtaataatgacaatgtcatgatatttctcttaaatgcagtactccttgacggtagagatatataaattacaattaaaatatcttaaaaaatgttaatcatcattggaattcaagttttactagtagttgctcagaaagaaaatacaagcagtgagtgtaatattgttaatgctttacacagcaggaatggaaagccaagagctctcagttacattttgaagctgtttaatactaaaataagaaaattaaatgcaacgcatggctgaatagtaactgagacactgtggaattccaatttcacatttgcagccaatttatctcttcatccttctgaagtagataaattgaatatcacagttaatagtaggatagtacttttgagtaaagccaagtatttgcctattcaacaatgatacagattccattgtgcctttcgtagatcccacggcatattctttaagagcaaaaattaaaaagaggagacaaatttgccagatatgttcccctcttaattgtcttatctggcagagagtaatttctgtcatttctctaatccagaaaagatgtattttgagtctattgaaaatttacatttaagtacttggtaattgtataatgtttttcaagtgacagaaaagtggaattgactaattttttcttcaaaaactttgagcacatatgcatcctcaaaattaaaatgataaggaattggagaaataagagctaagtattctattaagtgactttatatatgaaagttttaaaaattgaggctctcactagccagataattacttgactaataaatactagtgatctaaaaatacacaagaatgtagatattcattagttaactcttttccagttttgtggtttatgtagcaatttaacagacaggcaaaataccttcagaccttcaataagatgatacttcactgtcttaaatttattctggaataaccaaaggtaaaaatttaatagtgaatcacagagcctactctatcacatgaccatgtggtaagatcaaacagatttttgcagactaacatttccagaatgttgtatttttaaataaaatataactgacttttattatgtttctgtttaatattaagataatgttaagaactgatgatataaagaatgaaaagccatgattccaattctcaaagattttaggatttagtagaaatgacacatgtaaatagatgagaagaataccaggtgataaggataaagacaggatatagaaaggatgtgtttttttattaacaaggatgagaggtaaatcagggaagaagtaatgactgagttgaactgtgagtgctataggagactttgttatgtggatgaaagagatgagggtagatgtggatgggatggtaaaagagtcattccagtaagacaagcacacagagtcttggtcatattaggttttcttacaattataaatatagatcgcttttctgaaattcttgattacagatgggtgccaaaattcagatgtttttaaaaagtaatatatttcataaactgaatataacatctcattcagatgtagtctgaagctacatctcataatcaaacataatatttctacagtgaaacatgaatatttacctcatgtggataaatacagtcaaaatgagtcacataataggtccgtataggttttgccatgtggcaaattaccaaaaaaaaatctgtgcttaggattttttctagttttgaaaatttgaataagtgactatagacctataattactcaattcattttaatgggtatataatttttaaaaatgaaaagagaaaatggtggcagataaattggagaatatagcagaagcttgaggtcatagagcagataaatgttagagccaaggtttaaaatgaataagattaagacataagtcaatctttcctgctagatgacacaggtcttatgtgtaggatgatctgaaagctagaaggatcttcaggggattattggacatgattctaatgagagatgatgagaacttgaactgtgatagagaagacaggttcaagaaaataggaagagttagatatcttaatttgatatttaaaaagaaatttacatttgccctaagactgcagttagcaattgaatagaaaaataattgtaatattttaacttaaattcaatgactatatcataaaataaaaaagcatagcactgttgtgattatgtgtatggacacatacacacacacaataattatgtaaattacataacttggttaaggttaaagatataactccctctcaccaccatgaattttttttttaatgtaggtataggtaactttgtgtttagaaagccataactaataaataatatacaagtaattttttaaagatacaaaatatggttaaatccaagataacaaattatcattatgttaatactttactttgaaaggtgtcattattttcaagacgtatcatttaactgatctactttatctagttacccacacctatgacttccataagtgaaatgtctttatcagtgaaaacaaaactagcctggataaatggagtaggattgaagacctaaacaaaaagccattcttgagctgcccaggttgtgtcctgcccacagtggcccccaagatcacctgagtgggaggtgaaatccagcctgctcttcccttcaccaagttgctcaccttgacacgggctgcatcagcctggaggacaggctgcctctcccaagtggttctgccataatggctgaaattttgtaatcattactgggtgaagcagaatgcaatttttcacctttgtagtgggcgtataatttataacaataaaaagagaaaatgatggcagataaaatagagagtatagcagaagctagaagtcatacagctcttaattgttaaagccaagaccctcagtggagggtctgtcaaaggcacctcagtactaatagccactggcggccttgtgctaaactcccctttacttgttcactaccttcataggtttaagggcatcaaatactgctcctttttcatttgtcttccacaaaaccagtttcatgtagtgaaaagaacatgggtatcaccagcactggtgcttgaggttcaagaacatgaatgtctaggtttgagctctgaccttgccactttagagcctaaatgttgccttaggcaatacacagtatactgaagaaaagacaagttctacttaaacaagtcagcaaagcattgtgagccagagttgtcaaatccttataaggatggaaacacatttaaacatttacaaattggctttctcattaaaaatacttcagttctgaaaatcactaaatctatatctaaatttgcatactcagagtgagaaattaccatgtacacgttcattaaatgggtcgctcctatacaattttcctattatacagcctaatttctggcagaacattgaagtacattatttgtacatatattcagataattttagagaccactaggagataaattgttaaagtgaaatcaatttttacactacttaagtatgtaaaaagaaaatatgaattcatcttttacagtgttagcatcttatatatttcatactataatgaaaacaagtataatattagtcaaaacaaataaactttaaaaaatgaatttgtaaaagtccgttcatttgtattagggataacgtgtattcatgtatatgaatggagaaccctggggcaaatcaagaataaaatatacaaaggagactactggtactctatagataatcagaaacaacaaatataaataggctcacactacaaaaatagacttaattacctgtaaaatttggcttaccgaagcttactatgcttagtacttggttaacagtaaagcaactagctttaaagttatcagttagtgaagggtgcagcagctacaaagaggatcaataatactatgcttcatgccatgttaacaaccaggcagcattcagggattccctcatatagtgctatagaccactctgaggaatatgcatagtggataattgggtggaatcataaaagggcaaatagaattttcatcccatataaatatataaatcaagtatgcacatttaagaactgctaggatatcactactgtctgctttctccctctaatcaattctctttacatcaatgtaaataagttagtgtatcagtgatagttgctttacctcctctaccagttagtttcattcaaggtgtggttctcagattgcaagatgaagtaattcacacccctgacatacttaagagtttaattgaacttgttgtgacattaacagcctcctgctataaagcaactatttttagttcttgcaaccatcacaaggggacaagactgcttctggcagtacagagagaagagatggaatgtcaacctatagatgtagttaggtataatagtatagataccacattattgcaataaggattttaggaggcaaacaatgaaatggtccaacatgatgaatgataaaatgataagtaagtgagacattacagaatatatgtctaaatgttagcagcagttacttcggtgcagttacttcagtggattgtaattacaggtttttctctctgtttactttcttattgttgtttcagatataattttattatttatatgttctctgtttaatctcgtcttagttattatgaagtgttattttgataaaaatttagaaaactgaagagaagaatgggtgaaatttaatgaacactaaagttccaggttcttgcacacatttctaagacagtgttcacagatttggctgtgagctttctggcaaccaatgcaaaaaaaaaaaaaaagcaataataataaattataaataattaataaaaatatcatagatcagaaaaaggaagtacttcaggcttcaggcctcatttaggggcaaagataagtatttcttgacaaggtctttaaaagttgtgtttgtaataaatatttttaacaaccatcctttgatataaacagaaacataattattggggctgtttccttaaagagtttgtctacatgaaactatcccaaggatgccagaagtactcatcaagtccctgatgagtaaactgacaattcagtgcacatagtatgtctatacaaaataaagaagcaatgatccttacataatgttttgtaaaaccagcttttgatatatattttgctgtaaagatcagctattagcgatttctgacaaggtacttcaatagagatatttttcactaagcctccatttacatgattcagcagtcaacaaagccagagctgcagctgaatcatcctagaggagctgaaagaagacctgcaaatggatggcaacaacacgtgatcacaggaaacccacgaagagaacaatgatttcccagaaataaaggggtctatttcatacatacaaaggacctacactccaatccattgcacaaataatttatatctgcaaaatgtatgtatggataatgatccttcatgtgaagcttgaggctaaaatataccaatgaagcattcaaggaatatttagctttaggaggtttctatcttgttaaaacttttggaaaaattaagaaaacatacgattttaggaaaactaatgagatcattgccacacagatatattaaataggctagggaaacaatggaggatattacatgtactgatggttgtggtctttggtataggtaaagcaactgtggccagttttccctaaggcggccttcttctaggttgaatggtaagtagttgctgatttttgaccaattggcacctccatgtggcagttttatgtgttttaacctaatagttcatgaggacaaatttattttattcactcatgggagaatctgtctttatgctttctatcaggagttagaatccaggcaataaatatacctacgtgcacatgtaaaattgactctcttattagagaagtagaataggttttacttattcccactctgcatctttctgatttcagtagttgcaatctctagagatcactgtgattatgggtaagatgataatgaccttattccagagggggagtttgtaacctaagctaagtcaataagccctacacacaatcatctattggttcagaaatggatatgttacaatggtgggctaaacagagagaggttggtgactgttgaaagtgttatgcatataaatttgaaagtggaataggataggctgagattatgagggaagactgtcttaaaatgaagtcatgaccaatgaagtaaaagctgacagacagtaatatcgctaaactcttgggtcagcccttgcctgaaggctgaaaggaattctagaccttcagattcataagccaatgaatatgctgtattctgtgtgacaattttagttatgtttttattactttcataataaagtatcttaacacatatgtgaaggcagtcattctatctatatctatctatctatctatataaaatcattaaaaacatattaagaagacatttatgcatccaacagacacatgaaaaaatgctcatcatcactggccatcagagaaatgcaaattaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagacagtgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgtagccataaaaaatgatgagttcatgtcctttgtagggacatggatgaagctggaaaccatcattcctagcaaactatcacaaggacagaaaaccaaacatcacatgttctcactcataggtgggaattgaacaatgagaacacttggacacaggaaggggtacatcacacactggggcctgctgtggggtgggggaaggggggagggatagcattaggagatatacctaatgtaaatgacgagtaaatgggtgcagcacaccaacatgccacatgtatacatatgtaacaaacatgcatgttgtgcacatgtaccctagaacttaaaggataatttaaaaaataaataaattaacataaatacataaatattgtgcaaactattggtaaatttattatgctctatagttccaaaacaatttagattcaaaatcacacaaatatgtgtgtatgtgtgtgtatatatatatatatatatacacatatcttttataattattaagttgccactctagaagtgaagaaattcatgttttatactcacacacacacgcacacacatttgtatgtatacaaattatatttcttctcttctagaatggcaacttaataattatgaaaatgttatatgcagctagtggtaatgagtgctgggtttggatttctgatctggtatatggatactaatgctttgggattctactaatgtgttagatgtaaacagatgtgagacagaagtaaagtggtaggtgggggtgatggggaataatattactgacattccacattttaaacatttccaaatcctctgttaccttgtgaggggaaatcttcattcttaatgacccaaaagttatttcagccattgattatattccaagacagaagtgcctccaccaccagtttctctagttgtggtatgaacctcaatgttcagacaaactgaataacagctgattataactgacaggctttcagagggtctggggtcaaaaataaaagcttttaaagtgacaaatacatgaaatcattaaagaagtggtacctagtagcatgattcaatttgttctaagtaaaaaaaaaaaagaaagaaagaaaaagaaaaaagaaaaaaacaaactgagtaacagaagccagaagctgtcagaggcacttgatatatttctgtgatggcatttgtaatctcaagggattgagcagggagctttatgtggaaatgtgtgtggggtgtgtgtgtcagaaagaaagggagagagggagggagaagagagagagagagaaaaaacaagagctcaagatatagacagagaagtgctaaagtgttttgctgtttgatgaagcaatttttaaaatatcacctaatttgggccttgcaacaaacctacgcagtgtgaagggcagttattattatcctcattttaaaaatgatgaaagggaggctgatgtcctcagtggctaaatgactttagtacagacaaatagctagtgaatggtggtcttgggattatatttcagatcttctgactgcaaagtccttaaaagttttacaactccttcatattataatgcaccactcataaaaaaaattaaatctaaaaagctgctaatatggtttcaaatggaatattttgtcacatcctagactgataaatccagttgtatctatctatatatagttatatatatatctcttcaaatttcctttaggaggtaagattaccatatctatctatctatctatctatctatctatatatatatatatatatacacacatacacattatatatattataaagatatatatctatatctacctatacatacactatacaaagatctctctctctatgttatgtacacacacacatacacacacacacatatacacacacacaactagatttgttagactaggacgtgacaaaataaatataacctggtaaatttattgagagagaaaagaaaaactgtcttttgtaaatgtgtaaataaatatatatatatcttaaagagatatatataaagagataaagagatataattatatatctttataaagagatatatttcttaagatatatctatattatatatagatattgtatattatgtatatattttaaagagatatataaagatatatgtgtaagtacatattaagagatatatataaagatataatatatataaaacatatatattacatctttgtttatccttttgcaaacgacggtttttttttcctctctcaataaaattatcaggttatatttattaaggtgaaaaataaatatatgaagtagtttgcctaaaaccatcttatgtgcttctgaactttctcataaaacacttaaacatttatttggacacctttaggcatctttaaagctactccaaatcttcttctaccctttcaattcccccatgaaagagaataaagccaaataattgttgtctctgtttcgctaccagtgagaagcggccctgtgatccagttctgggtcataaaatatcaatgtaaaaatttgtgcttctgagaaagtttggctttctcacagtaaagaggaaagctttcgtacagattttacttttttcttgctttaaatttgagcacaatgactagagagtcagcagtaatctctccacctaaaggaaagttgaaagcaatccgggaggcagccctgacatgtttgcactactgaaaacatactagcaactgccatcctctggatttgtcttggtgggaggtggaggcagagggaagggaggtgttgtaggttttactgtttatattcattcacatctgaaatatccaaataatgctttttttggtccccaaaactctcgaaactacttaacacatgtgctatgtcactgcttaggacagacaatattaacagcatcatcaggcattttaaatatgcaccattcttacctaagggcaaatgggcccctctcaatcaaagaatgaaaggagtccctatcatgctaacgttcttcagcacctttgcatttctgttgcatcaagtatatggcaccttataagcatcttgttgatgcagactgacttttcagactaacgctatatgctcctgctaagtgactatttgctaccatcgccacctccttttccttatttatgctcttccatctagcagcaatactttctcataattttctcctctgtagcactgcctgttgacgtctaggaatactctttacaagcttatctacagcaatatctcttatttaaagccttgcctgcattatctgtcatttaaagccttgcctggtacttgtaaccaaaattatgttcttccttttaatctccctggggaaattgttactgctcatgtggcattaatatcacacattttctcatattattacgtgcagtagacacattccttgtcatttgcaaaattatcaccctcactcccagtagaccatagagctcgttccctgagggcaggaagagtatgtgattcactttccatagtcatacagtatataccacaaaggtgataggggtgggatagctatgggtaccaaggctgaaagagtttattctctgcaaaaagttattcccttcttcatgccctcctctactgctacaaatttctcaagaatgagaataagcaaagaggaagggctatcttatggatacaattttagagagtttgagatttaagtacaaaatctaaaacagagatttccaaatcagacattttttaaaactacctctgcataatattggcgggggttggaaaattccagcacacaggccaaatccagcccagtgggctgatttgataaagttttattggaacccagccacatatttgtttctataatatctaaatctgcttttgcactataaaggaagagttgagtagatgccagagagacccatacagcctgcaaagcccaaactatttaccctcttgccctttatagaaaaactttgcaaactgttattaggaaggttataaaacaatgttagaaaaacaaatttttagcatttttcttgatggcagaacttctctaaccctttcattactattacaaattttcatatcattttcctgagctgtcaaaattatttccaccacagaaaaatttttaacggaccttatcttctcaggacaagtgatctgaggatcgcatttggcaaatgctgctttaacaaagtgcaagaaaaaacaattgttaaaatgatttgcaggtttctcttcaagtaattgcctcatctgttaatattcaaccctgtgaatgcgcttattattctagtaattttctaggacacaattaagccacatagaaaactgttgtggcccatgataaaagaaatacttaagctcccttcagataaaaagttacagcataccttgtgctataaacaagttaggtggtaattatctgagtgatgtggataattaacatcaaaacagcagcaaatgtacttgagggagaatctatgatgctggacttaaattatttaatctaatttaaatggagtcaggaataccagactttagatacattaatgtggatagatcacacagttataagttccgttagatgtagaacttcccgtatttgcttatagttcttaaattactttctttaacctcagtgttttcccttagaaactatggttggtctcatttatatcccttctaaaataactatgtttctttaacttgaataaacatagtgttgatgtaaaaaggtactaaaacaaaatgtatttttttccagaagttttagaattgtgcacaaattatttagtgatcaaattcatttaaccgaacagtagggaaactgcctttgcaaaaatggtaacagggagaaaattatgacagtgaaagagatctgacctaaccaactccatcttgcctttaacctctaaattgcccttagtcattcctgggcatgggccaagctaactttgggagacatttagtttatagtttacatgataatagtccttcccagaaactaaactgcctttgtaaaactaatgaaagtccaccaggttaggaggctgagaagcgcctgaatattgctaagactcctgtcttggggtctggattgcgacctctttctggtaatataacctcagaccagatgtcttcctattgtcaatggagaggcagcatgatgcagtagaacctactatggctgtgaagtcagacccaggtttgagtctcagtccctctgcttagtattacacaacttaggcttaaacaattaccagtcattgttctagaggttacaagagctgcaacttctctaattatttttgtaattaacatcactatttcagaacctaagatttgctttttaaggtggttctacagacttttgcatttctgacaacctgatgactccacccaggccagggactattctgtggctccaactcagaagcacactcagtccagaaggaccattttccacaccttatcaaccaatcagcaattttcctagccctctgcctgccaaactgtccttgaaaagccctagcctccacattttgtgggaggctgatctgagtagtaataaaactttagtctctcgtttagccagctctacatgtattaaactctctctattgtaactcccctatcttgataaatcagctatatctgggcaagatgaacccattgggtggttagataggtccacaaggaattataactatgctgatgcatgtatactccaaagagactacttagaactatctcacaaagttatattcaatatataaagacccacagcctcagatttatacatcatgaaaacttattgattttatcagaggcattcgaaccaaagagactccgttatgaagaggggctgggaaaaataaggctaagacctattgggctgcatacccaggagattagaccttctcagtcacaggatgagaaaggatgttagctcaaactacaggtcacaaaaacccagctgttaaaacagattacggtaaagaagctgccaaacaaaatctgcccaaaccaagatggtgaagaaagtcacctctggtcatcctcagtagtcattattcactaattataatgcattagcatgctaaaagacactcccaccagagccatgacagcttacaaatgccatggcaacatttggaagttgccctatatggtctaaaacggcagggaggaaccctcagttccaggaattgcccgcccctttcctggaacactcatgagtaatctaccccttgtttagcgcatgatcaagaaataactgttaagtatactcagttaagcagctcatgccactgctctgcctatggagtagcaattctttattcctttactttcttaataaatcaattcttgtacaagggtcaagaaccttctcttggggtctggattgggacccctttccggttacataaccccagaccagaggccttcctgttgtcaacggtgaggccacacgatgcagtagagcctactatggctgcggagtcagacccaagtttgagtctcagtctctgtttcgtattacacaacttaagcctttacatgagaaaaaatatctgacaaataaagttggagtacttgagtacagatactaaaggaactttatctcgtattttctcagtcagtggtataactgggtttcacctattcaacataaaatgtatttttttttttaaatattctttttggtcaatgttttgtttccttgacctgttaagacaactgagaacatcattaataatacctatcaatgtaaaatgttgttttgaataatttatctgttaaatatatttatttaatataattataataagaattttaaagatatataagatatacaaaatgctgtaagaaaaataattaagtaatacaattggagtaaaaaagtaacatcttaggttaagtaattgaaataagtattgaggatatttctgcaaaattaccaaagttgttcataattttcataattcatgctcttgttgatttattacataacaacagtattttaattgtccaaggagagaaacagattttctttgtactaatgtcaggacaaaaatagaaatcacaaaatctcaaaaaggaaaaactaaagatgtcttatgtttttcatgactaccattttacacctctgatgaaactgaatcaaaatggcctcatcattattagtcatcatttgtacacactcttactacgcaagcggattgaaaaggtgtacgtgtagagtacttaccctaatccttcaaggaatttcttacacagaagggtagagaattgagaactgttacatattagagtgtttgtattggaaattttgatactggtctataattatctatttatctatccgtcatctatccatttgtgcatatgaaaacatatgaacctatatggtattaataattattaaataataagctgtttgtgctacatttttatttgaatgtcctgaaagaaagtttatcataaactcacctgaactctaaatagcaagaatcttggggacatgaaaattttgtcttttcaagtattcgtttcatgattttgtatactcaacaaacgatgaaattataactttaaaacaatttcatgtgatttttttgcatgaaaaaattatatctgaaatatattgttacataggaaattaaatatgcatatatgaggaataaaattatggttgaaaaatataaagcctaaggctcagcctcaaatctgtttaagtgtactgacacagaaatgtcttaggtacgcagagaaggacctatagcacttttaaaacttgagcatattatttaaaatataatttattattactaaaagagaatgttatttcaaatctttatttttataaaaactccacaaatccccctgcaaaacagcattttatacattaaaaagtataaaatggtaaaattatttttatttttagtattttaacatattcagtagcaaatagtagtaaatgcctactttgccacagctttatgataaatgctattcatatactcgtggatgaaagagagttttttcattttttctggagccaggagcaagagataaattaagcaagtatgataagcagtcatgtgtttatatacacataacatatatgtgtatcataaattgcaaattacagttatatatttcttctttaataatatttgatttccttaaacatgttccagttctgagtttttatttataaattttattcattactaccttgatttcatagacattattctatttctgtacctttttccataaatttctatttcggattctatttcaatggatttaaaacattataataccactaaaatacaattctcctaactttcactgaagctattgttacccaaattttattttaatttctattttgttgctccaatgttataaaagctatttcttctgtaattgaagcacaagcctcacttcagaaacacataaaagaaaattgattttcatcctgaaaatgtcaaacttctgcctataatactcagctatggttttctgaaacaacaaagttcaaaaagagccatcgacctgatggccctttgacacacaatgatggatgcaatgtgtctactactttactgccagaatgttctctccaagagaatgaaacaatcaatgaagaataataaatctaaactgggtagaaggtttgcttgttttaaatgtactaaaagagaaacaacaggtatttcacttctctagggaaagacatttatttactacttgattaactattttctctccgtctagcttatgtgaatccaacataacatatatctgcttaaagacattgagcaatgcctggaaatttaattccatacacagttcttgaacttactgtgaaatatagatgtaatgtattgttattcttcaaaggagaaggaaaaaattataaaggaggataccactttactcaccctagtgtcgtgtccttttgtcaacctctaggtctgtcaacttcaactgtttctagggaatgatgtttccattttcctgtagaatagagttattgatcaataccacatcaaaatcaaagtcgttactctagtgcaaaacataggagcaattcattttcttacagattatgattatattaagatttcttgtgcttaaaataaattcttgcaaattatcaaaagtaaatgagtaaaagattgcaagaatcttaaatataagtttggaagtggaagacttaagtctaatttaaaacttaactcttagaatgcatatctatgcctcaggttatattctttacccaggaaatgaaaaaccacttccacctgcatatttggtatgaccagagtctgccatttcaccagtcttaacaacgaagcactgcataaattctccttaaatgacacttcaaatatatgatgttttatgatatggtgtacatattcaagacaattaaggacaattatatagattgaaagttacttttgattccttagcatttttattttattttgttttgagacagggtcttgccctgttgcccagattggagtgcagtggcacaatcacagctcactgcagcctcaaccacctgggctcaagctattctcccacctcagcctcccgagtagctggaactacagatatgtgccaccatactcaggtcatttttatattttttgtacagtttcgtagttttgccatgttgcccaggcttgtctcaaacttctgggctcaagtgattctcccaccttggcctccaaaggtgctgggcttacaggtgtgagtcacccagcaatacagcacttttggatttcaaaattttatactataccattattattttataccaataattttattattgccacaggggcacagcttttgtatttatgctttgtcaaagtagaaataaattaattttatgatgatgtaatataaaattgaagttataaaagttgttaagaaattttaacattggtatctttctactgtgttttgatttcaaagttagagaacatgtctcaattattcacatctctcatgcacatgtcaagaaataggtacagaaatagatggaaatagctatattttgtttcaaacacacaaacatgtagaatataaaattgacagatgcatttaatttatggaaaacaaaacaatgatttatttcttacaaccaaagtttggttgtgatctgctgaataagtggaaataattagaaagaattgttattttacaatggttctaaggtgaactacattaaataacatcctgaaaaaggagatgaatatttataaaaatctagcgcatataaattaaaattttaaaatactttcttttcatagatatataaagatctctacataaaataaaaattaagaaatgcatacaagtcaatttttataatactttggggattaatgtatatctatcttaaaggagaaaataaatagtactatattcaaaatataaaaacaataagcagtgtattcagcactttttcacaataaaatttaagcttaatagcaatatgtaaaacatagcagcaaatcctttccagacaaattatggatgaggtgtgatgggatcttctaaatatttgccaccaccacccctatccccgaccccaagcccagtgtggccccttggtagcatatgagacaattttatacaactccaagtttccatagaacaaatttggaaaactcttgatataaatcatttttaacattctttaataatgaaagctataaaatggatattgcaaagacttaagtaaaattttctcaatttgtttaatcaacaataaccacaataggaggaaagtttatgcagtgacctcctgactggacattagctctgagtgtagcatcaaacaccagaaatagctagatattcccctaggggttctgtacatttgtgaacagtgctgaaccttcaattagcctcattctaaggaaggcattttgcactgtgctttgtgtcgatttagtaatacagtgggtggcttatgatttctgagtcatcattacacatttcataaaatatagcagaaattgtagatttaaaaattaacacttaaagcatttaatgccttcaggtcaggggataaaagatgaatgaaagattatcttttatgtgtacagtatatgtaattatgattatataagaattaatttcatgtgattgtgcacgcattttatcaatatagttccaaagaccaaattattacttaaatgctgacttttaaaacatttctgatactctagatttggggagttataaattagatcttaaatagagagtgtaggatttcaattaaacaaataatttatgtttataaagattggaaaataggataaaagtcatatcttagagtgagtaccaactctctgtggtatttcacttattgtgaatcttaatttttaaaaacttgtttttctagattgatatttcaacagtaccgttctggagttctacctaataccgaaaataaacatttttaaccgctcttaactacttcaatattagctagaataaataagaaaagaagagattctattaatttaaagcatacaatttcccacggattgctttggaaatgtgtggtataatgaacctaaactagtattaaaatgtagtcattgcacagtgtatatatatttgaaaacgtcgtgttgcacacagtaaacacaattttatctgtcaattaaaaaatcaattgctaagaaatacattgtttcctttaaaaaatgtgttattcatgattaatctctatgttgtagtaatacagtatttaaccaacaagattcattatttaactacatttcaaccctttaaaggtgtcactaaatgtgcaacagcagaaaggtttatactgtgatctaattgaacaccattccaccttcaaccaaacctgaataatcaattaaaatttattaacataaaagcaggttttataaaaggcagtttcagtcttcataaccactatccacaaaagggcaatactttgatttgtgaagccataattaaacactagagaactacaaattgatacaaatatgaaactacgtcatatgttgctatgtaagtacaagggtggttgtaggcatttatattactaactgccaattatcagaggtaattacaataaacaaaaaacaaatatgcacctaggtgtgaagtggaaatagcaaacattagtataattaattgaattttgaaaatccttaaggataccaaaattaatgtgatttaaataataagaagatttacctttctacataaataatgttattaaccattagtagacataaaattctatgagtcaaattccatagactgttacttaaatttactgatagaataaaggaaggaaggaaggaaggaaggaaaggaggaggaaggacattaagtaggcagtgagggaaggagtagaagagaacttgatgctttacaatgctacagattttttaatttgaacctacttgaattttgaatgttttattgttgttgatgtgggttttgttttatttgttttgctttttggtacagtgtctcactcactctgtgacccaggctgaagtacagtggcatcattatggctcactacaggcttgacctcctgggctcaagcaatcctcctgcctcagccccccaggtagctgagaatacagatgtatgccaccatattggctatttaaaaaaaaaaattgcagagacaagtcttgatatgttggccagttctgtttcaaactccttggctcaagtgatcctcttggctaagcctcccaaagtgctatgattacaggaatgagccaccgtgccagccttaaaggtgtcttaaagctggagagatgataataccactaccacccccttttccgaatgaaggaaaagagaaaaatgtgctaagaaattttttaaaatgtgattcctagtagcaggtatatgtacagggcacactggtagaaagcataattgatggccgagtgcagtggcttacacctgtaattccagcactttgggaggctgaggtgggtggatcacgaggtcaggagttcgagactagcctgaccaacatggtgaaaccccgtctccactaaaaatacaaaaattagctgggcgtggtggcatgcgcctgtaatctcagctacacaggaggctgaggcaggagaattccttgaacctgggaggcggaggttgcagtgagccaagatcgcaccattgcactccagcctgggcgacacagggagactccatctcaaaaaaaagaaaaaaagaaaaagaaaaagaaagcgtaattgatttttctcttagtatattttcttttttggattccaggatacctcacttcctgatgtatctcctacatttctggttccttttttgctggtcctttctcatttctccatctctcaataatagaatgccctagggcactgaccttaactttcttctcatttctacatataataatattctagctgtttttattcaacctatggaattaaacatcatctaaatctcaaaaacaccaaaattagcatgtcagtctactaccctccagctttttccttcacatctaatttaaggtctgtagtcatgtcaaaattaatatggccaatgccaagctactgattcttacagctcttctactctgtataaatagcaattctattatttcaccagcttaggcctaaatgatgcattcatacacatgaagcctcaaagttaaaattcactatttcttgaatctttttcatccaacatttctatgttcatgatatagtcccaaagtcctaatgactcataaattgtgttattattcttttcatccttctagtaacttcattcagcttaatgaaatccccacttattttaggccacgataatataaggcagtggaggggattaaaattaaaaaaacaacgacataaaagaaaaatggaaagaaatttaagataataaggagggggccatcctactctgctatttggcatttgaccaagttctttgcctaattacactttaattttcatatttatatagtaagtattttggtatgatttctaatatgtctttcagatctgtgattcaagactacacaattttatgtcagaagttgatactgacttcaagaattaatattagtcatttggtagtagattgttacattaataaggatttgattagtgatctagaaaaaaaatgctatgttcaagatgttgaatggctaaatagtagtgatgtacgccaaacaatgttcacatcagcagtatatttaaccagaaaagaaaaaaaaaatcaatgccaacaagcttttattaaaaatgccttcttcaaaccaataaataatttcagaaatatgttggatattacatttcaaaacttttagaaacaataacataaactcttcctggttgctgtggaatggattttatgaccacttatctttatgtaaatctagagattttttcaaaagattaaagtattgtgcttgcttttctcaacaccataaataatataaaatataaattgtcaagagaataaatttatatttcataaaaatgtcagtattaatagggaaccttgactgacaaaaatgaacacctaaacagaaaaagaaactcttactcactataattatttattggcattatttcttaaacgtaagtactcctctaattaaaatattgcagcttttttttcaagataaaagtacaaaagtgtacaaataaaggcatgacctttgatttttgaattttttttctgagtaaaagatagggcataatatcctagaaacagctaagagaacagtgttttgttcaaaactaaagtgattaataaatgacttttgagaaagcttactattttgcataacaagatgtgcaatgaatggccacttcagagcatttggatattataaatcattataacaccattttgaaatttaaaaggccttctaatactcagcatgctacaataactccatgaaattatttttggcatacttcaagagtatgtatttagtcattacattttcctgctgagagagttcacacagaacacactattctttaaattatgttttatagaatatttatggtatcattaggatgtaacaaaaaaactaaaaagtgcccaaaggagagatggggcctatgtatgttaaaacaaggacaaaatttaaatatatatatatctattacatatgtatttcttttagattgtctctgcttgagaaagctgttattagaaaaagggcaccatctttgagagttgcaagcacttttagaagttctaaaagccttttaaatgcaaaggtctacaaaaaaggtttgttttatgcaaatttaagcaagtcagctgaatcatattgcaaagatgaatggctgcttattttgattcagattttaggtcattctttcacatacaaatggccatataactgtatttgactaatgctggggacatgtatcaattctgcaaaaaattgattttgctttgtaattggcaattaaaaaaaacactttagaattccttgccacttttttttttaacctccaggtaacatactgaatctttacatttaaattggcaaaggtccaataaggacttagagaactattttaagtcatagggaggggaagtgacaaaataggaatcctttgattctatattagaaagattatgtgtgtgtgtgtgtgtgtgtgtgtgtgtgtgtgtgtatgtgtatgtagaaggatgggggttaggaagactgtgcttataaacatcttctttaagatatgtaaaaatttatatgcccattcattgttttgcaaccttccctgatttccctaatctcatagaaaatcatagttaatttcataggtaaaaattaatatgacatcgtttaatttgtagtttttacatacatgtgtggttgaaagctttaatgcatttgcttttcttaaaattatcaactttctcaatttatccgtttaaaaaaactattgtataactttttagcatataaaaagttattagagatatttattgagccagtattcatgttgtttacatttttgctagattccttttcttagtttgtagtatgatttcattctgcagcatttgacataaatgtgaaatgtttatatgttaaaaatgtatcatttttcctttgcgttttttcttcccttaaactgaaactttactccttagtacagattttttgatgtttcattcatctatctattttcatattagaaaatttataccaatacatttaatgtatatgaaattgattttgatgtaaggtaagtgtttatgggtccaaatatgaattactgcatttcaaagctttattatttcacactttatggtacattttgctgatccatcatggaaacaaaaatattcaattttatagacaaaagtagatctttgctataaaagtagaattatattctcaaatccttgataatagaatactgttgtataactattcttcattaccatgacatgaaatcgattttaaattgataaatgcttacttttcttttttggaaggcatcttttagtttggaatttagatgtgaaaactactaccaattgaatactgatgctagcaacaggagacaggcaaattcctaggcagaaaggactcagggtccccactgaaacccgatcttgaaggcaaggacaatttaaagcctgaaaaccaggctgccagttctgaagaatccacgaccagagtgagaacttctatcctcatcttacccactctctctagatttgcttataattcagcttggccgaattataaactgcaggacagagaagcttggcctccagaggaaagtattttcacactgtcctgcagctggaccttttctgtaaatgagatggccaaagtgtccaaggtcgcatatgtgcaggctttctttgccttgcatgatattccaaagctttgccaacattgtagaattgatctagccctcctagtggtcatctcaggagaggctgcaaacggcaatctcaagggacaagggaagcaaattccagagctgcctccagcaggcgagtccagtttctctggtcctgttcctcctgatccatcctgtcctccctatccatgttctttcttaacttgtcccatcctagaaatcctcattttaagtgggtcccagcctcactcatgcccctataagagatgccttgtgaatatggccctattaaggtttaggtccccttttctctacaagacttaagacaaattaagggggatcatgttaagttttcagactaccctggcaggtatatagcagctttccagaatttaacccaagcatttgaaatctcctggaaggatgttatgttacttttgactaccactgagaagcaggccgacttacaaacagcagagaagtttggggatgagcttagttttccatatagtgccaagaaaggggaagaaccttatccaattggaaaaacagcagtaccattggaggaccctaaatgggaccccaaagaagacacaggagaatgaagaaggaagcactttcagatgtgcatagcggagggcttatgaaggactaacactaagcctctcagttactccaaactatccatgatagactagggatcagatgaaaattccactgccatcctggaaaggctaagagagtccttggtaaagcatgccactctacctcctgattcaatcaaggtacaactaatcctaaaggataagtttattattcaggcagaacctgatattaggaggaagctacagaaacaggctatgggaccagatagtactttagaggtgggtgaatcacaaggtcaggagtttgagaccagcctgaccaacatgctgaaactccgtctctactaaaaacacaaaaatttcccgggcatggtggtgtgtgcctataatcccaggtacttggggggtggctggcgcaagagaatcactttaacccgggaggcagaggttgcagtgagccaagattgcgccactgcactccagcctgggcaacagagagactctgtctcaaaaaaaaaaaaaaagaaaaagaaaaaaaaagaaaagaaaaaagaaaaagaaaagaaaagaaaacctcctgaaaatagccacctcagtcttttataatagggctcaggaggacactcaagaaagaggagagagaaaaaggcagaggttctagtggctacattgtaggtttgcaaaccccagaatccctgagatgtacctcttaactgctatacgtgtggcagccagggcactataagaaggactgtgcaggaaacatggggaagccaccttaaccctctccagtctgcagtggggaccactgtagggtggactgtcccgggagatgcaggttaccgggtacagatagtctcccaaatagtcaagcaggactgatgggtccaagggctcctctctccagctccgacgactcagaccaccattaccatccaggagcccagggtgattctagaggttgaagggaggaagataacttcctcctggatataggagtggccatttctgttctcctctccaatccaggcttcttctcctccctcagtacgaccatgaggggtgtctcaggacgatacttttcccaacccattagttgtagttgggaaaacctcttgtttactcctgccttttaaatcatgcctgaaaacttaactcctcagctaggcagggatattttagctcctatgggaaccaccatccttatggttccagggtatactctttgtcttccccctggtggagactgatattaactcaaaagtttgggcaactcaagggaaaattggctgggccacaactgccatacctgtccagatccattgtaaagatccaaccttttttcctaaccagagacaagatcccaaaaaccagaagccaggaaaaagctagaatcaatcaatgataacttgatgttccagggcatcttcaaaccctgcaacaacccttgtaatgccctgatattgagggtacagaaacccaataagaaatggagacgttccaggatcactacctcattaatgacgttgtggttctaattcatcttgtggttcccaatccctatatcctgctaactcaagtacctgaggatactaaattgttcacagtcctggacctaaaggatgcttttttcctgcataccactacaccctgacttccaatatttctttgcattcgaggatccttgcaaccagactacccagctaacttggatggtattaccacagagattctgagacaggccctacctgtttgggcaggcattgtcaagggatctctctttatccacaatttaaagttttataatatgtagatgacattctccattgtgccccaactgaggaaatctctcaggaggggtataaggctcttcttaattttctagctgacagaagatgtaagatctcaaaatttaaggctcggctctatcagacttcagtgaagtacttaggtttagtcttgtcagagggaaccagggcattaggcaaagaaaagattaagctcatctcctccttttccctcccctaaatcttcaagcaactgaggggattcatgggcattagagtattctccagattatggatacctgggtatgatgagatagctcatccctttatcacctaaaaaaggaagctcagacagctaatttgggaaccagaggctaaaagggtctttgaccaattgaaacaagccttgtctgaggcatcagccgttagtcttcccattgggaagccgttcaatccttatggatcagaaaggaagagaatggccctgggagttctaacccaggtccaagatccagtccagcagcctgtaggctatctaagcaaggagcttgatttggtggctaaaggatggccggcctgcctctgggcagttgcagtggtaactttgctggtgccagaggctactaagttaacgatggggaataacttaactgtttataccctacataatgtggcaggactgctgtcttccatgaggagtctccagctaacatacaaccatctcctcaaatatcaagctctgctattggagggatctacagtccagttaagaaggtgtcactgtcaaaactcagccaccttccttccagaaaaagctggggaacctgaacatgactgcaaacagatagtagtacaaatctatgcagccagagagaacctcaaagaaactaccttggagaacccagattggactctttttacagacggattttttttatagaacaagagatccataaagcagggtatgcagtagtcaccctgaatgacactattgagagcacacctctttcttcgagcacaagtgctcaactagttcagctaattgtcctcataaaaatgtttgaattaagcaaagggaaagcagtttacaattatactgattctaagtatgttttcctaatcctccatgcccatgccaatatctggaaagagagagacttcctcatagctaattggtctccctttaaacaccatcaggaaattaacagactattattctaggttttccttccattggcagtggcattgatacattgtgaaggccaccaaaaatgggtggatgaaacagccaagggaaatacattggcagaccaagcagctaaattggcagtgagagttccacagatatctgatccacttgaggcctctaatctgggagggctgcataagagaaataaaacttcaatattcttctgaggaaatagaatgggccacctcttgggaatacacctttcagccctcaggatgactacaatcagagtatggcaaacttcatccagcagctttcagccaatggaaagttcttcaaatccttcaccaagccttccacctaggaaaggattaaacctatcaattagcccagtggttgttctcaggtctgggttgggagggaccttacagtgtacttctttctacttcttcagcagtgaagatcactggaatagattcttggatatattatactagagtaaaggcctggggaacttatggaattatctctgttgacccagagagcactcaaagcaccaatgtaaagaaattggaaacctgaagctaaagatcataagtgtcagtaattcacctttcatggatatcctttatagtcctgcctatgattgctgttctcaccttcattctgttcctcaccattaggtgtctttgccaaggacccctaatcctgaatgcccatgggattatctactcccctaaacagaaatctcttttctaaaatttaactgccctcccccaaattagatttaatttctttcacaagggtgaaactgctctggccacaacattgttttcagaatgattagtctattttacttcttatttctgttatctctggcacaagattattcccttttagctcctttttgtataatactcatatatggttcatgcatacttaacctccttgtaaaatttgtttctttttggctaaaggccatcaaactccaaatgatcatgtaaatggagcctcagatgatggctccctttttactggggacccttagataggcctctgagagatatctgacagctgttttcccaaaacaattccccccgtcggcaggaagcagttagagcagtcattgtccctatcctaatggaagttagatgcacctcttcagaggggggattgatagtgaaaggatacagacgaattcctaggcagacagggtccctccctaggacaggtctcaaccttcaagccaggatagtttgaagcctgaaaactgagatgccagttctggatagagtccatgaccagagtgagaatttctgtccccggtttacccactctccctcaatttgttccttctcgatgataccttttaaccaaactttttccaagcctgctcatggacaattcagcacacactcccccccattctaagcccatagaaacctggactcagccacaaagttagcttacccacttacaggtcccctcagatgctgagagcttagtttctgtcgctcaatacaattctactctgccttactcactctctgatttccacgtaccctattcctcttggttgtgggacaagaacctagaatttgctgaactgcaggagtgaaaggggtgtattgtttctgcttgctgatctgcaggtggcaggagtaaaagagctgtaacactctctcccacttgctgaacaatgggagagaagtggcaactgggtgacactccctcctgcttgctgaactacgggagtgaaaaacctgcaacagtagcagtaagaatctctcagaaattcaaaactgtgcatagatgtgcctaagatacaaagaataataaacacatttctattctaagggagtttttaaatctaggagataagttggctcttgttcacatatacctacaattcaagcagaatgggaaaactcaccagaacattctggaaagctgagaagattcagggaaggaactggtcaggaagaagtcacaaaatggctttaaagaactctgagaagttggagagggatttggcagatggtgaaacccacaagagaagtacaaagtaaagagagagaaaatcagaatcatgaagtatcaaaagccaggaaaatctgataatttgtaaataatgtaggctggctccagttgtacaattgtagaaagtttggggaacaggtcacaaaatgacttcttacaatacctaaagaccctggattctatacctttgagatggaaagttttaattttattgcttctaataagagaccgtctcaccagtatgtgctttagataagttaaggtagaagcaaatttattgtaaaaggggaaatagttaagaagctattgtattaattcactcatctattcacttgtccatctattcaacagtgatttatgaaatgcctgctatgaatcaggcattgtcctgagttatgcaccacagaaaggcatagagtgcaataactcaggtaagattaaggtcataaattagatgagaatatgtctttctaatatgacaaaaacacagaaactataaaatgatagattgtaaatttgtttgcatatttatacatttgccttcatggcaaaaatatcatgaaattaaatcaaatgtaattttggggaaaacaaaactcacatttcagttgcagatgcctgtctccaacacttccagctacctttctaaaagtgtttgttttgagttaacacttatatggcactctttctgttctatgtttgttttattttagcccagttggaataaaaataccttggctgtcatgttcctagagggggaaaactcagagaaaaaaaacatatttttttaatactaaaagatatggctttgaacagattattccaggggctatgacagacacctagatgattaggaattgggacttactttagatagtgtggaaaagaagagtagttctggcaaagtgatatttaaaatgaggcctaaaatatgtgaagagaatagaagtctgagggaaaaatcatttcaggtggcaagaataaagcaagtaaaagccatgctgtgaaaatgaacaaatacagtctgacattctgtgatttataattctttaggctttgggctttggccagcatattataattattgttttgccttttttaagtgaaaaatttttaagtattgggttaaccatactcttttgcttatgaccattaaacaaatgggttaccaaagtaatgagctctactaaaattatgtattgaatttgaactcttctgttaaaatatactaattaatgtttctttctattgtgatgatacattgggtctaagttttcccattaggataaaattggcaccttgatccacaattatgccaggtagtacatcatcttcatttaagtagatatttaaaggatcttcatcactcatctgtttcattgttagtttttaaggactattttaaatttattgacgataattttctaagagtgtcaacatttttaaagatcttgaactgtttaaaaaagaaggctaacattggaggaccctacaccaattcaaaatcattttgtgtataaatgcatatattatgtgcacttctatattaaactaaaaagaggcctaatgagatgtagattaaaactgattttctgatttttaaaagctgaatattcctttaaagccttgttcttgtgaactaaaataatttttaatacagaggtatttaagtaggattttataaatttaaaatgttagatgtctcagaagaaaatttggggaatactgttttattaatgttatcgacctatccccaacactttactagacttaaatctctataatctaattttctgtatcaagattgtccttcttcagaagttttggtgattgaggagaagatccagggtttcaacatgatgaaccgtgtcttgttctcagcaaacataataaaagagaacttagtattatataatagaatctgggagaaaacaagattcttggcattctgaggttttctagcatgaggatacttattttacatgcaggcttcagggaggtatattggaaagttagtaactgtgccatgttattttctctttagatatttggaaacaaaaccaaaaggacaccagtaacaagtgaataaaaataactacaaaaaattacacctgacttcaaagtataaaattactcttctatcctacttttctgtatctaccattaatacacagactttctcttaccacctaaacaaacacatatgtacatgcacacacacacttgcacttgctcatgaatacaacatatcatagtggttaataacacaaactctaaaatcattccacctggaattaagtcttggctttgtcactgatcgctgtcaacttggacaggttactttacctatcagtccttactttcctcatccataagcagatctataaagcatattctagcctatgttgttagattaaatgaattggtatatgcaaattacctagaccagtgactatcaaacagtaagtaatacataagtacagatggtatgtatgatgtaagtgttaaatgacatcattagcatgattaccgttttaatgcatagcagcacaaagtctatggaaagaaaacaggaggaaaactgtgggatttcattgggaggaaagaaatgatgtacttttagttccgagaaatgacttgtgttcagtcaagttaggaaatcatttagcaagaccttgtgacaaagcaggcaagaaagtgagaaagaaactgaaggatatttaaatttttgtgattttaaaagcaaagtgagccaatggtctgtatccaatccaggtgggcagaaactgtgcagcccagatagaaacatgtagcactacccttggtcactctaaatatggactccttccttatggcttcacatctatattctcatctgatgcccaaatccattatgagatatagatatggtatatatttatattattgtacagaggaagcagttgattttgaaaaagttgttacttatctaatgtcaaaatctattcagttttagaaatagaatttgaagctacttctcagtttcatatattttgcattataccatttgtccttatgaatgtctcattttagaaatattgtcaagtgttttaagggatagtaatatcaccatcattaagaatatgtcctgatataaaaacatagtagcaatttccacatcttgatacatattgtaaattatcattgatgaaataaaaaatctgagataagtttcagaactattcctgaaacatgtacacaatgtggcttttaagaaaagcgctctatacacccaataaattaacccaaaataagctggttttcatggtgcacacctgtaatcttagctatacaggaggattgcttgagcccaggagttcaagactagcctgggaaacactgtgagaccctgtctcaaaataacataaaatgaaataaccaaaaacaagaaaaaaattaaactcaaaaactaaaactgcttacattgttttttcagaggaaaggcgggggtaacaacattaaaacctattttttttttctaattgaaaaagaatggtttatgctatcagatgaatgcctccagcagaatgtaatttggttaagacattattggtaatgctgtatgtgggatgaccacacgttttgtttgtcctggacagtactagtttatccctatttgccttgcatcacttctgttagcctttgtctcagatttttcaattaaaaattattattaataattacatttaaaaaggttagagttattttggcaatcctcactttgtacttctagctgtgaaaatataaatggattgagaacagcatccatactttaacacacggtcaagtaagctatcaggtttacctctctttttctgatgctttccaggagccgtataactcttggtaatattttacagacagtgtatgtgaccctgcatggtaaaaggcagtggtgggagaagtattcagagctggtaactaaggtctcaacttggccctccagctagatgtggttttatgcatcctcagcttgtgaaatgctgaaaaccacaaagcactggtggtagctggtgaggctggtggaacaatgagacaattatagttttggtgcatgtgaaataactacaggaaatatggactcatccgtactgccatagagaatatagagagtggtgtgaggactcactacaaaggacttgtcatttattgtttggtgaaaatctatactgttcaattatttactattttagtgcttatttatttttaagccataaactccatctgcaacaataaacagtctcactccccaaaaatgcatttataatacaaattaagaaataaatttccatttctcaagaaagttgatgaataatatgttacttgtacacaatgtctgttgacatttacgatacttatcactcacacagaaagtggaagaaaaagacaaaattgctcaagaagcaataccatcaattttacaaataagtagctatattaagacagtgctctaaaataaagatttaacacatacagctgtagagggtatattttcatagcatttgggaagcatgatattttatttaaatcaaatgacttttcctcaaaattaaacttgatcttttttattctaagatttatgacacatgcacacaaagttaaaccacggatatcagttccattaatatataagaatttcaaaattgtcaaatattgccacatttatcaaataatgccaaatagaaaatgagttaaactaattttaataatggattgattatttcatggaattcagaaatcaaagtaaacattttagaagttccttcagttggatgtgaaaattctaccattattaagaattccaatagaaagtcagttaagtaatccattatttaaggtaaaataacttgcttttgtggcaataatattaaaaacatttttgaagcacagagtcatagtgaaaacaatgtttaaccacattaagaaaccaataaactgaaattgtatttggaatttaatagaaactgttttgtaaacctaaaatatatttctatacccagagatataggacaccaaagatttgagacaaaacaaatgtttaggtggtatacactttgtctgtttgtagctcattatctataagatgttagaaatatttgaggctttaatgacctagtttgtaaatgatgttgcatgtcttaaaatgttattgaaactttctataaactaggcctcttaaatttgcttaaattttgtattaaaaatcagctcagaatctttattaaaagactttgatgagtgcaacatcaaataagtaatcttttgaagcttctagtaagttttagttatcaagaataaagattgctaggaggaagagaaatatcagtatatctctacaaaaatatgaggagttgagcaagttaaaaataaaaagtcagtgagtaagattttattttcaaattatataaattttctttagaatattatgtggaaagaatcatttgacagggcttctatttttatttggatacagtgttttgttttctatgcatgaacagaacaccttgacaggttttctcagttttgcagcctcgaaggttgacaaaacattcaaaacaatcacaaacgaaggtaatatatattgagttttgttatatgaaaatatttgtcataaagaggccctctgcatggaggaaaagaacagtacctgtaaaactgtttggattgaaatatttatacatttgaatatttacatatttcaatacaaaaatagaaatagttacgcatttcaatatgaaaaaaataatactgtttatcctctatgtattagtatttgtttgggacttggaaattatcaaaaggattttctccttcagaaacaaatgatctacagagaaaagtcatcaaggatgtcaacaatttcatttttattaatcataaaacaaatgttagaagactgaagcctatttgagtaaataaattaaaatttataagactatattgaaaaaatacattatttgactaaatataatgcaaatgattttagtcatacagataaataaagaatggattaaagtacataaaaatgtactggctaattattaattattccactctatgttttttatttttagatgaacaatatttaaaaaaaaactttttgctttatgtacgggacatttttctttgtattttttaaaaaaccaattgaactgtttaaaacagcctaaaagaagatttcaacatctgccactataataaaatcaaatataattaataaatacatatatatacaataattttaatagtttgcctactgtctttcattcatagacgtatcctggtttggacaaactattaggtgtttgctttaactttaaattagtcaatcagttggcagaatagacaactaatatgagactaccaaaagtgtagtctgctttcacagctgctagtaaacattttcctaaaaatttttatttagaaaaaacttacatttttaaaaaatctataaattttagatttgtgccatgcacaaccatgtacatttacatagaactaccagtctttaacagtttaccacatactctcctctgtgtgtgtgtgtgtgtatttttttttcctgaaaaatttgctagtaagttgctgatattgtagcacttcaataaattagactcatcagatactgttttatgcttcagtacttagttggtaaaatttaaattcaccaagcttatattttggtatagagttatgaaagtcattctttatatcagtatagtgtgggaagaaaatgaaaataaaaattctcagcgttgaatgaataaataacataatcattttaagcattacaacaattaatgaataaatgcacttattttttctatatttaatcaatatttattgagaacctattatacctattcctcttttataacaaatattgaacaagatagtcaatgttcatatacacagagtactttcagtctagtggagtgtgaacagacaaagaggagataagttcatactcacgtaatatttcattaagagctttaaaaatccttttgataatttccaagtcccaaacaaatactattacatagaggataaactcagtattaattttttcatattgaaatgcataactatctctatttttgtattgaaatatgtaaatattcaaatagacaactgaaagtgttatttcaggtagcatacatgagacagagctctcttaggagttgtattcgaatgtaaactttaaaaaggtgaaagtgtgtgtcttgtgaatatgtggtgatagaatgttaggatcagaaggaccatcgtgtgtgaaagccatgttgaaaagaggagagggccaatacaactttagggctgataatatagggacatcacctagaagatgacatgagagccactgtcaggtatagaccgggtcacataagggttttgaccatggcccaatcttagatttatgattcagcaaattacagctctgaggccaaagctggctcatgggctggtttaagtgacctatgagccaatattttattttttagatttttaaatgttcattaataaacatcaacaacaaagaaaaagaacatgtaacagagagaggctgtatgtgagccacaaagcttaaaatatttactttctggtcttcagaggagaaaaaaatatggtaattccagatggaaagtcatcacaatttgagagctggagagtcacataatatgtattatattttataatgactactttaatattagtgttgaaaatattctgcaggcagtcaagagcagaagcagaatgatccgttaggacgctatggcaatggtccaggcagtaggtgggaatggctaggtctagggtggtagttttggaggagctgaaaatttacaggacttgggctataactagaaggtaaaatcaatagaatttgctaatttggtgaatgaagataagcaaacagtttaaaacatgtgcaactgctcactgtgtggtgtttttctaggaagtgacaacccagagtgtgcacattttatatcgtgtttatgttacagataatttatttatttcttctagaattaaactccttttaccaattctatataattttctcacgctttctatttttttttaagacaataatctgtgatggcaaatgaatgctaacaaaagtaatagttaaaagagtcactctatttcttaaatatcattattttatatatttccattttgatcatcagttactttttctggcatcaaatttcaaaataacagcttaggagtggcagatgtattttgttaaagacagaaagtaatgccgtcatattcactttaaatatgttttgtcatttaacagaccctcactctttctctactggagttaagaaactatttttgttaatttgcttaagtaacctataagtgtttttccattttgcacagctcatctaaaatgatcatttttccagttattttagttgccataagacaatttccaaacttttacagtatcctttttttaaaaaaaataaagttatggtcctttaaattctcactttcttaaaaatctcaatagcctttgctattttatcttatttttacatacatgtgtatatatacatatatgtaaactaatttcttattatttcaatgtaaatatttccccagaattgttgtaccacattacattcaactatttgcttcctgaagaacttttaatttggcccaaatttctaaaattttagaaacagttacatggaacttatcagggatatttcatcaaaatcaacaattaaaaaaataaaaaagagaaaaataattattcatatcagatgagcttttcatattattgctgagtgtaggttacctttgtagtagtaaactgatcatcaaaaaattacctttaaaaatgattttactgttctgatactctttcctactgtgtttcatggctacacaaggagcatggatgagcaacaagggcgctccaattctgttcctctcaagaagggttacatattttgactgaattagctagttagttgtaaaaaacgattttactattgccttccaaatttagcattcatttgcctagactgtgcaaatctaaaaaaattgacaataggaattttcatctgctttagctctcttggaatttaagtcaatatttcagatcatgtaaagatttttttaaatgtatgttcaacaatctgtctgcccaatgaaaatccttctctctttcatcatttgctatttaaatactgaaaatcaaaccatttcttgctatagagataattaaataacctcatgtttttgtgactaaagttagaccagctgatacaaaatgttagattctacagaactctagggattgtattcacactctccagaacttgattttgttttgaggtgagcagaacttctataagctttatgtttaagaactttgttttacataaactatattcaaatctcaactctacaacttactcctattagctctctttatatctcagagcatgagtttctttttctttttttgcaataaaggattttaacacttctgagaagtttttactgaaataatgattgtagactaataataaatgttgacaaaaattggggtaaatggagttcttatacattaatgaatggagctgtcacttggttcaaatacttagaaaaatttttatggtattcactagagctaagcatttccctatcccatgacccagaaattattaatacaatatgcatgatacgggcacacaagaaatggagtgcatatgtccatccaaagaatgttcatagcagcttgattcctgatacataaaatggaaaattatccaagtactcttcagtaagaatgtgggaaacaaatcatggtctctctaaacctgcatgaaatgaaagagctacagatacacaaagcataaatgaatctcatagtctctatgtcaagcaaaagaatccagatacatgataatacatacttcatgattttatttgtatgaaattcaagaacagacaaaactaatttatggcaatgacagtcagaatagtgttacatattggagtgtcatattggctctgaagttattaaaaaaaaaacttctgctgtcatagaaactttaatatattgatcccagtagtgtttattggagtgcacacatgcacaataatttatccaggggtatatatatgaaaatccagcaaattgtcaaggaaaagcaagcattttattgtatgtaagttatgattaaataagaagttatataaagcagtttgaacggtatctgacaaataatgtgcaaacatattcaggagaacattagctataggtcaaaataagtgttatttaaaacccttacataccaattcccaattacatttagataaaagtgaacataaactggtcacaaaaatactgtttaataataatttaataattgaccaagtgttctctaaattacacattataaacagatgtttagaataccaactgcacatcaataaaatattacacaatttaatttagatggtaggaaatatatgcatattgaaacaatgtttaggagattttagagaaaaataatttaccatccatctgtgaaactggtaagatgcttaatggaactctcatttagtgcacaaaacataagatttgacatggtagatataataggcattactctttataaaagagttgatccacttttaaaatcaaaccaaattcattatttttttttgacattaacagaaatgaaggtcagatgcagtctgttgtatttaatatattatttgataaacttattttgacagatgtcttatacaatattccttctccaggaaaaaatatttggggttttttaagagttaaagtaatattgttttgcattttcagccagattttattagcaattagctggtgaatataacaaaaatatggattttttttggttggataccatcttgtattaaacatcatagagataagagactctgattttcagtccctattgaatctttattatagcttaagatttttttttatttttgtgacatatcctgttagttctaagtaaaagcactcagcatgactaggatcactttttatctacttttctatcagcagtttttcaggtacagcatagttacctatattattcacttacatgtcacttatcttcaggagctaatctgctacaattaccaagaaatgtaagatcctaagtatctcaacatatcttttgtttttatcttttctagcataattttgttattttatgtgacatttacacttgtctcaggaatgcaagattaggaaactaagtgatatgactaaaggtgcacctggtttgctatcagatctaaattcaaatctagaggtatggcttactcatgtaaaattatttaatctcttttaacatgggaattataactacattacaagatgtttgcaacaataaagatgaaatcacgtgactaattattgttccataatcagttgataagtggcacttaattttatgaaggttcatttcttacactgacttgaaaccccagcaaacccaagaagtgacccacttatctagtcaatggccaactattgttttcagtagcccaaacatttgggattttcacctttcactgtaactttcccaaacaattttcatgagattcatacggcactttttttctttcttgttctcagcctctcaaagcatgacactgtgtttgaacaagatagcaaaccactgcaaatcccgtttgtctgaactgctaaaaaaaattagttaaaaaatagacgttgtcacacttttcagacaagaaaatgtttagctattccattgtcagtgtaagataataatatcacactaaaataaagggacttttttttcttaatttccatagcctatggatattcatttcaatatctgagaaagcaatgacaaggcaatgtggaacaggcactccacttcattagctagttcatcccactctgaatatctaagtttaagtgccaatttcttcagagacaggatgaaatttgtaaattttatttcctctgtctcttccataaccaaaaccactggggggttatatacagtgccattctccagatggcttatgttatgagactatttataaaagaaagattgatgtttggcaggaaaaaaaataaaatggtcctacagtgacctagaagacaaaatatgccctatactcccatataaaaaagttatttctctctctgaatagatattccacacggaggaaaccgactcagaatgtttcacagcagcatgagttattttctgggtcacttctttttttttaatacttttcctgcctttgataaagtttcctttgcaatgttttggatattgaaatctgggagtttcaaagactaatcccaaggaatcacattatagcaaataattaatcttgatattggcaatttcctgacctacatattaagctattgcttatttcactaaacatttttcttcattaaaggcaaaggaaataaattctgagtttcatagatgaaagaatctctctctctctctctctctatatatatatatacatatagatacatgcacaaagacacatagacatatgtacatgcatacatgtacatacatacatatatatgaatacctgcacacacttatatgtataatgtattttatgagtttatatgtatatacatatataatctgtttattgtaacatgtgaattaaaatatagagaaaaaatagatataaaatatgcctgcataggtagatttcctttcctatcctttcaaaatggcttttttttttttttttgataattgcaagatactttaaaaaagatgaagtaaattttgcctgggaggataaatacttaaaaatttacttgctactttgtgtaagagacactgtcctcaacctggacatactgctctttgtacactgtagtgtgtaattttgatgtgtcatgcaggaatttttcccctcacgagttatgtcagaaattctagggtggcttacgatattggagatattcaatattcattatagcaagcaccaattaaagaagaacagaatataatctagaaaagcaatttcaatatgaaactgtaacacaatatgttcatttaccttgattatatttagatttcaagccagctgttgtatcataaacactgtttgtttcattgccaaaattaatgtgcctagtctgagttatttagaaaaatacatatgcaattatgttaaaattaaagaagttatgaaatatgattattaatcaaaatgctttacattgatttaaaacaagataatgcatttataaaatgagttctactgcatcccctcttcaggttaatagtttgagagttcatcattttttatttttctcagaagaaaataaatgtaaatggtttaaattcaaatttaataattcaataaattaaattctcatatgctaagttacatttaatccatgaataatgatagtttttcaacttatgtgtgtttttaactttatcatgcatttagtactggagatatttgtcttaaatattcatgatgagttaaataactttttgtgtacatggaagttcaaagagccaatttttgtactttcttctttcaattatattatatatatcccagaggttaatatagacatattgagagtagtgttgcagcttgatacacaattaggtaaactatgggtcccttaaataatgataaagccataatccaataatcctgatgctaaaacataatttactgaataatactaatattagcttatatttgctgcatgtatgcttccagtgcaccaagtacagtgctaagttatacacaaaacacacacactcatatttatatgtcagagtaaatttataatcttgatattattattctcaccatcttacatattcagaaaatgaattttggaggcattcaaaatcctggcatgttggtcaagaacttacatttgcagagcattgatcttaactgtgatgttatagtgattcattgtctttctttctttcttaaaccattacattacaatttccccttggtgtaaataacagcccttttctctcttcatcattcttttatctcaaagaaagagtatgacaggtatgttaaaaactattgtctatgtgtctcttattgtataccaagctgtttgaagtagttaacgtaataaattcatttaattccaataccaatgttacaggagatgaaccatttcaattttttagagataaagaaacagaggcatcaacagaataaaactttccttaaattgcaaagcccaatggtgatagagtcatgaaatatgaacccagtttgtcttgctccaaaatctgtgttttcagtcatcactgtgctttcattcaaagcaaggatacttgctctttcaagtagattatcattttatgcttattattattgtaatggaggaataagacatatacccaggaaaaataactagcaatataactagacatatacccaggaaatatatactagacatataccaaataactagacatatacccagtaaaaataattagcaatataagccgaacgtgatgagcgactatatatagtatgaatgagaagcactactgtaatttagaagtaaaaaaaaaaaatcaattatttccccactttagcttcctaatagcctttgtctcaccttctctatatgtttatatacaattcaacatatgttaaaaatgttatagcaattcatgctaccttttaacttactgaatttcagtcattcgctctgctttgcctagcagtagccaaattacacacacaagacatggaagaagaaaatttttttttttttttttggagacggagtcttgctctgtggcccaggctggagtgcactggtgggatctcggctcactgcaacctctgcctcccgagttcgagctattcacctgcctcagtctcctgagtagctgggattacaggcatcagccaccacgcctggctaacttttgtatttttagtagagacgggatttcaccatattggtcaggctgctctcgaattcctgactcaagtggtctcccagcttcggcctcccaaagtgctgggattacaggcatgagccactgcgcccggccagaaatttcattttagcttatgttagaaatgtagtagaagccgggcgctgtgattcacgcctgtaatcccatcactttgggaagccgaggcaggtggatcacgaggtcaggagttcaagatcagcctggccaagatggtgaaaccctatttctactaaaaatacaaaaaaaaaaaaaaaaaaaattaggcgggcatggtggtgggtgcctataatcccagctactccggaggctgaggcagagaatttcttaaacccggaaggcggaggatgtagtgagctgagattgcgccactgcactccagcctgggtgacagagggaaactccatctaaaaaaaaaaaaaaaaaaagtagtaaaggagacatgcgtgatagatttaaacaaaatgtatatctaataatataactatcaaataaagtatttctgtgataaaatttattgtggaaatattcatgaatgtcatagatgagatttgctttttcattgttttattaaacatctgtgcttccattttgaaataatacttgaaatcccactgtttatcttactttcctttgtcagtcataatctttgaaaatatgtagtgcaagtgctgaactgcatccacactagttctttcctaattaagagttgcagcatatcactgaaacaaaagaaaaatatttttattttttcaggtccttaaattatctatagctttagacactattgaccaattgtcagtgaatcagaatctccttccttactgttcttaatgactttgtacagtttgtatctcattctgaagtataatggctacttttactttcttaattttcctcacctctgcttagtgtgatagccagtttggatattcattgcctattacgacctcctacacaagtttattccatttttttccatcatcccagtcatgtaccattcacactgtagttatctgagtaggtaacatagtattacctcaaaaataaacatattaaaatgtaatttatctttttctttcaactgtctttcccatgaagttgacaccacttacctttcaatggctttatattctgaactcatcctgctagatcttgttttaaatgtaagccctattatctctttcaatagagctctcaattatttcttctttctttatgtctaatgccttcaagttagttcatggcctaatgaattctctctgaattatcctaacagcttcctggatataatcacaggtacaatataaggacatacaacaaacataaggacataaagccagagcacacacaatctctaattataaacttcaaggataaatgtaattaaatcacatgctattaaaagtattaaagtaaaagtatttcattaatggtaatcgcttggcacttctctaagccagatacatttagtccttaagaaaaatactatttatgtaaagaaaaattttccatacggacgagttttgtctttccaaaacacatttttttcagtcttactcacgatgaattatttaaattatgacaatgcttttgtagaataattgtgagatgagcgagaatagctactctaactttttaaacatttacaaaaaaatactgtgccatggttatattggagaaagaatttttaaaaattatcacctctacccaagtaattatataatcctattgtatatctttgtatttgaaactgtaatccttttgtcaccatttttttaaatagttacttaaaatgctcaccacttctttttactaggtgagccacctagttatgtaaaataaacaagtacttctcagaggccagattgaaacaattttatttagcttaaattcttcctagctacctactttcttcctttcaaaactcttattttcaaaaagatattaagataccagcactattcatttatatcacattgattatgtaaataaattgaaaacgtttccttacaaattaaaagagaaaaaagtaacttgcaataaccctgatatttttatctctatttattcaataaacagcatctttttgctctaaaacacacttttgaatacttgcagaaggaaatccagattttgattaaattttctattgattgctatgcaattctgtatgaatcatggttccttaataattccactataagtttcagattgaataagatggttgtcgatagacttggacttcaacactgtagctttatataagtcatttgaaccttcagattcttaaaaatgccataatgtcagtataacacaataattttttgattctgggtcaccaaacaaaatgttcataaaaagtcattcatccagtgttagtggctacataatagaagcaggtggaaataacaaatattttttatcatccacttctacacatcctcctggttcagggcctaaatagcaagtgtttattcctggtaagtacattatcttcttgaaatgatatattttgcttttaagtggtattacagtgagctagaagttataatacattcccattatgcatctaatatttatttgaatgtacccattgataagataccatacttatatatcaatgtttcataattctttaaaatggatggatataaagattaagatacatttaaagataacaaatcaatattagtgaagttattttgttaaggctgaatataatgtgctgaatattcagacatctacataaaagggaaatctgtggttctgtgttctgcctcaggaggtagaaaaaggatggatagatatagatagatagtgaatggtaagaaatcaatggaccaaacaacgatctgcaaatcatggttggttatgaagtgtcttgcaagtaatatgttcttcttcactgttaaggtagctgataattttttgcagttgctcttcaataaaccactattattcactctcagtttaagtagttctactgagtagaatttacgttgcagcttgatatggtttggctctgtgtctctacccaaatttcatgttgaattttaatccccacgtattggaggagtggcctgataggtggtgactgaattcagggggcggacttcccccttgctgttcttgtgacagtaaatgaattcttatgaaatctggttgctttaaaagtgctgttttaaaagtgctcatgagatctggtgtttaaaagctgcttttaaaaaataagttatttatttattttattattttttgagacggagtctcgccctgtcgcccaagctggagagcagtggcgcgataacagctcactgcaagctccgcctcctgggttcacgccattcccctgcctcagcctcccgaatagctgggactacaaggcacccgccaccacgcccagctaattttttttttttttgtatttttagtagagatggggtttcaccgtggtctcgatctcctgacctccgcatctgcccgcctcggcatcccaaagtactgggattacaggcgtgagccaccacacccagccaaaagctgcttgttaaaaagtactgtgtagtgcttccccctttgctctccctctctcctgctctgtcattgtaagttgtgcttgcttcccctttgccttcgccatgactaagtttcctgagacttcccagccacgcttcctgtacagcctgcagaactgtgaatcaattaaacctcttttcttcataaattacccaatctcaggtagttatttatagcagtgtgggaatgatcacagaaaattggtactaggagtggggcattgctataaagatgcctgaaaaggtggaagcaacttttggaactgtgtaatgggcagaggttggcatagctggggggctcagaagaagacagggaaatgagagaaagtttggaacttcctaaagacttgttgaatggttatgaacaaaatgctgatagtgatatggacaataaagtccaggctaaggtggtctcagatggagatgaaaaagttattgggaaacggagcaaagatcactcttgctatgctttagcaaagagattggtggcattgtgcccctgatctagagatctgcagaactttgaacttaagagagatgatttagggtatctggcagaagaaatttctaagcagcaaggcattcaatatgtggcctggttgcttataaaagccaatgctcatttaaataagtaaaaacaacttatatttaaaagggaatgagatcataaaagtttggaaaatttgcagcctgaccacgtggaagaaaaaaaaaatttctggggagaaattcaagcccactgcagaaatttatataagtaaagaagagcagaatataaatagccaagacaatggggaaaatgcctccagggcatttcagggacctttgtggcagcccctcccatcacagacctggggacctaggagagaaaatggtttcatggtccaggcccagggacttgctgctctttgcagcctcaggacatagcaccctgcatcccagctgctctagctccagccgtggctgaaaggtcccaaggtacagctcaggccattgcaccagggggtgcaagccctaagccttagtggcttccacatggtgttgggccttcgggtgcacagaaagcaagaattaaggtttggtagcctccacctagatttcagaggatgtatggaaatgcctcgatgttcaggcagaagtccattgcaggggtggagccttcatggagaacctctactagagcagtgtggaggggaatgtggggttcgtgtctctacacattgtccccactggggaactggcttgtggacctgtaagaagagggctaccatcctctagactcagaatggtagatccactgccagcttgcactgtacactttgaaaagacacaggcactcaacactagctcatgaaaacattcatggggaatgtaccctgcaaagcaacatggaaggagctgtccaaggccttgggggcccgtcctttgcatcagtgtggcctagatgtaagacatgaagtcaaatgagattattttggagctttacaatttagtgactgccctgctgtgttttggacttgcaaggggcctgtagcctctttatttgggccaatttctcctgtctggaatggaatcatttacccaatgcctgtagcctcattgtatcatggaagtaagtaatttgaacttgtgttttattttacaggctcataggtggaagggaattgccttgtctcagatgagactttggacttggacttttgagttaatcctggaacgagttaagactctgggggacttttgggaaggcatgaatgtgttttgaaatgtaagaaagacatgagctttgggaggggccaggaacagaatgatatggtttgactctatttccccacccaaatctcatgttgaattgaaatttctagcgttgaaggaaagacctggtgggagttgactggattatgggggcagatttcctccttgctgttctgatgagagtgagttctcatgagatttggttgtttgaaagtgtgtagtgctctccacttcactctctctcctgcctcaccatgttaaggtatgtgggcttccccttccccttctgccatgattataagtttcctgaagcctccctgccatgcttcctgtaaagccagtgaaactgtgagacaattaaacctcttttcttcataaatcacccactctcaagtaattccttatagcaacatgaaaacagactaatacagaggtctagagattgattaatgacctaggtatgatatacttcatttcgtatccttagtatagtgactggttgagcaacaacacataacctgaggccaaacaatgagttccttagaaaacgaaagatttcaggaaattattactctttctgctaagcagctacactgatagaatataaggctggaaatatcagaagctacttttgtcacacaaggtaaagaagacctccatactccctaaaaatgaagtcactggggtcacgcagagcctgaagatgaataaatcacataataagatgatctgaatcattaattcaagccatgcaagaaccagccttactcctgtttcagttatgcatactagtttaagttgtgtttctgttacttgcaattgaggggggaaaaaacccaaaatgtaggagaaaatattgctaatgatttattatataagcaccttaaattatgtcaattgcatcattattgtcatttacttcttcccctaatgacttgtacactggatgagaatgtagaatttaaggtcttccaggaacacctatgaaagactgaaattgttgtggatgctttggcagaaagatatcaaggacttttgctctgatgtagtggttgtctactgctggtccacatactattgatgttcattgatgacattccactgatacgtgaaaacgtgggaaaatagattatcagatgagttattcacaaagtcaaatgcattcacttggaagagctccctttccttctcagattatgacttctaagcttttttggtggaatactgctttttcttttttaaatgaaataatacctttaataaataggtttgtttgtctactttacaatgtgcttttttaaaattttgcataataaaaggccagtttttctgtgctgcactttcaaagaatttaaagtttttcattttttccccctaggtttagaaaattctgggataaactgcttgtagtaatttccttgaaagtgtttatggtatcacagctgtcactagagattttaaccaaccatctgaagtgaattattctctaaagataatgctgagagactagtattaagccatttgctgaattaaagatagaaaaattttgaacggatgaaagctaccaatgtatggagcttctgaaagccatgattaccaggggctgctgtggcttctgtagtgttattggaaacttcatctacgcagagccagtataaatgacctccaagatggcgagtcaaaaagcagccacggggaaatacttttgccaggatttgtagctgctagggtagagacagcaaataaaagacatgcttttctcccttccatcacccatggcagatatagctaattttaaaccatgtgttgtgcaaagatgaatactacttcccattataggcctaaagataatatagtgctccagttacaaggtatgtgcctttctgcttcaaacacactgtttatacatttctctgtgatgctggagcggaacactgcaaaccacatttctattcattaattgcctccacctattgaagaaaggaggtagggggagaaggcaagtttgaaagagacaaatggacactctccttgtttgcgttcatttcttgtccatgtcactctacttgatgtggtttggctctgtgtccccacccaaactttatcttgaatagtaatccccccgtgtcaagggagggacctagtgggatatgaagaaatcatgggtttcccccatgccgtttacatgatagtgagttctcacaagatctgatggttttataagtgtttggaagttcctgcttcgctattctctctcctgcctgctgtgaagaaggtgcttgctttctcttccacttccaccataattgtgtgagtttcctaaggcctcccaggccatctggaactgtgagtcaattaaatctctttccttcataaatcatccagtcttgggtattttatagcagtgtgaaaacacatacttaacaatgcttctagttccttacaataccatcaattcaatctcattaagagttttacagataaaaatcagtcttatcatgcccctctgagataccagcgccagcatgccctagtgccctcctgaaaggcttggactctagctcctcctggactcttcttggttctgagaaatatcaaacagtgtcctttttcaaagggatgagtgtcagctctgtagggcttctcttttacacttctaattccataaattctacaacttccatttgttttctcagccttaaggatagtagctgatttctggattattattattattactattattataacaatattatgagttctgatatctcagaagtgtattaatctctcatatcttacatatatatttaatcctcacaataatgctacgtggagagtcctattattacccatatttttaaagataaaggaaatgaaacagaaaatacgatatttgacttgcctgtggtgagatgtgagtcatcagaagccgacattaggaacagcagtggggaatgttaaaaaaggaaggcttccttgctcagaaatcactagacttttctgtcatctcagaataatcctctggtataaacaactgtgggtcagagaggggccatggtagttggctagtagtaatcctttaaatatctttctcattaaatagagataaatattttcccaagaagactaagtagattggacatttccaaaactttggaaagattcctaatatccactggagagcatagcctgggataaagatgatttctacctctattgtaccaaatttttaaaaagtgttctactcaattatggccacctgtttctaccccaaatttctcctttctaaagtgctgtgttatttactgtgattctaagagatttggtggttaaaatgcaatacatttcagctgggcttggtggtgcatgcctgtaatcccagcaatttgggaggctgaggcaggtggattgcatgagtccaggagtttgagatcagcctgtgcaacatagtgagatcctgtctctatttttatttaaaaaattaatttataaacattatatatagtgcatttattatatatcatatacttatattttataatgtaatatattaaatgtgtaatttaaatatttaatatatttaaaggattttatactaatatatttattttacatatttaatatactcaagggttttaaatatttaatatattcaaggaagacttttaaatatttaatatattgaaggaagtgtttaatgtattgaattttatgtatatatacacatatatacatatacaaatatacacatttgtttacatatacacacatgtatatatatacatatgtacgtgtatatatacatataatgcaatacattaaatataaaactcttccttgaatctcagcatagttattggtagtttggaagtgcttatgccattaccatttataaatgcagtgctaatatcttcatttcaattatccttagaaaaggctactataccttgtccatataaaatcttattgatcaaatattaccaaggagcatgatctgctaaaggtctataagacccagttaaatggctccagaaaatctaaatttgcaaaggctggagagatcttaacttcagagagaaaattgagtcaggaatgcacaacttttgtggactccaacatacactgcaaacagtcactggtatcttttaatagtatgaaaataaaaaatctttatcaaggactcagactgtcatagctatcattctaagtatgaatcatgtttaattttttacaacagttctacgtggtgagtactattatatccacattttacatactaagaaaactcaaatttaaaactatctgagacccacacagttatattattttttcaaataacaatgcttggattaaatctattaaataatttttagaattataatgccaacagatttttctacacaaatttggcttttttctgttttgtaaatatttgtttgttctctggaagttggttgaataaacaggctcctcagatatcctcagatcttacttccaagcaagccaactatttatatgcaattataagaagtatagtttcaagaattagtatgatagagaagtgataaaaataaaagaaatattaaaataaaccacttacgtaagttacaataaattccaattaactcagtatgaaatattattttgcaaagcttatttaataaattattacagatatctatgataatataaacctaaagtatttagaattctcaattaaagcaattataaggcatccctctggaaatcggtctacttattcctggaaaacagatttctacaagaatctggactcagtaataacaatgatagcaacatatgtaggacatataattatgtatttttactgagaatctaataggagatctaatatatatatgtgtgtgttcatatatacttacatatattttcaaatataatattagttaatagtctgttgaaatatttgatacactacaatttttatataatccaataatgaatgcaagaaacaagcaaaattttaaacatatttttgaggacattaggtatattattgctttcaaaatttgtcaagattcgtaatattactgataagatacaggattctttccttcctgtttaattgcttaccacccccaccctcaacacacacacataagaaagcatattgcatgtattttggtgtttttaccttccgtattagccgttttcacgctgctgataaagatataactgggactgggcaatttacaaaagaaagaggtttattgaacttacggttccacatggctggggaggcctcacagtcatcgcagaaggcaaggaggagcaagtcatatcttacgttgatggcagcaggcaaagagagagcttatgcagagacccctgttcttaaaactatcagatctggtgagatccattcactatcacgagaacagcatgagaaagacccacccccaagattcaatgatctcccactggttccttcccacaacacgtgggaagtatgggagctacaatatgcgatttgggtggggacacagggccaaaccatatcaccttcgtaattttgagatgacacattatacaaccctcctaaaacttgtaggaaggcttatgatgaaaaacagaaacaaaacagatcaaaaggaaatactgatattgcaaattgcttggcagtttttgtttgtttttcagatttcagcactccaaatctggaaaacttaaaaatgtatgtatttaatttaaatgtcaagttgtgatctagcttttgcttggatggagtgataaaagatcactacttttccaagtctctttcccataagtcaggtatggtgcactccacagacactgatggcaaatgccatcatctggaaggctaattttaaccagaaaagtctgggttagtagttttctctcagcttgtctttagttagttacttaacttgagtttcagtgcaggcttgggactaaagtaaaaagaattttgtgggtttgaggtcagactatgtgaactattgattctttctcttcacaattaacatcacataatgctataattaatataagtgcatttaaaacttagactacaactttagacacattttggagcagtctgttttcctattcaagttggtaatatctacatttaaatacttatatcacatattaaataatgaaatatcattctgatgttgtttgaaaatcagaggtctttaaatatctgagtacttaaatatggaatcaaagttattgcctgaataaataattttgaaattttggaaaataggaaattaagctaaaagtagatagatatgatgaatgatttttgacctcttaaataaatctcataaatgtgaatttttatactaatttgtggacttttttgatagagttagtcgggttcagatctctctatattgatctctctttctctttctctttgtttctctctatatatatcagaatacgcataatattttctctcacacccttctaacccaagaatcaagtaataatcatcaaattaagcacctcagagactctttgccatcagaagtcgggagtaattacttctctgaaaaactttgttatttattaaatagtaatttagcacttacaacatgatgaatttgcttaatcattttttgatatagcaggaataagacatatatattccatatcaatatggaacttgtatgccatatgttgagacacatacaatttagtagtatggttttacattacactctcccctaaatctcagtctgccctaaacctcaagagtattccctaaacctcagaagactgaagcgtatttgcctaaattagtagttgtcaggcccgagtaaccactatgcatttcacattgctaagaatggctccgttatttagccagtcaagcctagaaactctgaatttgttgtggcccaagtagtcttaatgccgaatttctgatagactgattgattgactaccaagttctctttcaaattactaaagtcattaagggcaccaaattaaaacatagctaagcatttttctactcagatagttataatcagtgggaagatattttttcttgttttttttgaaaataaaataggttcaaattaatacatacaggctggatgccatggcttacgcctgtagtcccagcacttgggaggctgaggcgggcatatcacctgaggtcaggagttcaagaccagcctggacaacatggtgaaacccgtctttattaaaaatacaaaaaaattagctgggcgtggtggcacacacctgtaattctagctacttgtgaggctgagtcaggagaatcacttgaacctggaaggcagaggttgcagtgaggcgaggctgcaccactgtactccagcctaggtgacagagtgacagtctatctcaaaaaacaaacaaacaaacaaaaaattaatagatacagatatatatttttaactcatgggatttattgtaatgaatgaataaaagatgcttgaatattctataatttcacagtattcttttgcttactttcttggcagagatgtaaaaacatattgattatatagagtagatacttattttgtagaaataaaagtgtatggagaaatctttgcagatgtatttatcaatataaatggaagaacatttgttgcccactaaataaataaatattggagatatttccatacaagtgttctgcttatcaaaagaaaacaaaatcaaaacgcttgttccatcctttgttgccctttagctgccactgtgttatctccacaagtatgatcttgtaaagagtcatctctggattcaaactttttccactcaactctcattcttctcataccacaacctgcttcccacctctcacattcacctccccccacatactctaaacttagtaatttcaataaccttctatgtctttgctttcaacttgctcatatttctccaacattttccaggtaattctcaattttagaatatcttttcccaatattgggaaaaagagggaaaagatattctaaaattcccttctcacttatatagatgtaggactccttagccaggaatactgctactcctttatcaaatcatacactttttttgtctgccggcttttcacatatttgctcctattcaaatttcctttcctacatacccctgggatgccttccatgattatgaagtaggtgcttaaggaagcttgacaaaatgaattgtttaaaacctattatttagttatttaacaatattgttgacaagttactatataccatgcactattttaggtactatgaaggaaacaacatacatgctcccttatatcaaggagatacagtatacttgggcaagtaaaaggaaataatgaactaaattaaaattacaactgtaataagcactatggagatgggaaatagtaacatgggtccatttataacacaaatatctgttatattctgggggactgaaggttttcttaaggaagtgacatttgaactgagatagaaacaaatcatataaacaggataaaaaagaaaagcgtcaagtgagaagactgttaaatgatgatgaatttacacaggcaaagaaagaccttgtaacatgatacattcaaggcactgaaacaacagagtggaggctggtggaatgtgtaaaggagatggagacaggattgtggcttctgtagaagtggcttgaactgagatgatgcagaaccttaaaaactgtcttttattctaagagcaatgaaaagacatcagatgattctgaagagagagatgacttgaaaatatgtactttaaatccatcactctaacatatttgtgaacaatggagagtaggactcaaggacagatacaaggagacaagtaaggaggctattgtactggtctatggtaaaggacgatgtgagcacaagtgaaggtgatggatgaggacgtgaggaaaagtggacaaattaaagataatggaggggtgggataaaaactgtcataacttagtattggtttggacatatgaaaatgagggaggaaataatccaggaccactcctgggtattttgtttgtgcagtggatgaataaatgattctattcattgatatacataatggtggaaaagaactagactaatagaattgagagttgagaaggggcatgggagagattataaattatgttttttaaataacatgagttttagtgtttgagattaattagtgaaaataccaatttagtatctggatataagcactatgctcaaaaaagcgatccatgctaaagatttgtatgtgtgattcatgcatatgttgttggtagtaaaatcatggatcagatatcctagaaaataaggagacagaggaggaacaagtgaaaagattctagaactaagccttgaagaaattcaagtttaatatgatagaagaatgagtgtgcaagaaattaagaaagaacagcctaagaactatgagaagaaccaggaaagctatcatagaagccaaaaaagaggggttttgggaagaggcataaatttcaaaagcttaaaaatgaagaaaaaaacacaaggaaaatgagatccagaaaaaaaatcaattgagataaatgaatgtaattactaatccaattaaaatttatagtgttacagcagatgatgccacattatactatagaggacagagtcatggggccacgaataacagaaaattaaacctaacagcaaaaacaatcttataatctagaagttaagtcacttatgaagtttttaaccccagaaaatagtagataaataaaagtaaaatgaatacatatgttaatttttttgaagaaaagatcactgaagtatttgaggaaagtataagagaccacaacatttaaaacataatttgaagaacatagacaatagcaaaggaagcatagacatctggtagaaacgaccaacacatgatatcagaactaatggggaaatggtgtagttgaagcatggaggaattttgcggggggaaaaaaaagctaattgaatttggctctcacgatttttttttcttttttcttttctttttttttttttttttttttttttttttttgacggaatctcgctctgtcgccaggctggagtgtagtggcgcgatctcggctcactgcaatctctgcctcccgtgttcaagtgattctcctgcctcagattccctagtagctgggactacagccgcgcaccaccacgcccagctaatttttgtatttttaatagagatgggatttcaccatgttggccggatggtcttgatctctttacctcgtgatacgcccgcctcggcctcccaaaatgctgggattacaggcgtgaaccaccgtgtccggtctgatgattcttttaataactgactgtaaatatagagtccctctccctgtaacccccttgaaacgtttttgatttatcagcagataactaatcagaacatattgatgtttttaagaagattcctcagggcagcttgaatggagggaacagagactagcatcagcccagctagccttagaaatggcagggtcaaggtaatgaagatgtgatgaaggcagtggtaacaagaatgagaccaaaggggaaagtgggagacagcttgaaggagaaaatggaagtcctctgtaaataactggataacatggatgataggttaatattataaaggatgccatatttcaagtgaatagaatgccccaccaatacagaaatggaatttagaaaaaagccagtaaatagccaatgtataattgattagcaactgagtgttaaaacataatgctttttctaataagagcttaaattctgttgaaatgtaatcatttgcatttccaatgataaaacacacaaggaaagctagtaaacaattcatttggaaaatataaacatttagggaaaaagaaattcacatagagctatcaaactagtgttaagtgcttggctaacagttcaatactgattacttttcctctctctctacccaaatattgcttctgaatatatgaccttgaatatatttgcaaaggatgattgatatttctaaatagcattaagtgaagttattttccactcaaagaccaaatattaacattttcagattaaaattataaaccaagaagccaataaagcgggcagacactaaatatatatagacaaattgacttaaagtgaacaaagaaagttactataatgagttaacccataaggaaaacctacgtatatgtaaaacctagaaattcggacttaagttatttatagaaatgatacagaaggtagaaagaaatcatttatgcagatattgaaggtaaaagagtccttggcagcttcccttttaacaaaaagcagccccccaaataaattcttttctaacaaagagcagcctgaaaaatttgagctgcaaacctagacaagcaagttggaagcttgcacggtggaatgccggcagctgtgccaatagaaaacagctacctgtgggccaggcatatccaacatggaggctccatcttcttttttgttgttaccacatgcacagtaaagaaatgggcaacatggtgcagctcaggcagaactgcataataaaagattaggttgagggaggccagaaatttgcaccctatgcaggtggcacatctagtcctaaccagtttttcacagcctatgcaaatgacacacctagtccaaccagtctttcctaccctgtgtagatgagacatcacctcttcaccagctcatctataaaagctgcttcattttactgcagatccagtaacccatttctccaggacccctctctgcagcatcagagagcaattctctttcttttgcctattaaacttccactcttaacctccctctttgtgtgtctgtgtccttgttctccttgactgtggctgtgggacaacgaaccttgggtgatactccagacaatgaaactgtttcagaaagagatccctataatcaggaatgataatttaaatagttaacaaggggaacttaacatcagtaacttactaaacagagcgcatgaactgagtgggaatgacagtcagggatgttcctgctctgtgaaagattaaatttgatgctagattccgggaagctctgggtcatgtgagtaggggtccataaaagtcagcagagtagcataagcctgaagttcttcaacaacaggttaagaaatactgcagttctttaatcataggcgggtctctaccacaatgtaccatctgaatgtcagcattggctatagtcctactttctattcaaaatctatcaaataatttttttcctaaaataaatttttttactttccaccttaaaggttatattattcagggaatagtttttagtaaattacagcatgtattcttattataaggtagaacagcagagctcaacattacctcaccaaagtgtccaagctagaaactttcttattcttcctaattccttctgttcaaacacataggcatataaagacatgattaaaatagcataatggttcttttactgaactgtgagtcgcaatttctggcgtagaaattaagtgtttgactcatcttttcattgtatcatctggcatggttttgggatcatagcagatatttagacaatgaaaatagatggttggattaaaatatgtgcatacataggcatgaggatggatggataaatcattatcatctattagtttcacgaatcttcatttacactacctaaatgaataacttcatagagctacttgggaagttctccccttgcagtttatggaagaagcttttccttgatcagataagtattatttccttgagtgtttggtagaacattcgattaaaacagttaccaggggtgtactttcatctaaacatttcaagtcaccaattcaattttgttaatgtttataatacctttcagattttctatgttaactttgagttcatttttataagttaaattttttacatttgtgttttttagtgtttacattttttggcataaatgtatcttatatttttaatcttttaaaaatcttaaatatatgttatatttatattaagtcctcttccctttctagtattgtttatttatgttttcttgttttcgccccatggtcaatttcacaaaaactttctcattcttcttaatgtttacaatacaaaaacttttagtttattgaacttctttattgcatttgttattttattatcttctatcataactatcactttcttctttcttatttcttccagcttattttgtttttcctttataatttgattagctttctatttaattcttaattttcagcatttttgcttccagtataaacattaaaaatcaaactgactttagctatattgcatgcattttgatatgtgatgttattatttcaattctaagcattacctagtttccattagaagctcttcttcaactcaaaattatttagaagtttattcctaaatatatgatattttatgttatcttgttattgatttctagcttaagtgcattgtgttcaaagaacatattctctatggtacttgtttttaaaaatatgttagaactggttttatcactttatatgtcatcaacttttataaaacagtacttggaaagcaaaggtgtgttttccagttgttaaatgcaccaattaatatacattgaatagttaaagcttttaaattatcttaagtccaaattttatatagccttatcatttttttattattattttcatagactaactactgagagaggtatgacaaagtttctacaatcatgatatatttatttatttctctctgcagttacattgttttttctttatgtatatggaaaattatgtatttagacacgcacaagtttaaatttttttttgtcctggtggaattagaacttttatcataatacatgaccattttatatccaaatttttttgtcttaaattccttgttatctggtatttattcttttttttttgtgggatgggaaagggttacattttcctggcatatatcttttaatctttatttcaaactttatgtttcatggactgtttttatttgttttttaagagatgggttcttgctacattgctcaggctgctctggaactcctgggctcaagagatcctcccaactcagtctccagagtagctgggaccaaaggtacataccactatgcttggctttagatgttgtaccctgtttaaccagtctgtagtactgactcatatatcatattgtttgcacatttcaatagcaaaccactgtaataaagactctctggccttctcactcctaaattctataatctgttttacagtgtaatggtagtgcttctggctatgctcaggtaagcttgaatttgagagagaactcttctacgaggtattacatatttattcactttaatgcactctttatttcttgttcatctgagtaagtaaaacatacattgtgaattcttatgtaggatttaagtagagtttgaagttgaaaaatatattaaagctaattggcccccaaagggctcaaatccatgatcttagactcattagctctgagcatctaagtaagacaaatacaacaatgaatccattatacagcaagaaaacaacattaaatattttaaaactttaacttgttgactttgaaaattgaagaaaggcagagatgcaactttctttttagtactgaattatttatccttcatatttgaattcaagtgataattcagtgtgtacttaggcctgatgtagttagcattggcaagtagttatgcatttgtacagtgggcagtattctgcatgtgagcacatacatgaatccagttaccttatcattatctttcacaattctacataaattattttacaatcccttattgtgattacattctttacttccctccttgttaatttagtactaagcaacttgtatgtaatgaaaacaacacaggtcacatgtgcaaaatttaagactgtattaggtagaggggaaaatgaaatattgcatcacttttttgccttatcaatgtaaattgataagtgttgtatgtatactactcaatggatactaataaattcttagctagggcttccatggcaggataattttcattagtacccaatgcagtgagcaattttatgaacatcatgtaatgtgtgagcatctgttttcatgttcttccaaaattaccttcagttgtctgtgattctagcagtagttcctcatatgttatagtcacagctgtttttctgtgtctcagagacatccaggatttctgaagttacaatcttgatgtgttatgacacaacacgaagcagtataatgcagtgcttgacagttgtatgggagtagagaaagcattaagaagagatattaagagcacagactctggcatttggtagctttgattccatttgcaggtctgttacttacatgtattatctagggcaaattaatgaatttatctgtgccaatttttccttacatgtaaaatatattaatgctcaccacctagaaaaaaaaatgaggaagcacatataaaagtccttggcatagaataggtgctcaacaaatgttagtttatattgcacatctagtttaattttgtccttatataaatcttctgatatatgttgaaagtcatatttgggtctgaaataactaaatgtgtggtggttacttaggaaaagtttcctagtttttctgttctactgatattttcaatttcaattattaaatatgttacagaattaataactttaattgtatctctttgttagaagtcaatttttaaataaaaatttacaaatacggtatacaccaatttatagctttggtaaagtgccaaaaagaagtggaggaatggaaagagacttgtcaaggagtacaaagttacagttacatagtagaaataagttctggtgttccatagcatagtatgatggctagggttaacaatatatcttttattacaaaatagctagaagacaggtttttaatgttctcatcacaaaaaaaatgataaatgtttaaggtgatggatatgctaattaccttgatttaataattataaaatttatatatgtattaaaacatgttgtactccataaatctgtacaattattatgtgtcaatcttgcactcaaaaaattttacctaagcctgttgtttttcctatgtgactaagacaaagcaatgtttgagaaatatagaagtctgttaggctgttttccgtcaggttgtcacatatcctcagagccttgatacctaatagacatttgtttttttctccatgtaagtaaagcttggtttatttgctaaatttatcctgctaaaacaaactctttctgtgaattctacaaaacacagagatgctaaactgagggtctcatgtttgcatacagtttggtattttggcatatgacttataatatgattggaacatacatgcaacatataaaagttcttcacagaagaatggtagggggtgggttcctgaacacagaacacaaagattcagctgaatgaacattggtaactgagaaataaacccctgtgatatatatgacactgtaaattgctgttaaagcaatgtttttggtcaactcgaaagaaatttgtgagacagttttctaatggttacttttatctcttactcaccgaaaacatatcaatagatagggaaaatattttcataaaatgcttttcaattttaaataaaaatggtagaaacaaattggtttttgccataataaaactctcaaaatattttctgttgctgagtgtacgttgcttggtcatatcaattcacaaatgctttaaaaaccttcgtatttttatgtttatattttctattttttatgttcactgttaaacgttttaaaaatgaaagattctattattctttcgcaaatgatacacatgaaatagagctcaaggatctgacatgctcacaattcatgtgctttaaaaataaatttccacaaagctattattgatcaagggacattatattcataatgctgaatcataatagaacagctttataaagcattactagctaatatacaacagaaattaatgaacacttgctaaagatgattacaagatacttctgttaaatgacacaaaagaaaaaaaaactgctagccatcacataaaacactgctatttttctttttgtacataaatacttagctaatcaaatggtattttatgtcttaatcaaggggtgaactgctggaaaaaaagaaaagaaatttcatgtttgtggaagggattctttttacttgttagtctaacagcttttttgtaaacataagaatcttactatgaagcacaaaatgtacagattttaaaaaatgctttctgtcatgatcagtatgcagtgccttaaaatcctgtcagtaggagcattcctctctttttaggaagagttctcctgacactttcttagccattgggttatttagaacaccaactatcctttccttgtattcagtatttctagtcctcacaataaccttttaaaataggcatgtgtgtttctattttgcacatgagaaagtgaaagctcagagcaatgaaatttattgttcccaatcacatggatagcaagaggatttgtgtttccagtacaatcttaacaaactccaaaggccacttctttcctccacaccacatttcctctctagtgaaatctatggagtacattgtatattaaatacagtagccacgagttaacgaaataataggaagcagatgaaaataatatagaatagaaaaaatggtgatatgaatgaggaaaagcaatggaaagaggagaggagagaagctagtggttcacattattattttttgccattgactctttttctggaaacagctcttgcctttggtctggagaacatccttccctgactcagcctagtagctttgggtaagctgattaaagtgcaagcaatacatgtggagcacttgatctacagttatgtcaatcacatacttcattcagtcatccttcgttgataggtaagccatcaaagcaagttaaaatcaatctgggaaaatcatgtgtttgttgagatcaatatttgcttttcctgatggatttggactgtaaggtgtggaaaactttgggcactttgctgagcctctctgaaaatggagctatctcaaatgagggggagctaagagataaagctctgtgaccccatttgacctcatttctgcctgcatctaaatcctcatctacactccggttcttcaattataagaattcttccactttttgtgtaaatcattttgtatttttcatatgtaaatgacagccaacatctatattttgttgatttctccatttatagctgggtttatataataaaatgaatatcattcacaggaaaatgagtctctgggaagcaacattctctcataattatcaagtgactttgttttaataatctctatgcttactgctccttctggtagaaatattgatgtgaggggccttagatcaaaattctttaggaggaaattttcactaatctcagtatgtttcaccctgtcagatatatcccagataaagcttcctcatgatcagtagaccataaataagtagggtcttctctatttctaacgtggctatacatcctgttgtgcttagggtcatgatcactatgtatgcctatttttctagtataattactgattgtgccttctttcatctcaaaatggttcccggttgcaagataaattctatacttatattattgctaacagtcccgatgcagcactgaatcattacaacattaaggatggctatatttttatttatggtcagatatatgtacctaaagttcatgatactttattattgcttttttcttgcatacatcgtatattggtactctcacttttttttcctgtggcaaaacttttaattaatatactgtttcagaatatcagaaacatatataataatataaattttcttatatatttaattttgaatcaaatgccttttaatattcaaatatgataaagtaaatggcagtgtcacaaaagttttaaggaaaatttatagcaataatttgagaagataacatttagttttttttaaagactaacattcattgttagatgcctccgtttccagctaacataatgtaattgtttaatgagtacatagcaaggaaaaataaggagctgaagaactaattgtttttcaaaacaatattggaggtgtttcacagaatgttaggcctagcgatcctgatatcagtcacacacacacacacacacacacacacacacagtgaatttcctaacatgttaggtcatcaataaatgttctatttataaactctccaatatctttaagggaccacatgctatggtagaccacatggatacctcctgtatcacatgagatatcagaaataaagccacaagttattattttatttctctattttcttggctaattaccctaaaacattcctagtttttatacttaaggccctatgtcttataaatcctctcagtcctaagtatattgatcaccctattggtgacttatcataatggtaccaaacattgcagtgtagtacatcaaggagttgtaccagcaaactctccctgatctgaaccaaacgagataacctgatgtttccatattttcttcttattttcaaagtgtaagtctcgctctttttttaaaacacatttttgacttatagaatttaattttatggcacgatacaggaatctaacttgtcatttaaaaaatagctaattgccctagaatcatccacagaaagatatacagtcatgtgtcagttaataaaaaggatgcattctgagaaatgcatttttaggcaatttccttgttgtacgaacattatagagtatacttacacaagcccaggtggtatagcctactatatacttaggctatgtggtaaagactatatttctcctaagctaaaaatctgtacagcatgttactatactaaatgttgtaagcaattacaacacaatggtaagtacgtacgtatctaaacttagaaaagatacagtgaaaaatatgatatcatgattctctgggggcatgatcatatacacaatctgttgttgacagaaacatcattatgtggcacataaatggatattttttcctatggatataaaaatcatatatatttgacactttgttgttgttaagttaggtaattaggtacacattttccattcagtgtttttttgttttttgttttctacagattcctcactgggctttatttttctaggtaaaatttataattagcttgtaaattataaaataaattccatctggtacgttcaagatgtttgtagcaatggcctcattcataatagttaaaacctggaaaccacccaaaggctcatcatcaggatatacattcatataatgtgatgcttttcagcaatgaaaagaatcaagtccctaatactcatgacaacatgaatggatcttaaaaatgtggagtgaaagaaagcagaaacagatagcacacacacacactcacacatacattgcacaatacatagtgtgtgtccaagaacaggcaaaattagtctatggtgacagaattcagaatgtggttgtctctggagtggaggtagggttacagaacagagacatgagcagtgatgtgctgttgaatgtctaggctttaaaatatggatatgtgtatataaatgtttattaaaaattttactgatataaaaatatgtagcaatatttacacataataaaatatacagtgctcttctttgtaaatttcatacagcctgtaaactgtttttgctgatgtttactgttctctggtatctgttgatattattgcaattcaaccatggctagacaaatagaatcgtgtcgctacctgttcatgtttgtcccagtaaatttattgtcattaaatctggtatttgacctactgtaaattaccacactctctcataagatacattcattaagctgaaatctcattcagctccagaattaatttcaagttaccagtgtgatgtttaactgaaggtggagttaagacaagatacacagtgacacatgtatgcacgtcctccatagaagtgtagtatatgtcaataaccttcacaccatagatatggtaaaatgtagaaaaacaattagaaatcaagaaatctagactatttcctttttaaaatgtttatttaatattgtttctataatttatttatttttatcattattttttttttttgaaatggagtctcactctgtcgcccaggctggagtgcagtggcttgatctcagctcactgcaacctccgcctcctgggttcacgccattctcctgcctcagcctctcgagtagctgggactacaggcacccgccaccacacccggctaatttttttttttttttgtatttttagtagagacggggtttcaccgtgttagccaggatggtctcgagctcctgaccttgtgatccacctgcctcggcctcccaaagtgctgggattacaggtgtgagccaccgcgcccagcctatataatttaatttttaattatttccctgtttaacaacatgcttgtgaaatgcctcaaatattaacaattgttcctgataagctagtactagctaatgtcaacctctctgcagtgatagtcatattctgtaacttgttttgaatagtagttatatgggtgtattccattatcaaaatgtattcagtttaacagacacaaaaatacatgtcaaactttgtgttagacttgcatttaatatatatcttttggaaaggtgagaggagaaacaacatctttaaaatattgattcttttcatccaggattatgatatgtctgtctttttatttttattaacgttgtaaaatggtatttttctttgttcattgtttattttctttttcttaacgtgccagctggagaactactaatgtataattatctttttatcctactgagttttctttataattttaagactccttggttgattccttgattctcttatctgccaggttgattgtcatctacaagtaatgataattttatatctttatacacacacacacacacacacatatatatatatatatatatatatatatatatatatatgtagttcctctctcttttatttgttttgggatattgttttcccatggtgatttaagtgagaaatgtcattctaaaatttgggcatcttgaattgagaccaaagcatgagttaatcctggatgaagcacaaattatagtgaaatcttttatctttgtccatagttattgataacaatttttttgattacatttctttacacattctttaaatctttcttaacagactgaatctcagtttaaaccagcatagtccccacagtgctttctgcaatgatgggaaggttttatacctgtgcagtccattaggttattcaatggccccatcaggcttgtgcacaaagtaaatgttgcttatgtgaccgaggtattaatattgagcataattttatttattttcatttaatttgtttaaatagccacaactggctaatagctactacattagataatgaagatttaaacacttgtatgtgccaagaggctattgccaataagttaaaagccccttggtcatagagcctccatagtaaatctacaactttaactacaataacctcagctttatctttctcactgcagcttttacatgcacctttttcaaggatacagtcaagatttttctttggtaattattttggtttgttttgtactccttgataacactgtaaacattctaatatctattttattcagaattcccaatgcctatgactatattgaaagagttgtaagaaacgtagtctcttttcctgcctcctggaaactgggctaaaatgctgacatcaactcatttggcaacttgatatataggaggtcctctttttccttttatgactacagatttggaaacatcttcataatagcacaatcaaaactctgccccctcattaaatttacacaagcaagttatcaacaaccaggccttgtcaatgaaagatcactatgaagccataaatgtgagtatacgatttattgtaaaaataagtaagcagtaatctgctaaactctggtctttaaaataaaggaagattttgccaaatatagatgggctgatttctaacaattgtaaattattaatccttgataaagtttcccctataattgaaaattttacctttcagtttaccgcacatagtactgaagcacataccctctataataatataagcaagcaaaacaaaatccataaataaacaaatacagctggaagtggtggctcacgcctgtaatcgcagcactttgggaggctaaggcaggtgaatcacttgagttcaggagtttgagaccagcctggacaacatggcgaagccctatttcagccccttgggaggctgaggcaaggagatcatttgagcccaggttgtggagcttgcagtgagccagattgcaccactgcactccagcctgagcaacagagtgagagcttgtctcaaacagaaacaaaaacaaaacaaaaaaacaaaaagtacaggtaaatgaatatggtcagaatctattttttacttcctgtatctatatcctttgcaatgtgacttcacaaatgttccctcaaaaggtgacatctgttttcttctctccttgcataagggctgtctttgactaggtggtagaggcagacaggaagtgagctagttctgagtctgtgctttaagggtccttgtgtgcttttgcttgacttcttagaattctgctcagccacaatgtgaagaaatccaggcgaccctgctccttacatgaagcagagatcagtcatttcaaagctgaggtcgctctagaccaactaaccttagctgatccaacagcagatagatggtaagtagcacagaagcgtgcaaggccctgagtataaggctctttgactagtacatagcacaccaccttccatgaagtaggggctcaataaatactcactgaatgaataagtgttgttcttttgcttaatcttccacttgcacatagaataaaacccaaacccataccatggcctacagggcttgcgtgatataactcctgtcctccaacttacaactcatctcacactcctttcagccacatacttctttacctttccattctcacttctgaagctttttgttgtttaccctgcctgtttgtgtagttggaaccacatcatgaccctattctcatcttgaaaagcagaaagtcattcccagtgataagctcagtacagcaaagccactccttggtcaatatcatgttattttcttttcttctttagacatcttcttaacacttatccttattaaaacaatcttgtttcttgtcttattgttttagtatttgtatcttctattagagtgtaagctcatgagaagaaactttttttttttggttatcttcactatttcataaactgcactttagcacttagaccaggaaataacacttagtaacaaaagtacgtaacaaataaatgaacaagcaacatctaatttccccaactgatagatgaacaaaaacccaatatccttaattaagtattttctggattaattattgctataacctctaacatcagagattgtttctgtaacctaagcttttaagttacatgctcccaaccctctattatcattgcatcaaataaattaaaagaaaaaacccctttagagcaagatagactagagcagataagagttgtcaacttaattttgtatgattagaagaggatagccaagtggcaacagcttagcaaaacaaaaaccatgacattttgctgtcttgtcggaagatagaaaagagaaaaccaatttatgcagcaggatctattaaaagcttcataactagaggttccagatgcctttaaacgattgtgggatgtgtgtgtgtgtatgtgtgtgtgtgtttgtgtgtgtgtgtgtgagagagagagagagagagagaaacggagagagaaggaaagaggtataaaagcaggaggattaattaactatgagtgtgaagtataagaagtagttagatccccaaattttctctctaatttcccacctagtgaacgtctcccactccaacaagccttcccctgtacacgtttactgtttaagtaaagagagaaaatttactcctttgcaatgttgaagctaagattctctaaatttggggaccgtgggtacagcaaagagtaagagtgagatactctatttattgattgaaagcacatccataatggtaagaaacaagtccccttccttgttggctttcagaatgctgagttagagttctgtctctaagattaagggttggaggagctcttttgggagaatttcagcagcccaagagaaaataactactcttatcaaatcaaactatgcttaaacacatcagttaataaggcttgaacaaacagtttctaatcagctttttattatcacacgctaaaatatgaactggcagccaataaatagttgacatttgaccaaaacttctagcatatgagacagatcaaataaccaagaatagtctcagaggagaagagattgatgagggagagaacacaaaatattatttaattctatagtaattaatttcttcagatgaatactaacaaaacagaatagtttttttgttttgttttgtttttgtttttgtttttgtttttgagaccgagcctcaccctggagtgcagtggcatcatgtcggctcactgcaaccctgcaaccctgcaaccctgcaacctctgtctcctgggttcaagcaattctcctgcctcagcctcctgagtagctgggattacaggcacccaccaccacagtcggctaatttttagatttttagtagacacggggtttcatcatgttggccaggctggtctcgaactcctgacctcaggtgatccgcccgcctcggcctcccaaagtgctgagattacaggcgtgagccactgcgcccggccaagaatagttaaagaaaaaggttacttgtagaaaataagaaagaccttttagtaataagatagtacaaaataactacaataataatttaaaacagaaaatatttaaaaatccattgaaattcagacaattcagttggggaaatttccccaaaaggagaacaaaaagatagatataagtcaataaaacagaaatataagttactggaggattagatcaagagattcactatccagctaacataagtaaatacatagaaaatggaaagtggaaatgatggacaagagattaacaaaaaaattagaaaaatttttagtatcacaagacatgagttttcagctttaagaataattagcttcattagtcattccacaatgtatatacatttcaaccataatgttgaacatgaaaaaataagatatatgtatatataaacaaaaccaaaaatctaattatgaaatttcaaaacatcatagagcagacattaaaaattccagagagatgaaagaggtcagaaatcacaatgctgtcagccttctcgacaaaaaaactgaaaactagaagaaaatcgataaatgtttttaaaattctcagacgactaaatttacatgtaaaaccaaactatgaataaaatcatttgcatatactgtgaatgcaccctttctcaaaaactattcgaagatctactctaccaaggtaggaacatacctcaattaagaacaagacatggaatggggaaacagatagtccaacacaagaaagaaacataggatcttaaggtaagaattgattgattcccaggataactgctgggcagcaggcttagagggtagtcagcagtaatagagcagaaggatgcaaggtgccaggagaaagacttcttagtatgtgttaccattttgagaaatgttacagagttttaatacaaatgtaaggcttaagtcataagaggtctattgagaactaagaaaagtataaaagtgggtaacctgtattggcaggataaaaggaactggagaagaaaagaaatgtaatcgtactttgctcagctatcaccaatattaacagaattataataatgggaacaatgatcattaacaagacacatgtattattatattcagaggacgggagaaggcaatgaatgtttgtcgaagagaaggagtagtgaaaaaatcaatcctcaccttatacagtaaccacaaaacatacataatttttattttacattttttacagatttgacagcccccccatccccaactcccctacccttgactgtttgtcctggggtatgctaaatgtgcaggtttatttagtgaaaatcaatcaaagacacaattcatctgagacattgcatcacagatgcacatgcagggactgatgaaaatgcttcatgcactgtatttatttcaatttttcacaatctgttgaaatatagcttgctaatgagggacaagcactttgaccatgctgaggtgggtgaaacataataagcatatcatgtatcatgttgcatacatcatgcactgtaaggtaacatcaataaatcacttattatgtatatctgcctgtttcaggccattgtagccatcctgtgcaaaaagtccatacgtcaagtgttatttttaaaaaatgagaaataactctataaaaatgttatctaggaagatcaaaaaaaaaattgtgtgagctaggaaccagtataggagtagtatggggaatgaatattctgttttactataagcttcgtaaggactgcttgacttttaaaaaaatgtacatgtattgcattgaaaaaaattaaacgaaataaaaccaaagcctttctctttaccatatataaattattttgtaattaagtgttaaatgtgagcatgcttgtgctcacctacttagaagttatcaaatacatgtatgtttgattcaatctcatatttcaattcagtatatttttcaaactgggaaactaagggagcttgccaaggtaaattaccctagcaaatatacatttgacacatcacataatattctaaacacctcttatatctgttattttttaaattatgataaacaaaatcttattagtaaattttattaccaacattttaaacctctcctgatctagtgatcttatttcagttatatctgacacaatttcaattttaacaaaatagtagtacttatcatttactcccatcacaataccttaataatttcttgttagttttaatgattagctaagctcatgagcattaaatataaattacattacaaggttccaaaagcaggtaaaaattatcagcaacaaaagtaaaggcccaaatgggaattaagcaatatcatatttttcctcaagtataggagtatctttaattctctttagacttgatataatgaggtaaactctatacaaataaaaagtctctgaagtttcctttttctataaaactcacacaatatagaattctctccaacgtatttaaaaacacatacttttatagtatgggataagcacatggctcttctgagagtaaaagataataaaatgtaaggtattatttgaaaaaaaatgtgcctaacaaaatttttcaaatagactaccataaatgatatatatcccctaaaaggaaataatatggtatccaaaattataataaaatagaggtttataatctgttgttataaaaagccttaaataggcttcaccaagaaatgtgtactattcaatatgtgaagaaggatatatatttaaaagtaaatacactaaaagaaaaaaatacaatgtaaattgcaaatttctcggtatgtatatatcacatttttatgactctgtatgtgaaattaactcaagccacctactgtattgactttattgatggtaatttcttatcaacagcatgaacaactatgtccattattcaaaatgtcagtgataagtcaaacatggaaaaataagactactggcccaaatatcattttctttggctttagttttacttcaaacattgtatagaccaatccagtaaatgaaaaataaatcctgcaggcttaagagaaaataacactctttcatgtaaatgagaaatttcctttggagtagtagacagcagaataaaatattgataaaagcgggggttctagtttgagcagacctggtttgggattccagcttgacaagtctctacccatgcacacttcaccactcttatttctcatggcctagtgctataattctgaactatatggacaataatagtaacctgctgaactctgctgtgtctgttgaacaactgaacaatagcaatggggctattttatatagtgtttggagtaacaaattaagcattttatgaaaagcacttataacctagtgcctgtccctatagcatagtggagctaagtatatgtcagtaatctaaattgtattcaatattgctatatgcaaataaagtgtatgagaacattaccttttatttgtcctaagctcattctccttcaaaaagatcacagattaaaattttgatttatttggaatagagttattaatttttttaaatttccaattaggagttgcaatattatttgattattgcataatttatacaaaataacatttagcatctatatacacacagacagtgacatacatatattaacacaaaatctcagcactcaggctggtgtaatactcttcttcagaggcttgttagtgatttataaagtaacttaagcatatttaagtaatatttactcagtggattaagcaatacattttgactcatatcacatatttattcatgtgtttaatacattaacatttattgtgcatgcacagggtgccacacatgcattgaatataaggaaaatatgaagacagagtttgcaaagaaagcagggtataaaaggagatttatagaaagaaataatcggcagaggtatatggaacttacagagacagcggacagtgttacttctgtctaggagaatggaaagtgtctcagtgtgatgtcatgttttcagctaaatctttacagataagtagaaaattttatgctcgatttgttggtggctggaagtaactgtaatagaaagagagactaaaattggaaaaattatggaaaccagaaaaagtgaacagtataattggagaataactcagcatacatattattacaaagtggcagaagctgagattgaaggggttgttaatggtcatacattgaaaggccttaaatgcccaaccagatattttagaggtggaaaagataattgccttttcctaacactggtgggcttacaagacccccaaaagaaatatatgtagagatacagagaaacagtgtaatttacttaaagaattacatataattcaatatttgtgatatatagacaatgaggtgaagaataaactaatatacgtagccagaatatagctttgcatctctgagaaatatggtgttttagcacataaatgatggtatcttaaatagggtttattggtcgcaagcaacaaaaattgaatctggataattcatccagaaaataaacttgttgaaagagattgagaagttcctaaaattgctaagaaatctggagaacttttgttgaaggagaataaaaccaatgtaattcttgggatgtgggtcccaggtacttacaaagagtcttgcatactgactcccgaataatgtaaagtttaagtcattgttccatttagttcattattcaaagtaacaggagttgttttgagtaaactacctagctaaggccactaagctaatcctttgagaatgcattcttgcttattatttcatcaaattacacaaaatggagatgatcgtctaaaacaaaattggcaatctattccaatgaaatgagaaatgaatgttgattccagaaattagcaaatttccattaaggataggaaattattgtaagctttgaaacaattaaatggcatgatcaaatttgtttttagatggatggctgtcttgcatggatcaagaatagaaaggaagagtacacaatttctaggtattcaaattgtcaaatgaaaaggtgatgatttttaccaagacagtgaaaaagatacagctatcttgtgacatctttgaaataaataaatcttaaattacatatcaaaaataatttattactaaattctcgatatttgcttactttttcttttttctgtaaagaacaagtagaggaataaaataatttctataataagattaataataggaagggtaattatatttccattgtttggacaatatatttaattctgtcaaagctgtgccaggtttacaaagagtttgtcaactttatttttaacaaatgtagttatataatttgaaacaattatataatccaaaccaactttatatttatttagatgaaggtctatttgaccctattccatattgtaacactgtcaaaattatagtctgtgttttgttgaattttagatatgtgaagtttaatgaggtagatgttaaactttttttaatataaggactcatatgttatatttagatatcattgggagtaattttatcattcaatttgtaaatactttttaaactttataatattcagtgttaacattcatggaataatattttgtggattaacatttaaaaagtgaaaatttgttagggagaaaatatgaaataataattttggaaaagctttattcttgtagaaagttattttataatattgcatacagaataatataatgtataatgtttttcaaaaaaagttacaaataatctgtgttaggcagaatctaagaggatccctaacatttccccacttcctggaacttacatctttgtacatttcctcctactgagtgtaggctgaacccaataacttgcttctaatggaatatagcaaaaatcatgggatattacttcaatattaagttgcagaaagtttgtaacttccaattgggatgctcattttatttcactctcttatcttctatgatcaaagccagctgccatgtcagtagatgtctaatgggaagtcccatacataaggaactgaagactgcctccacttagtagcaagagaggaactgaaccactctgcccaacaatcctcaaggaaacggatcctgccaacaatcaagttacataagctccaaagcctagtctgtcccaggtaagccttcagataaaataggagcctcagctgagatcttgattgtggccttttggaatgcattgatctagagaaacttcagtaacctgtgcctgggcatctgaagtaaactatgagatagtaaatgttcattgctttaaaccactatgttttgggacagttagttacttagcaataggaaactaatacacagatatttggagaaaatattgtctcataattttctttacattaaaatgatgttatacttctgtatatttatagagataaaaatatggtatctatactacttctatattaactaaaaattgttttgacatgatggagatacaattaaatagtcttggattattaaaataaacatgctttttcaataactttcacgtttctcctttatatacaaaagcttttgctttatcaatagctttgcttttactttcagttttgtttaaccgtggaaaacacttttcggtgtatgtttaactgcaaagttatttctacctcacaataattagatgctttactgctaaactggttagtttttagagataaaacttaaactatttttagattcataaagcacatgaagaataagaaattatagtaaatgcatgagagtttagacataatataatcaatatctcttttttgcatagacatgtgtcataaggataagaaaaataaagtcaacttcataaaatgcactgattcatttttttactcaaatatttgagtaaactttaccatttttttctcctaacaatctaccagatttgtgcttttctaatctcctccctagatatgcaaattataaaagcacagtgaagagagagaaagtgtggttttgacaccttactatgttggtttcatgccttcatgagcaattcaccagatgtaaagcattggaatgaataagataaaagcaacataattatttcctttattttcttatgagaaacaatatactatagtgctttgtttctcaaccattaataaataagataatgtatactgttatccacaatgagaccacccccaaaaatgattgtgacaaaatgaaaataaagaagatgaacgagtatggatgaagccaatattaaaacttcactaaacacaaaagctcagtctcactcatcttatattacctgaaggctatgttgatagctatgttgcgaagaggtgggcaggtgaggatggcttcatcagtaagtatttagatgtagtctttacatatacacccttcccctcttgacacgcacacccattaacccacatatacacacatcaaattaaaatctgaatgaaagagctctgagtttcaaatattaaatcaaccaagtgtaataggattccacaatctagaacttgttaatagttgaaatctaacttttctttgacatgaaagttacagaaatattgtggtgttgctaccaaatactcaaaaacaatgttttgtaagagcagatcttcatatttaaattaaaaaaaattaaatattcatttttaatgagttaatatgaaaaatttaatgaaccaataagtacagatttgtcattttttttttctttgagacagggtctcactctcactcaggctggagtgagtggcacaatcatggctcactgcagcctcaacttcccatgctcaagtgatgctcccacctcagcctcccaactaatttttttggttgggtggatttctttttgtagaaatggggtctcaccatgttgccgaggccatcctcaaactcctggcctcaagcaatccacctacctcggcctcccaaagtgctaggattacagatgtgagccaccatgcctagccaagatttgttatttctattgagatttctgataaaacatgtattttgagacaataaaattctaaaatatttgcctaatagaatcacacttttttattactcatgaagtccacataattttacctaattattacaatgagagtggtaataaacattagtacatcgttcataaatatgtcaaaagttttatatattatttttattatcacagctgatcaaagtatatattattatttttctaatataggaaaatggtaatgcagtaagattccataatttttccaaaatttacaaaaataagttaaaaatccataatgaaaaccctgccatgtacagccacaaagtctaggtttgatataccacctcaatataaaagtcacgaaatccagttttaagtcggaaagaagtgaaaaaataaggagtttggcattttaaccaaattttaaaatatatcaatttctgctttcatattataataatttaaattagcaaccacagtggaatttaacaattttatacatgggtaagtcaaacgaggacatgaaagtcattataaaatggataaatttatgttaccagttagactcagtcaagtccaagaccctcctttttctttctctttgcctcatattttctcctagtaaaaatttccattcgtaacttagtcctttgattcgtcaaccctaaaaaatatggaattatcttccaagctgtctttgtactttataaaccactgatttacaccttaaaaatcttttatttgtctacttttcttaaagtccatacattcttccccagaaagttctcattcaatagaaactaaatttaagataccgtattatgctatgagaagagttctcattcttcctagcaaatgcaagtctatgctcacattgcccaaacttcacattcacccagggaccataaggaacaataagaatcttctggccaggagcggtggctcaggcctgtaatcccagcactttggaaggccgaggtgggtggatcacctgaggtcaaaagttccagaccagcctgacctatatggtgaaaccctgtctctactacaattacaaaaattagccgggcgcggtggcatgtacctgtagtcccagctacttgggaggctgaggcaggagaattgcttgaacccgggaggtggaggttgcagtgagccgagactgcgccactgcactccagcctgggcgacagagcgagactccatgtcaaaaaaaaaaaaaaaaaaaaaaaaaagaatctccttccattttctgactggaatgttagtttaaaatttaaagtatagattacctttaatgtaaaactgctggaacacaaagataatagaaaaaaagacatttgaagtctggatcaccttagtctacctcctctttcttttattctctgtcctgctgttttttttcttaatttgaaaggtagttataatattcaataacatgcagtgtttctgttgagtttgaatagcttgatttaaatgaagtatctagcagacgtcttgttgcatattagatactcagtaaatggtaaccatgagtattataattaaataagcaccttcttgctctaattgtactggaaaatgcctcttcaaaattattcaattcagacaaattagaaggaacattagaataatgtctacagaaatattccctgggatgtggttgaaggtaaactgagtagaacaagagacctttctgaaaatacatacacttacacccttcaccatcataatacaagtggtttgattcttaattgctcagttaatgaggtgagcaacaggaagtgtgcatttaatgagatatactaattttcaaatattgagcaatttgtgccttattaaacattaatagaaatgcccatattgctaatcaaataaaatatcataaaaagaaatgaaattcttccacaaattaagttacaattctacattttaaaggcaaaattcattctgtattttgaaataatactgaacattcaaaagttggcgttttcctattaaatgtacctagcttttatatgaatcaaaactatacatatgatggaaaatattagctataagtgtacatcaacattaagaacattatatttatacaattggtaaatcatagtgcattactatatgttttaaaatacaccacataattctgataaataataaaataaaatactaatataattgattgctgtaataatttaaaaatatttgcagaaatagattagcttggtagaaatgtaatatagtatttctattcaaaagtcacgtgtacgcatcactggatcttattttgcaacagtactataaagaatttgggcttaataacatatcaaacaggctagtgtttgatgtcattttaaaaaactataaatttatgtattacttgcaaacatgcagaatctaacaaatcattttctcagtaattcatttctttttaacattagaaaagtttaaaactttgtcaggtaaacaattttttagatagactttgagggatgaaatcggctgcacaatgcactatattggtagagctttttatatatttggttttctgaccgctgggatttctgtgttgaagaaaaaacagccccttcttttacttaaagacaggttatgagctaatttgtatttctagctcagaattcttggccatttttactcactcttcatgtgtatttcatatattatctttaaaactaactttaactcataaagaatacaagaaattctagaatttgaagtatctttcagtctttccattttacaaatgtgaaaactgtgttttaatgaatttaaattacttggtcagtcactcatactgttagtaggagagatttcagtagattatcattatttgtgttcattacaatgatttccttcttagtgcaaagagatcattctaaatttgatgctgtataattctctatattcagaaatttggctacttacctaaacatcaaacaggaactattattattgcacaacttttaagggcaacctgattggatgatacttattatgccttatttttttcctctgaaatgttattttgttttaaaccaaaaaatagaaaaccttggtagattgaatgcattctgtagatatttaagaaatattttcaatgtattggaattcaaaaaaaaaatggaacataacaacacattatataaactattttaatattcaggatgtacaatattaaattataaatatgatcttttttcttgatgaaaattaaaatgactaaaatttagcttttagttaccactttgaatacaaaagagaccgtacaaattcaagtctttttatcatttgaatttaaatacacaacctgcagtgtgttaaactgataaacacttaaaaattatatacgtgatttttgacctgaaataagatttaacttaaaaataagctttagtttatctataagacttcatgcattcatattttcttttttttttttttttttttgagacggagtctccctctgtcgcccaggctggagtgcacagtggcgcgatctcggctcactgcaagctctgcctcccaggttcacgccattctcctgcctcagcctcccgagtagttgggattacaggcacccgctaccacgcccggctaattttcttgtatttttagtagagacggggtttcaccatgttagccaggatggtctcgatctcctgacctcgtgatccgcccacctcggcctcccaaagtgctgggattaaaggcgtgagccaccgcgcccggccgcattcatattttcttaaggaccatatccaatactgagaaaattaagtgctaattagttaagaaaataaaacaattttttgaataaaatatatggtttaatgttgaaacaattgaccttgaatcaaccaatgatagcctttaacaagaccacaaaagtctcatttattaaacaaaagtgacacttctaaattactttgggcagaaaataatttatttttatttccattttatttttaagttcttgaatcacttttttctcttaatttatatatatttttaatttttatgggtacataatcattgtatgtatctatggagtatatgtgatgttttcatacaggtgtacaaggtgtaatgaccaaattaaggtaactggggtatctattgcctcaagcatttatcacttctttgtgttaggaacacaaagtacttttgtaagcacaattccactcttttagttattttaaaatatacaatgaatattgttaactattttattcattctatatattttttacttattaaccatttctactttattccccactccccactacccttcctagcctctggtagccaacagtttactctttatatccatgatttttatttattctcattttttatttttagcttccacaaatgagtaagaatatgtgaaatttgtctttcggcttgtgcttggcttatttcacttaacataatgtccaccagttccatccatgttgttgcaaatgacaggatttcattattttttataaattaatcatattccaatatgtatacgtacaacattttctttatctgttcaaccattgatggacccatagactgatttcatatcttagttattgtaaataatgctgcaatgaacatggtactggcataaaagtaggcacatagacacttgcaacataatagagaacccagaaataaatccacacatttagcagtgatctcatttttgacaagggtaccaagaacttacactgagcaaaggatagtctctttaataaatggtgctagcaaaactggatatccacatgcagaagagtgaaactagacccctcttgccatatacaaaaatcatatcaaaactgattaaacacttaaatctaagaccttgaactatgaaactagaaaaacactggaaaaacattccagaacatttttctgggcaaagatttcttgagtaatacctcacaagcacaggcaatcaaaccaaaacagacaaatgggatcacatcaagctaaaagcttttgcacaacaaaggaaacaatcagcaaagtgaggagacaacgccttagaaaaggaaaatgtttgcaaaccactcatataacaaaagattaataagcagactatataaggagctcaaactatctaataggaaaaaataaaataatctgactataaaattggcaaaatatctgaatagacatttctctaaagaaaacatacatatagacaagtatatgaaaaaatattcatatcaaaaaaattctaatcagagcaatgcaaatcaaatctacaatgagacatcacctcaccctagtaaaaatagcttttatccaaaaacaggcaacaatgaaggatgtggaggaagcggaacccttgtacactgttgatggaaatgcaaattagtatacccactgtgaataacagtgtggaggttcctcaaaaaactaaaaatagaactaccatatgatccagaaatcttactactgcatatatattcaaaagaaaggaaactgatacatcatagagatatcagaacctcttgaatctttcttcatttagtcaatattacaaatttgtatttaatatacaaagtagtatgacatgtctatactctatcattgattctaaataattttggaatttcatcaccctacttttatctactcaacaattgtgccctctaccccaaccaacaaaattattgtccatttaaaaaaccaacaaattaaataattatgcatgctaaaatataaactgctgttattattttcagaattgtgtttagtcttgcaacatcttgacattgtgaaacacctaaaaatgaaacacataatgtattactaatccttcttccatgcttagatgatttctaaagacctatcaatacaatagatgtaaaataaatagttttgaaagatgtatgagtgcatgcagatttcttttactgttctgcaaaacagttcataatatgtttctctgtttcttactgatgtttttatgacagttcaccagagctcttgcatttttaacatgtatccttattcgccttattactatacttttatttttattttaaaataagtatgtattcacaaaaattgacaaaaataatctagtgtttcttattaccaagcattcttcaaaagtgacacattcaaaattatagtgcactctcaaaaccaaaaaattgattgttataatgcacatctagaattgaatattcatttttataaaaactgttttaagaccgggcacggtggctcaggcctgtaatcccagcattttgggaggccaaggcgggcggatcacgaggtcaggagatcgagaccatcctggctaacacagtgaaaccctgtttctattaaaaatacaaaaaattagccaggcgtggtggcacacacctgtagtcccagctactcaggaggctgagacaggagaatcgcttgcacccgggaggcggaggttgcagtgagccgagatcgtgccactgcactccagcctgggcgacagagcaagactccatgtcaaaaacaaacaaacaaacaaacttctaaaatatggctcttcagcaaaaactatcactggtttaaaattttctcatttattactgcatgcttatctatcttcctcattaacctgcaaatgttgctgatttgagcatttatcaccattaaaattaagttattttgaaccacatggtagatttccctctcattttgaatttatttattctttgttaaatgccctttcttttctttctcactctgtcgcccatgctggagtgcagtggtgtaaatgcagctcactgcagcctcaacctcccgggctcaagtgatcatcctaccttagtctcccgagtagctgagaccacaggtgtacaccaccgtgcctggctaatttttttgttaatttttgtagagacagagtgttactatgttgctcaggctggtctcaaactccagggctcaagcaatcctcctgccttggcctcccaaagttctgggattgcaggtatgagccaccacgcccagccactttgtttaatttctggaccttctcataatcttattccttctataattgcctccttctacttcattttcttcatcaaaagcacaatttcattcttattttacctggatttctattctgtatatcattaacaagaaaatagtattcattagaaaccctaaaacttttctgagttagaacttatcacaaatagattcaaaactcataaaacgtgttaccagtgtttgtctctgcatgagagtgaagtgataaagattatgtggtttatgttcttcattggtttattgagaacacataatagtatttttgtagataagccaagataatccataatatatatggaagtatataataaaacatagactgcacgtgcacatgactagtgaggaggcagagtgattatatgaaattttaataagtccaactattagaaagaatgttatttcttcttagtttccaaccactggtgttgcttcagttcagtgtgtcagttcctatgggtagctgcaagcatatatcagcttgaaatgattatctttctctctgtgcagcccacttcctgcttgtatgtgcaaagatatttgagaatggatcaatcccaactataatactgtgtgtactatttaaattggatataaatagctaatgagactctaagttgccactgctttgcttgtaaatttatattagttacagaactttgaatctgttaaatcagagttttggtttctacataagaaaatagccttttctaaaatcaatttaatgtgtaaatatatagtttttgtgtttgctttcctttcatttaaatgagaagataaaatcacaaactgtcggccaggaacagtggctcatgtctataatcctattacagcttttgaggaggctgacaggcagatcgcttgagcccaggagttcaagaccagctagggcaacgtggcaaaaccttgtctctacaaaaaatacaaaagaaaaaaaaagtagctgggcattgtgatgcatgcctgtagtcccagctaccctgggggttgaggtgggcggatcatctgtgcccaggaggttgagccgtgatcccaccactgcactccagcctgggcaacagagcgaaactctgtctcaaaacaaaacaaacaaacaaacaaaaaaggcacacactgttagtaattaagtaatgatgaattcacaacttataataggttgaaggagttaaaaattaataatgaagactgctgggagaaaatgatttggaacatttggaataagttttaacagatattttttctagaggaaatggaatagagaccttacagaaaattttgcttatagattttttttcaaaacaactttcatttatgataggaaataaaacaactaggagtaggcaaaaagaaaacaaagaaactttgtctgaaaaggaagtttattccccaggatagtctatcagttagcagctatgctcataatgagcataatacagtgcattttcatattccattgaactctgcacagcttcccccaaacacacaacaaatgaacaagagtagaactgcaggcttttatttagttcaatattgcataaatattaaatgcagacagggaattgcaaatggcaaaaggagactctactgaatgtaaattgtgatgaaaataccatggggaaataatggtcccaatttgctacttagaaagaaaatttatgtgaataacaagaccagactttccaaaaacctccatttaatggttatctaccacattctgttgttacagaggttttgttgttcaatttctttacttttcctaggatggttcacattgatgtttctcctggagtgggttcttaccctatcctaaaatgaaaactacacatctactcagtaggaaccagtgcatttaaagccatattgtgttctgtgactagcacaatgcaaggacaaaataaatgttaaaaatgaataattaactgacaataataatcaacattctggctttaaaaggctcccagaaacagtctctctaaagtgagctctcagtgtctcctttatttccaaattcagaacagctttgactcaaatcactgaacattgggcatgaagtaccttcctgaatttattcctttgtttagaagaaatcatctgtatcttattgtctctctgaatgctaaatgtgaatggctacttctcacttagcttgtcatttgactctgtaaaataatgtaaattcgggttataagtgtttctttataaaactttgtagtcttggatatatgtctggattttatatattatataaaatcataatattttctttcaaaaaatcattaatgtcaattaaacatcttcaaaataagaatattctgataatttgtctttagttctctttagagacttctgaaccacattgatctggaccaaaatggaatgtgatgcacaatctcatagttcgaaatgaaaataaaattctactttccatttccttgtcaaattgttttctgtgtcttgcactgcactacagtggaatttttgtcatttctgcttgtcttttatttaagctcattctttaatactttttttagtagagtgaaatatttgccaccttctctagtgttaaaaaaaataagctagaatactaacatgtatagacctctagaaataatagaagaaaacagtttcccctctacttgaaccaatgttccccagaatatcttttctaaattaaaggaaatactggacaaacatgaaaattcctaaaccccatgtgagatttatggaattcgtatctctgaaagaagggcaagaaaatatgcagtcttcacagttttctgagttgttctgtgtgtaacaactgaacttatacacacacacacacacacacaaacacactgaatttcaccatcctccaccagaattttctagttcctcacctcctggtattcttgggaacaactgatatcaaagcattacaatataatcttgagttcccaatggaattcactaacatgagatacattaatgtcagaatacaggaatccattaatttctattagaaaattatttccagaatctagtatgtgcagaaatgtagctgttaatataatccaggcagccatttcattgaaaaagtctgaagaaagttaaatcactttatcgaagatatggtaagtctaatttttgctgtagattaacatccttcctaatgatgaccttattttttgcaccattattgttcccttaaataaatgatacaaatattctttctgtcttctattctgaaggttcttcttttttttgaaccattgctatctttgaaatctcaccagttttgagaagttactcatgcaaaagttgaaaatcaaagtggttttgcatgagtttaaaacacaaagctggtagtcaaagaaatcaatcactttttagagtgtatcatgatgtgtaaagcataaaaatagaagttactgcttcagttctattttctagaagtataaaacatgagtttaaagataaattctcttcacttgtcttcacttagaaacatttgctgtaatgttttgaaacaagatcctcaacagaatttaatagaaaacaaacgttgtaaatgtgaaagtggtagagatggaaaatacaaaacaaagtaattaaaaataactcaaaaaaacagaaaacacccccccaaaacatcttatattactgtattattgtgttcttaactaccattgagctattgaaatcaaatttcaatgttgtatgcttatttccatatttttattctgacccaagctatggaaattcagtcttcttcaactagattaaaattcaaactgccaggtcattcagaaattgctattcctagtatctctattaaaaatggattatgttcttaaaatccttcaatgttggagtatttctgaaccctcaaacagaggcgaatactctggtaattacttcatatatgtggtgtccaaaaatttgcccaaaatcccagaatatgtatcagaagagatggcactctagtcaatatgatcaaccctattagatctaatgcctggccccattgtaatattttccccagcactctatgatagatagcataacacgaatttgtgaagattattttccacttctcaaaaatgctttccttagatcagagtagacagcaaattcataccaaagcctcagaaaactaaaccaaacagttctatgctggcagccatgcctaaaaggctgacttagggcagatgtgcacttggcaatcagtacttggctaaattactcagttcctggtgccatgataataccagtatcctacacagagcagcatctggaaaatcaataaagcaaaccaaagtttgcatcaatggcccagaaataggtcttttatcactattttgctgttccagccagtagctattcatggtgactttcttcaattaagagataagagtaaggacaagcataaattttagaagtctcaccataatcggctatgaataaatatcaagctaattgaagatttttttgcatgtagtttcttttctcatctaggttctagacttgctttcacagcactctgaatgatatccaatcagatatacatggatatatgaatattgttgctttgagaatgaaagataatattgagaataaatacacgttatctgtattaggcaaagtatatgagggaggagtctgaattactttcattttctcagctaattttccagtgcctaagtggaaaggctcaagttgcaaaagaataatgaataatataacaacaaagcactcaaattggaatttaaaagttctcaattgtagaaatattggatttatgacctaatgggtaataaattccaatttaggaaacttttgtttctaatctaactgtattatgtaagaaaagaaaatagcatttcaaggcaacaaggtacgcaagccactgtatgtactcagacttatgctcatgtgtatcaggtgtcttattcataaaagttagagatcattttgcaaaaaatcatttattacagatgaacttagtggagaggttaagacatttgtaggtttatgcagagaagatctaacattcttttctttttagttatcattgtttcaattttagactaaaattatattttccttgttatatattaaactgcagaggaaaacagcacaaaatgcaaaatatcccctttggtctaaactttcagtgctatttttcttctcatataaaattattatttttgcttgatatgtaggtctctgatcctctttttctatgttgattaacatacatgagtaaaagtttaagcacaaatatgcaaacatagattcatacctaccccacatatttatgttttacacaaatgaagttctatttttgaactatttttatcttctgtgtttcatcagttgacactgtatcttagagtttgttcatgttagttaaggaaaatctttttcctttaaattgctgcaatgtattctttagtttagatttttcaacactttgtttaaactctctcatagtggccagcctataggtagttctagttttcataatgggaaaataaaactggtgtagaaatcctacgtacatattcttatgtacaagtaagactatttatttaatgtaaattcacagaagtaaatggcctagtcaaacaggccatgtttatttccaattttgaaagacagccaaatttatatctcagaagtctctgtccatttatactctgcaaagaacatttaagagagttatccagcatgttattttttgggctggaggtggcatttctgtcaaactgatagctgagttaaagcagtgcaactttgcatttctgtcaaactgatagctgagttaaagcagtgcaactttttacatgtttatcaccattataattcttttttttttttaaacaaaatagaggctaggtgttgtggctctcatctgtaatcccagcattttgggaggccgaagcaggtgatcacttgagctcaggagtttgagaccaactgagcaagatggcaaaagctcatctttacaaaacatatacaaattggccaggcgtagtcccagctacttgagaggctgaggtgggaggattgcttgagccacggatatcgtactgagcccattgtgcagttcactccagcctgggtgacagagtgagacgctgtctggaaaaaaaaaaaaaaggaaaaatacatttataggttttatttttatcctattaaaatggaatacttttataattacttattttgggcttttttttttttttacaaatagtgtcactacagaaactcatttgtttatttctatttttatatacatatatttatatgtacaattgtctttcacctttacacttgtatttgaatatatatcttattacagaggttggggctttcttaatcttttcagtgaaatctgtccattttttacatagaggtagaagagtactgtatctgctcaaatacatacacatatatatatacacacacaaatatgtatacatgtataatactatatatcagattttatgatgtttagatatcattttgaaaaaaacacttattatacatgaacttatagagaggctaatacattttgagagttgtaaagacaaattttcaggtttttgcattttgtatctgccttagaaatatatccttaattcaactattataaacatattcctaatgttttcttgttatgtttgttttacatttatctattcaattcatctgtaatgtattttggggcctattatgagataaaggccaagatgtatggaattataaatggatacgcggataagcatccaatagatatgaataaaaatatttagtattgtaaaaatgtccccttttttttgagacagagtcttactctgtcccccatgctggatttcagtggcctccctgcaacctccacgtagttctagtgattcttgtgactcagcctcccaagtagctgggattacaggcctgtgccaaaatgccctgttaattttcatattttttgtagagacagggttttgccatgttgcccaggctggtctccaactcctggcctcaagtgattcccccacctcagcctcccaaagagctgggattacaggcatgagccaccatgcctagccaattctttccaaagtgatctatagatttaatgcaaccccattcaaaatgtcagtgatatgatttaaaggacttgacaaattgatactaagatttatatggatgagggagagtctagtacagccaagtcatatttaaagacacatttaaagacaatgtgggcatgtcataccttgtgataaaaaagttgtaaatctataaaaagacagactcatttggaagtagatagataaacaaacgataaaatcaacaaacagagacaccaacctccgtatatatgaaactttatagaggcgacatagtataatccgagggaaaagcaaatgcagtagagatcttgttgttagtgtgggaaaaatgaaataaaatggataatcatcttacataatagcaatcatctctagatagataaaggacttacatatttaagtcaaattttaaattcttggaataaaacataaattaatattctgacctagtggttggaatgtatcactaaaatatgacagtaaaagcactagttatagacaacatgctgttcatctacctatatgtaattacaatttctgttcaatatttaatactctaaaaagggaaagacaatacaaattgggagaagacatttacaatacatgtagccaaccaagagttaatgtacaacttagatgggtaaggaaaagcaaagacccagtaaaaaagggaaaataaaagtaattatcaaacacaatctgctgaatatcccaacaagcaataattttagtataaattgcaatcttctaattgttgtattagtaaggtgtgacatgcaacactttaatatgtagtagtaataatgtgtctaatatttccatgtaaaagttaacaaatatatgttacacttgggaaaataaaataaatattgtcatgtaattatatatgtatcatatatataaagaacaagtaattaagaaattatatatgaataatggttttattatgtcatgttttttctggtttattcataatttaaaagaaagtgcagattttagacaaaagaaaatttcagtttatattttcatctctatttaattatatcttgaaacaaaatattttggtcatgatctctagaaaaaaaatcacatttttattaattaaccccagtaatccactggtgcatggatatatagatagtttgtaatgaagtctctagagtctaaaacaaatgaacgtaaattttaaagaagtaattttgtttttcttattctgcttagaccaaaattaatggtattttaacttaatttatttaatttatttatttattgagacagagtcctgttctggagcctggagtgcaggctggagtgcagtggtgcaatcacagctcactgaaacctcaaactcccaggcccaagtgatcctcccgcatcagccttccaagtggctgtgactacaagagcatgctactatgactggataatttatttattattttttgtggagatagggtctcacttttttgccctggctggtcccaaactcctgggctacagctatcctcccttctcaacctcccaaagtgctacgattacaggtatgagacactgcacccaatcataataatatttttaaaatatcagtcagacccttgtaaaaaaaaaaactagtcaataccaaaatgacctaagaaatttaaataaattcttttttttttttttttttttgagatggagtctcgctctgtcactcaggctggagtgcagtggtgtgatctcggctcactgcaaccttcacctcccgggttcaagcaattctcctgcctcaccctcccgagtagctgggattacaggtgcccgccaccacacccagctattttttgtatttttagtagagacggggtttcaccaccttggccaggctggtcttgaactcctgacctcgtgatccacccgcctcagcctcccaaagtgctgggattacaggtgtgagtcaccatgcccagccaataaattcttattggtactattccactatatgttctttttgctttctatacatatcataaatattaaattatcaatattacaaacaaataatgctcggtaggaagtatttatattccctatgtttgaaattatcttacttgtttccattgcactattatggagacaactgacaattcacatgcagttgtaggaaaaaaatacacaaagatcctgtgtaccctttactcaatttccccaaaaggtaaaaacttgcaaaaattatagtacaatatccaagatattgtatcagtatatcgacattgatacaatctataggtcttatttaaatttccccagttttacttgtactcatttgtgcttgtgcttgtgtttgtgtatatttagttttatacatttgtatcatatatgtagatacatgtatctaccaatatgatcaagatactaaataactatatcagtataaggattatttttattgtctttttgtaactacatccacatcactgaagcaatcgtactccaccccatccccaccccagtcctaaaccatgtcaaacagtaatctggtttttctccatttctataattttgtaatttcaagaatgctataggaaataatataatatttaaccttctaggactgatattattcattcagcataagtatgtgtgtcaatattttgttcctgtttattgctaagtgtcccattttatgaatgtaccatcgtgtgtttattcactttttgaaggacatcgcctatatttttagttttgggctataacaatgaaaactgctatgaatgttcgtgtacaggtttttctgtgaacatagtttaaattctctgtgatgaatgtccacaggtccaattgttgaattgttaaaatttaactctgattaattttttttaaaaagttatttttgtcaggatacactaggttatgatgcagtaataaacagtcatttattttcaaggcttaacaaaatgatacacaatacatgtccaaagacagtgagtaggacagatccgctaattgagattactcaagaactagggcaaatgtagggtgtagtcaaggtttacttgtcaaaacaaaacaacaacaacaacaacaaaaattggctactggttcacaaatcccagaagaaacctgatatatttctgctcctataagttcagaaagcaacataagggagatgaggaagtgctcaaacaatatttttgaatagcagtaacaatcattcattgtcgaccaagctttaaaaaattattcagatttatgtttgtcataaaatgatatttgttccaccaaaaaggtataaacacttggtagcatttcctctcctgtgactaatgagccttttacagagttataagcaaaatccccaaaacattcagatcctgacagagatgtattttctcgggcaacagattacaccctacccaaataggagtgcaaataaaaagctgtagcacatccaaccattcttcagttatataaatcaatacctgctatgtctgtgccctagatgtaatcctgtcttagaataaagaggttattaaaaaatggaatatccacttactcttcctttttaaaaaatatttaattattatttatgttaatttcccaaattataaaatattggaactgatcacagtacttaaatagttctataatattttcatctatccttagaaatccaaagtttttttcctataattaagcagttaagaaatataattcaacatttaattgagtaatataaacattaattagctgagaaaactcacgttgaggagtctaaaatattagtgaaccaaaaataaatccaagggccaaggggggtaaagtgataaaaacctagagcaagttagctttaaaatttgaaggaaaatgtttcactatatcctcagaaaaggtaaaagtcatcaataaaggagactaatttaagctcaaaggaatgaacacacacaaacacacacatttaaactagaagacgattacaatttagtcactaaagaaacctgtaaaatatattttaaaaactgtctaaaataatgatattcatcaataaatatgtaatttcaacattcagctaaaggagaaaaaaattttctaaaacaaaataaatttttgtccaatcatgtttagttagcatagaaggtctggaatggttgtgatgacattttattaaataaggcaaaatttaagtataaatattgagggtcatgatacctgtttaatttctcactattatgaagtttcaattatttgtagagtcatggtctccatctaatggattctaaacaattcaactgaggagaaagacaaagacagaaacagagagaatggagagagtatagggcatggagaaatagagagagagtatgtgcgtgtgtgtgtgtgtgtgtgcgtgtgtgtgtgtgtgtgtgtgcatgcaagtaagaacttaaagtttaaccaaaccaaatatttagtagaaaaacatatttctttcttttctaaaaagctgagctggacaactcctaaaccatcctgtcgtttctcatatctgtatagtttgattcctatgctttctaaaattttactacctaagtcttggaattcattcaagcttataatttaatttgtattgaattactaattgttatcatagtttaactttttaaagcaaatacaggaattgctgagatttattgagaatgtaactttactaatacagaatgggatagcaatgtgccattgtgcattttaagtgaaccataataagttttttttttcttttttgttctaggagaatttgaagctaaatttcagaaacatataaacctattcttgtaaagtatatggctcattcagcaatgcacataaagctgaatcactgaagtatgctgattgatcaatacagtttgtggctacatttgtaaaatgggtaaaaattaaagcatttcactatttggttcagtaagttgagtgcataatggttcaaacagtattttatgcattttaagtcaagcacattgtacactgcaaagtagtcaaccgtgaaaacattcaatgattaggtaagaatatcaaatttgaaataaaattagtaatttagacagataattacacaaaatgctggtgagccactgaatttcttttatatgtctctatcctttaaaaacgtttagtatctcagcatcttttatacacaggtcttctttgaaagctacttgattgttactggtagaaggcatgaaaacgcatttattacagttgtaaaatttataacatatgatagcaatttataagtttgatgcatattgatgtaacttaaataactaaaatcacgctttaaaaatctggttatttatatgtatgtctaaaaccaatagttacttccaataccaagaaattataacatggtacataataaggtaggtttttcaaaagagactcaactccttcagttgattttctatgtggttatggttataaaatggatgtctcttttgagtgagggttttggaagaggctatttttttagggactatggttcagagacaccaaagtttcaattacagcagcatctagaacctttgacccaaaggctctacctggaaacattggtaataagagcaagatatcttttccagttgcaagctgtcagtggaaaggtgagtaacagaccaaagcaaaagaggattcaattgaacagaagtttataatcttctactatttggtcaagacaggacatagaaaaaaatatatatcaagattgcctttctcaaggaacctaccatttttgaagaaatttaatcttacctacaaaaggcaaagcaatatgagatattaaaatataattgtaattccctaatatctgtaaaagcaacaggtgctatgacatttcataaatgggggaggctttgtgaagcttatgtaatttgaaatacaaataagattgcgaaagaagaaatgagcagcatctgcaggtcttaacattgctatggcaagaagacaagaataatagaagtttcaaattcaagttgttttggaaacagtttagtcaaccttacatctcatgtcataggaattgtttaaaataattcagctagttagcttaagtcttttctttttttttttattatactttaagttttagggtacaggtgcacaatgtgcaggttagttacatatgtatacatgtgccatgttggtgtgctgcacccattaactagtcatttaacattagttatatctcctaatgctatccctccccaatccctccaccccacaacaggccccagtgggtgatgttccccttcctgtgtccatgtattctcgttgttcaattcccacctatgagttagaacatgcggtgtttggttttttgtccttgtgatagtttgctgagaatgatgatttccagcttcatccatgtccctacaaaggacatgaactcatcattttttatgactgcatagtattccatggtgtgtatgtgccacattttcttaatccagtctatcattgttggacatttgggttggttccaagtctttgctattgtgaatagtgccacaataaacatatgtgtgcatgtgtctttatagcagcatgatttataatcccttgggtatataccccgtaatggaacggctgggtcaaatggtatttctagttctagatccctgaggaatcgccacactgacttccacaatggttgaactagtttacactcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttcttcatgtgtcttttggctgcataaatgtcttcttttgagaagtgtctgttcatatccttcacccactttttgttggggttgtttttttcttgtaaatttgtttcagttcattgtagattctagatattagccctttgccagatgactagattacaaaaattttcttccattctttaggttgcctgttcactctgatggtagtttcttttgctgtgcagaagctgtttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagagatccagtttcagctttctacatatggctaaccagttttcccagcaccatttattaaatagggaatcctttccccatttcttgtttttgtcaggtttgtcaaagagacaagatggccgaataggaacagctccagtctacagctcccagtgtgagcgaggcagaagacgggtgatttctgcatttccaactgaggtaccgggttcatctcactggggagtgtcggaaagtgggtgcaggacagtgggtgcagcacaccgagcatgagccgaagcagggcgaggcatcgcctcacccgggaagtacaaggggtcagggaatttcctttcctagtcaaagaaaggggtgacagacagcacctggaaaatcgggtcactcccaccctaatactgcacttttccaatggtcttggcaaacggcacaccaggagattataacccgcacctggctcggagggtcccatgcccatgaagcctcgctcattgctagcacagcagtctgagatcaaactgcaaggcggcagcgaggctgggggaggggcgcccgccattgctcaggcctgagtaggtaaacaaagctgctgggaagctcgaactgggtggagcccaccgcagctcaaggaggcctgccagcctctgtagactccacctctgggggcagggcatagccaaacaaaaggcagccaaaacctctgcagacttaactgtccctgtctgacagctttgaagagagtagtggttctcccagtacgcagctggagatctgagaatggacagactgcctcctcaagtgggtccctgacccctgagtagactaactgggaggcacccccgagtaggggcagactgacacctcacactgccaggtactcctctgagacaaaacttccagaggaatgatcaggtagcaacatttgctgttcaccaatatccactgttctgcagcctccgctgctgaatacccaggcaaacatggtctggagtggacctccagcaaactccaacagacttgcagctgagggtcctgactgttagaaggaaaactaacaaacagaaaggacatccacaccaaaacaccatctgtatgccaccatcatcaaagaccaaaggtagataaaaccacaaagatggggaaaaaacagcagaaaaagtggaaactctaaaagtcagagtgcctctcctcctccaaaggaacacagctcttcaccagcaacggaacaaagctagatggagaatgactttgacgagttgagagaagaaggcttcagacgatcaaactactctgagctaaaggaggaagttcgaacccatggcaaagaagttaaaaaccttgaaaaaaaattagacgaatggctaactagaataaccaatgcagagaagtccttaaaggacctgatggagctgaaaactacggcacgagaactacctgacgaatacacaagcctcagtagctgattcaatcaactggaagaaaaggtatcagtgatggaagatcaaatgaatgaaatgaagtgagaagagaactttagagaaaaaagaataaaaagaaacgaacaaagcctccaagaaatatgggactatgtgaaaagaccaaatctacatctgattggtgtacctgaaagtgatggggagaatggaaccaagttggaaaacactctgcaggatattatccaggagaacttccccaatctagcaaggcaggccaacattcaaattcaggaaatacagagaatgccacaaagacactcctcgagaagagcaactccaagacacataattgtcagattcaccaaagttgaaatgaaggaaaaaatgttaagggcagccagagagaaaggttgggttatccacaaagggaagcccatcagactaacagctgatctcttggcagaaactctacaagtcttttcaattcatcatgctgcccacaatatgctatagaagattagcagttaaagttggacaggtaaaatatgcctagatttttgcttggatttaatcttatcattggaatttgctataggcttttagaaataatagggacatgagaattggagtattttaagaaaactataattgttcctaaaagggtttaagacaaatggagattactgataaaatattaattagtttttgaatgacccaggcatgagcttatggagaactagaactaggtaagtattaattaactcttgccctaccctaatggaagaatcatgggaaggaggtgcaagacaccagaggtggccagcatataaagtcctaggatcaaatttaaattccacatttgtccttcaagttgcctgcttaggtcttgtccaagtgtacttttctttctttctttcctgttctaaagctctgaaacttgcttcaatctctttttctgccttatacccctcagttgaatctttttcttctgaggaggcaagaattgaggttgctgcagacccatatggaagattcagtgaggtgagtttgctttgtgcagaaaggggatgcttagcataatagtataaatgctaagtataaatatttatatttcatataaccactgaatatttaagaggagatattgtaactgacccaatagtttcatagacaggattttgtttgtctgctttttttttttttttttttttaataaacagatattgacctttctggtctgaaagattgaaacttacatttgttttatctgagtaccttcttcaactgtaaccgcagggcctctcaaaaagtatcaaaaaactgaaactcatcagattatagcatccagacaatgagatgtccctcatttgtcatgattgcttccttactctacccaagttcctgttttctcatacatagtttcatttcttccctgctatataaatccccaatttcaattggtcaggcagatggatttgagactgatttccctctcctcatctgaagcactgattaagccattcttccttggcaaaaatcattgtctcactaatcagctttctgtgtggctagcagcaggacccagatggtacccctgctgtatcagtaacaatgtcaactagaaagttcaacacaagagtctttgcttcaggaggtctagtagtatttgaaaaatgagccaagagatacataaacatataaaagctactgaatgcataggacaagaataaatctgatagaaaattataaattaaaaaaattatagactgatccccagtcttggaaagggaaaagaaaatgggaatgcaaaagtgtatcagaatctaagtaaagaaagtatttcaagggacagggagtggttaactatgcctaaaaatggccaggccactgtgtaagatgatccgaaaggcaatcattttatttgggaaaatggaagacttttgcaattttactatcagtcaactggtgaaagactctttggagtgaattaagaataggaggagacctgaggacatgcagatagcaagtatacacattttaaaaatagtttagctaggctgggcacagtggctcacacctgcaatcccagcactttgggaggctgaggtgggcggatcacctgaggtcaggagttcaagaccagcctcaacatggagaaaccccgtctctactaaaaatacaaaattagctgggcgtggcggtgcatgcctgtaatcccagctactcaggaggctgaggcaggagaattgcttgaacctgggaggcagaggttgaggtgagccgagattgcaccattgcactccagcctgggcaacaagagcaaaactccgtctcaaaaaaaaaaaaaaaaaaaaaaaaaaaaaaaaaaaaaagtttagctaagaagagaaaaacagaaaatgtaaagaactagagaaggatataagaaatcagatttttgaaagatggttaatggtataagtttgttttaggctaaaacagataatccaataaagagtgaaagacagatggagctggagagttaatttgagtgaaacattgtggggtccaaagcacaaatggagtggtatctgcccttctcggtgacagtaagaattgtttaattgtttatccattatatgtgaaaagaagccagaggatactatgagtacagatactagtgaggagtcattttcaccatgttggtacaatttcatattctaatttgattatttctgttttcttactaaaaggaagccaatgaagaaggaagcaaatatagaggaggaaaggggataaaaggaagaataatctcagaaaaggaagatagagatgctggtaagcaaaaaaagagattacctattacacatagaagtaatttgtacattattttcgagaagaaataaagttttccaaaattgattaaaagaaaacacaactttcaaatactaataaattagtcaaaaacacaaaattttatgtttctatttttatatcaatgtttccatggagttaaatggatatagctaatttatacaatcttaaaaaaaagaagattagttttactggtagctgacttcattaaaatattcttcttaagccatttgggaggcaaacctctaggtaatattacaggatgttaaagtcatttaaatacaaataacgtatgccatatttgcatttaacaagttaacccaagttcatcctacctgtagggcttttaaaatgttataaaaagaatagataagcaaaatctttctttaagtattatacttcaattctcaaaacttaatgtgaaatgtggaaagacaaatgccttttctttgatctcggttggaattttgggctgaaatccatatttgtacctgatctgtgaactgtgtcttgtataatgaacagattcatggtgaaatcctttgggcttgttagctttttttctattgaatagtgatgcttctggggtaatgtgatggtccacaaacaccaacactaaaaatgaaatttttagatggctaaaaaacaagaaacagaacagtgaaatagtatacctggccatgttattctttccatgcaacaaatcaaaattctttaggcttcatttaaagcagcaaaaggcagcctgattaattcaatgtatgcctcaatgatcctcagccaaactcatggttgtgacatatgaaatataattggtatgagttgaaatagcctgtcttctttcagtctttcataataatcctactgtgttaaggctaacatttcttcataataatatcccattgattggtgaaattttgtacatgaggaaaaaaggggcatgaaatttagggcacagccatcatgtgtggccattcttgtactgttgtttgagtgatgttaaaagggtaatctgtcttgaaaacatttgatgtctcaggtgaacgcctgctacccccagattcactatgttataccaatgtattagcatgtatttgtgtattgcatctccagaaagccaccactgaaatgttaacctgttcatcagtgacactattaaacaaatacatccatataattatataaacttagaggaaatgggtcaagaataacccattttgatctcccgagaatcattcttggaaggttccttagatgactattcttaatttcaaaagttcaaacaaattttgaaacctctattcccgaaagaacaaatctgagatgggtaataagtttttctaaatcatatttaaaaagtaaattctagacttatatccagaaactatgtgtgtcttacgtcattcactattagattgtctgttattcccttggagtcaatgattaaaagccaattgttattgcactaacaacgaaggaaaacttggtcctcagaaagccaaaaacaaacataacaaatatggaaagcctctaatttctgcatgtcatctcaaattccatttcactgctgggagaaagaaagaaagagaagaagagaaaaacaaagaagggagggagggagggaaaaaggaagggagggagggaaagagataaaggaaaggaaaggaggagaggagagaagagaagagaaataaaaaagaaaagaaaagaaagatgaaggaaggagtgtgaggagaggagatggggggagggagggagggaaagggagtgagaaagaaaaaaggaaggaaaacaaaaggaagaaagaaagaaaggaaaggaaggaaggaagtgatatgggaggggggcaaagaagtcctgggtagagaagggcaggtccttggtgagggcttcacacctgggcctatgcccatggatctagtgacgacaggcatttctgtttttgtgcctaaatgttgcatttcctaagaccaccctggcccaccatgctttcatcctgtgcttataaaaacactgagaccctagcgggcagagacacacaggcggctggatgctgagaggaacacatcagcagaggaacgcataagcggctgaatattgagaagaacacatcggtggaagagtacactaacaggcaccagcagatgccggcaggccatcgaccagcagaacaatgcagagtttggccaggatgttctaaggagagcccggccactgagcagcccgactccagggaaaaaccaccttcccactgcatctcccttctggcttcccaatctgctgagagctactttcactcaacaaaaccttgcgctcattctccaagcccatgtgtggcctgattcttctggtacaccaagacaagaaatcctggggaacagaaagctctctgaccttgcaataagacagagggtctaattgaattcactaacacaagctgcctataaatggctaaactgaaagagcacactctaacacacgcccattgggacttcagctgtaaacattcacccctagatgctgctttggggtcagagccccacagcctgcccatctgcatgctcccctagaggtttgaacagtggggcaccaaataagtgagccacatcccatcacatgccctgtgatggggatgaggcaacttttcctgtttcgactgggtctcatccgggatcctggaaggtgaatacaaatgtgaaactatagaatcagtctctgttgtaaaaccctggcacttctctctttttcctgcaggtaagaggctctctttcccttcacgaagttttaaaccatcctaaccggtctggtaaaaactcccagacttcacctcttttctctcttttatggtttgaaatggcttttatctcttcctttacaatgttaagggatttgctacaggctgtggcaatgttactaggtaaaatgagcatttcgctcagcagccaagggtgcaaatcagaccacctatgcctagaggtgccacctatgcctccaccccaacagccgcaggcatgcatgactcagggcatctcacctttccctttcccttcccagttcaggtgcctgggcttgtgcacaacttgcaaagctcgcacccagcagccacgagggggagagggagaaagccctggtggtagccacaaccccaaagggccaatagacgggctcttctcacccaccaggccaacagaatgtttctccactgggggaaggatgtaaggattagagggactcacttgcactgaggaagaggctctttccccaggatctcccccttttgctctttaaactgtattttttaatttattttattttattattttatttttttgagacggagtctcactctgtcgtctgggctggagtgcagtggtgcgatctcggctcactgcaagctctgcctcgtgggttcacgccgttctcctgcctcagcctcccaagtagctgggactacaggcacctgccaccacgcccggctaattttttgtatttttagtaaagacggggtttcatcgtgtttgccaggatggtctcgatctccggacctcgtgattcgcccgcctcggcctcccaaagtgctgggattacaggcctgagccaccgccccgggcctgtttttccttttctaagtgagggggctccccactcccagcactgtttctgattgggaaattaatgcaggagtgacccctgctggctgataactgcaaattcgtcagggcttatttgagacactctaaatggataaaaacagcccctaaaataccttttcaatccgaagctcgattccaagcttctttttaagggtaaggccctagaaagaacaaccaggtctgaggcatccaaagccaggccacaggcacaatataaatgggcaagaccaattcttgccgattaaaccccacccccaaccccacagaaggaggccttgcttcatggcataaacaggcccagggaactcacaggttgttggcagcaggaaaaacaggaggcataggtgaggccggtcaattcctattctccaggttttccctgcttcatgggtacgtatcacatcagtacttatggccagcacctgccaaggttgccaggcctcagggatgccaggtggaagggatagggaggacgcttgctttatctctttatcacaccctgggttttcactgaaagaaagaaggaaatgagggacgcctctattccctgtctttcagaatcagtaaccagttctcttcaccacccccagcttatactcctccggagtgtgtcctgaaccactgggactgttttgaccctcaaaatctgaaggaaaaactcctcatagccttctgcacaaaggtttggccaattatgatttacagcaaggaattgcttggcctcaggaaggaaccattcattttgagaccctttggcagctggaacttttctatacatgtgaagacagatggtctgaggccccatatgtgcaggctttctatactttgcaaggcaatccagacctttgccaacagtgtaagattgacccagccctcctgtttgctgtctcagggaaggctgcaaggggcaagcccagggaattaaagatacaaatccgaggcactcccagttgagaagccagctcccaccagccctgctcctctgggtccaccctgacttccctatccactttcagcttctcacttgccccctcctagaaatcctcaccctaaagaagccccagtctcactcttgcccctccaacagatgcccagtaaatttgggaccagtaagttccaggtcctcttctcccaatagtacttaaagcaaatcaagggggatcttggtaagtttccggatgaccatgatagatacagagacgatatattgtgatagatatagagatgtatctctatgatatatatatatatatagacatagagatatatctctataatagatatagggatagatatattgggtgaaattctggaatttcacccaaatatttgaaatctcctggggagacgttatgtcatttttgaatcagaccctgatggacaatgagaagcagtacactctgcaagcagcagagagatttggggatgcactttgcatcacatatagcatcagggaagggggcaaatattatgcaactggaagataagcagaaccagtgaatgactctaaatgggatcccagtgacaagaaggaagacactttcaggtgtttataatggagggcttgcacaggactaagaccaagccactcagttaggctaagttgttcattatcgaccagggatttgctgaaaaccccactgccttcctggaaaagctaagagaggccttggtaaaacacacctctctatctcgtgattcagtcaagaaacagctaatcctaaaggatacatgcattactcaggcagcccctcatatcaggaggaagttccagaaatggccctgggaccagatatacattagagagcctcctgaagtggccacttcagttttgtacaatagagaaatgcagacccaagaaagaggcagaagctttaacgaccatcctgcaagccctcaaacagggtgcacctattaactgctaaagatacggcaaaaacagttagctgtcttctaaagtttaaccactcccatagaaggtttaatacctttcaccagggtgaaacacctcagggtacaatgttgctgttactatatttcacttcttgtctctgtaatctttggcactaaattctttccttgtataatacacatgtttaactcatgcatacttaaccttataaaactttttttttttcttctcatgcctagaagccataaaactccaaatggccaggcaattggagccttggatgatagctcctgtttgctagaaacccttagatagacccctgggaggaatctcactgctgttctccccaaaacaacaccccctgtcaccaggaagtagcttaagactagtcatcatccatattttaacagcagttagatgtacctcttcagaggggggagatgacacaggaggggagcatgggtagagaaaggcaggtccctcgtgagggctcccatgggcctgtgcccatggacctaggtgaggacaggcatttctgtttttgttcctaaatgttgcatttcctaagaccaacctggcttgccacaccccatcctgtacctgtaaaaaccctgagacccttgcgggcagagattcacaagcagctggaggtcgagaggaacacatcagaggaagaacacgcgagtggttgaacatcaagaggaacacactggcagaaaagcacactgacaggtactggcagatgcaggcaggtcatcgaccagcagaaccacacagagtctggccaaggtggtcagaggagaccccagccactaagcggcctactccaggggaaaaccacctctgttcttgcaataaggcagaggatctaattgagatgactaacacaagccgcctatagatggctaaactgaaagagcacattctaacacatgcccactggggcttcagctgttaacatttacccctagatgctgccatggggttggaaccctacagcctggttgcttcccctagaggtttgagcagcggggcaccacagatgcaagctgcactaccatcgcatgcactgtgaggaggacagaggaacttttcccatttcaaaaggaaggaagaataaaggaaggcagggagggggagggtaggagaaggagagacagaggggagaaacaaaaaaagaaagaaatgtatacacatacacacacacatatatacatatgtataggcattgttaaagatatacatatatctacttttctctgtttatctaactattatctatctatccatatatctatctttaatgttgaacctctaaagatgaatccttagatgtgtcattgaagcatttaccttagtgaacagcattgcaatttcagataattgtttcatgtaattattgtgttaactaaattaaactttcaattaatttttgacatttaagagaagtgtatgtcagcaaaattaagtgcaggttagccaaactaggattataaaaaccaatttgtcctttttatcaactttttatttcacattacacaaaattcatgttaggtgcttttgtggagtggttttccaaataaggtggtgggagaggaaaagttgtctttggtttcctacagtaaagtagcctataacaatgtcccttttcatatttattcaaatgcatgtttttcttattcaaaaaatgtcaaacaatatgtttcaaaaatggttatgacttcctgccttcttgtttgggcaaatacaaataaaacatctaaatttaagaaataggattgcagtatctaaaacaagttggacaatgaatagaggtttttgggatttcctttgggggaatggaggaagaaagtatgagacaggttccacagaaatcaatgcctaaaaatatattggtgtcccagacacaattgaaatatagttgtccaattgtcatgtctcactcatccttaaaaaaataaagcaaacttcaagtttaatcctttttattgtgtctgaaattgattatggaacaactgaataactatgtgctagcttgcgtattgttgtcgtgcactgaaagcatttcattgttataactctccctcaaagtatcaattaagtatcacaaaagtaataaagtaattactacttctgtgctatttgtattaattacaattattagtactgctttagtcactttactctcacagttacccgttgagttatgtactatatcattttacttacaagcttagagagaataaatgatttgctcaaattctgctagacactaagtggtggagcttgaattcaaacatagtaatatctgactccagccttctcactcccaccaaccccacatatgtacacaaaaacacaaatacatacacacaaaatcacataccaaaatatttttaacatacagatttatgagataatatggattaattctcaacatatccaaagtgatttcagtaaattgccatcttaaaatattaggactttaacatatagttcatattgttgacaatggttgctttcaaggaaattagcatatatggaggactggtgatgaagagtatgttcaccttttactgtattaaattcttctacagttcttgaacattttatagtgaatatatatttaattgttacttatgtaaaacaaacataaaacaaatttttaatataaaaaactataagaagttttgatgtgtcagtgacctaagattttggaattataagtcactaaaattgaatctaatacacagttggcatagtgtttgcaagttgaaacctagccatctctggaaatataccagaattcattactgaagtgaaaaattttaatagtgactagatatcaagatctcattttttcttactattatggaaagaaataaaagtagattagatgggagacaaaatctacttaaaatccagcagacatcaaaaacttaatacaccatgattaagtaggattaattcctggaatccaaggctggtccaacatatgcaaatcaataaatgtgattcaccacataaacagaattaaaagcaaaaaccgtatgatcacctcaatagattcagaaaaagctttcaacataatccaacatctcttcatgataaccacaatcaaccaaccggacattgaaggaacctaccccaaaataagaacaatctatgacaaacctgcagccaacaccatatggaatgggcaaaagctggaaacattacctttgagaactggaaaaccacaaggatgcccactctcgcccctcctatttaacatagtattagaagtcctagacagagcaatcaggcaagagaaagaaaaaaaaaggcattcaaataggaaaataagtcaaactaactctcttcactaaacatttgactccatacctagaaaaatcctaatgaccccatcaaaatgctgctagaatggataaaagattttagtaaggtttcaggatacaaaagcaacatacaaaaatctgtagcatttctatacaccaataatgttcaggctgagaggcaaatcaagaacatgatcccatttacaatagctaaaaataaaataaaacatctagaaatacagctaaccaaggaggtgaaagatctctacaagtagaactgcaagacacagctgaaaaaaaccacagacaaaacaaagaaaagggaaaacattttatgttcgtggattggaagaattaatattgttacaatggccatactgtccaaagtgattttacagattcaatgctattcctatcaaactaccaatatcatttttcacagttagaaaaaaaaattctaaaattcatctggaaccaaaaaagagcccaaatagacaaagcaatcctaagcaaaatgaacaaagctgcagacatcacatttcccagtgtcaaactacactataaggctatagtaaccaaaacagcatgatactggtataaaaataagacacatagaccaatggagcagaataaaaaacttggaaataaagttgaacagttacaactatcagatctttcacaagcctgacaaaaacaagcaatgaggaaaggaacctctattcaataaatggtcctgggttataactggctagccatatgcacaagaatgaacctgaccccttaccttttaccatatacaaaaattaactcaagatgaataaaacatttaagtgcaaggcctcaaatcctataacaaccctagaagaaaaccttggaaatacccttctgaacattggctttggcaaagagtttgtgactaagtccccaaaagcaattggaacaaaaacaaaacaattgacaatgagacctaattaaactaaagagtgtctgcacagaaaaagaaaatatcatacagtagaccgacaacctaccaaatgggagaaaatattcacaaactatgcatctggcaacggtctaatatccagaatctgtaaggaacttaaacaaaacaaaatgaaaaaaaaaaccaaataactccatttaaaaaatgggcaaaggatatgaacagacacttcgcaaaagaagacttacaagcagccaatgaacttgaaaaaaatgtccaccatcactaattatcagagaaatgtaaatcaaaaccacagtgaggtaccatctcacaccagtcagaatggctattgttaaaaaaataaaaaaacaacagatgctgatgacactgcagagaaaagggaatgcttatacactgttggtgagaatgcaagtttgttcagccactgtggaaagcagtgtggagatttctcaaagagcttagaaccccattctactctacaatcccactactgagtatgtacccaaaggaaaatagatcattatattaaaaagacccatgcactcacatgttcattgctatactattcacaataagaaagatgtggaatcaacctaggtgcccatcagtggtagagtgaataaagaaaatatggtacacgtacaccatggaacactgtgcagccataaaaaagaatgaaatcatgtgcttcacggtgatatggatggctctggaggccataatcctaagcaaattaacacaagaacagaaaaccaaataccacatgttttcattcataagtgggagctgaacactgagcacacatggacataaacatgggaacagacactggtcactaatagagaggaaagggagagaggtgggcagggggtgaaaaacttcctgttggttactatgtttcatacctggatgcaatatatccatgcaacaaacctacccatgaacctcctgtttctaaaatataagttgaattttaaaaaagacaaaaagaaaaatctaattaaaaatattttaaaaataatttctccaattacattttcaggtaccttcatgaattaacttattactttttgccatagagaaaaaaaggatttttttctctgatggttgaaaaagggtagttttacatcttctctaatcagatatgttcttaaattgaaaagagaaagggctatgagcaatgaacaaaaataaacattgcaaaggtgctttacaaaatttgctattttgctatcaacattttcatatttaattaaaaagactagtggaccacacaatttattgtttgtagcttccagcaaatacgggacagcaactgggaaggaaatagattattttgagtgtcaggatcagacagattgaagcagtggtcactcctgtactcatcagcattgtcctcttcctacctttcccaaacactgtggtactaggtcttggtactctggcctctaccttcctcacctgggaaggctttttctaaagctcagacctccccatctccaagcagcttcccgaaactgacctttctaaattgcctatcaaacattttcccacaagagatgcaaattttcattcactaattttgcaaatatgaactaagcatctcttataaaatgttttctaagagaaaacatggataaaaacctaccatttagacaggagtgacatatggtatttatctagaataaagaatttatctagacttattatgcagtaataacacctgctgcctgaaacagagaacgaaaataagccacgagtttgaggaaataaatatacctatgtgttttttctatataccattccttatacaagagtagcacataagaatagtagggaacttaataattatccagaagcttatgccaattagaggactaaatgaaataatgttttgaatatttcaatctgaaagtgaagaaaagaacaatcaggattgaaaacaaaacaactaagatttttttttagaatatggttaagttgaaatgacatattaaattcttacgttgcctttcataataactcattccagagttcaaagttgaatatttttattgtgccttattttatttttatttatttatatttatatttatttaattttattttcttatttattttattttattttgagatggtgtctcattctgtcacccaggctgtagtgcagtgacgcgatctcggctcactgcaacccctgcctcctgggttcaagcgattctcctgcctacggacacacaccaccacacccggctaatttttcgtattgttagtagagacgtggttttaccataccggccaggctggtcttgaactcctgatctcaagtaatctgcccgcccacctcggcctcccaaagtattgggattacaggtgtgagcttctgcgcctggcctatcatgtcttattttaaaataagaattcagtctaagaattagaaggcaagatgaggttggacagttaaggacattaaagaaaaaggaagttttatgctttccctcttttttgctttacttggatggatttttctactcacaattccttctccccccagcctgtctaatgcattatatactttgagatgtagcttatttcttgtttcaactcccaaaatactccgaacatatctttactgtgtacttaacaacactctattaaagcgatgtgctgtgtgtctctgtctcccctatgagactatgaaactgtgaaaaacgaaggcagaaatcttgtttattcatttttataagcccaagcagattgttgcactgtgcctggtgatactgatttcaaagttgaatgaaaaactgtgaaagaatgttcctggcatagtgcatgtatcatatgatgtgtaagtttatttcaacttagagtgagatagtttttattactctcattttataattagaaaaataatactaaaataaatcaatgacttaatttttttacacaagagtaagtggttgaacaaagatttaaattctgggtaatatgattccaaaacaagtgtcatttcaacatcttactatgcctgctctaaaagaaaaatgaatgaaacacctcttacctagactttggtcaggcaatggccatttattattactgcttgcctttgatttgtcaagtgtcttaatataggaggtaattaagaagctattatctcctatacaaagtttaagaaactattataactggtagaatgatgacgaattccacaaactagaagggtgtatgtggtgggtgggttggtgggcaagggggtgtgtgtgactgatgtatgttaacatttctatatatagatatgtacctaagtaacaaaacaaattattttaaagctgctaagttattatcactgcttgggacatctactcactatgtgaatttacgctttctgttagaactttccttatatatcagtcacccaaatttaatttatagagagatgtagagaaattaactcagtattctgaagagctgtgtatattctcacgtacttgaggaagaagaaaatcacttgccaaataagcatataacctattatatttttagaaaattcacaaacaatttgaaacaacgatttggaaagtataagaatccaggctcaataacaaattagttaagtgtaaaagttaacacctcccacacacacacacataaatacaaggccatccatgtaaaattaatgcacaatgtgtatgtacacatgtatgtatgtatgtgtgtgtgtgcatatgcagacagtctttctgagttatgtagtcctcattattacagaatttcctctttttgtcagaaaactcccaagaacatttgttctagttggtttgtatactgagccaaaacttatgcattggaaatgaatcatgacagatgctgaaatctcaacttgccaacacatttgaaacagggtgtcctccctcagcaatactgattgaatagaccccagagagattccacaaatacaccacaggtgattatgatgcatggaattagcagaatacctcaggatagtgaatactgcctaaatagtgaggtgttttttgtttatttgtttgtttgttttggtcattaaagcatactctccctacacatttaactgaagaggaaatgatattttctctctagcaaacctgtcccctgatttgtctacatatctttcccaatgggaactaaccttaagagaaagcatagggtgtcccattctcctagatttctgttattgcctgatgactccattttattcattcatcaacctgtctggaagctgtttactcttctctcctgcttctgtccaggaaccttagtcatcactaaaactaacagcttaccacttttttccaaacctgcttttcttataccgtgtattaaaagcagtggtccccaacctttttgacaccaggaacctgtttcatggaagacaaattttccatggcggaggcaggggtggggactgtagggagggtgtgggtggttggtttcgggatgaaactgttccatctcacatcatcaggcattgtattctcataaggagcgtgacctagatcccttgcatgtgcagttcaaaatagggtccccgctcttaggacaatctaaaaccaccactgatatgacaggagccagagctcaggcagtaatgctcactggcctgttgctcacctcctgctgtgcgacccaagggtagggacccctgcattaaagctcagtccactaaaaaattatagagtcccatttcctgctgttttctctttttttcttaccatatttctgtgatgtttttattgaattactggtgtttttcaaactgatctttcaccattctaacatattctgacccctccataaaatgcctgataatatattttttcttcaattttgcaatctgtttaatggtattttttcaaatttattcattcataagaattatttatgttatagatgttactttcatcaatcataacttttgctaatgtcttctccttttttataacttctatttctactcccactttagtgtctcttgattattagaagttcctaaatttactgctgttgaatttatcaattgctccaggtatgatttgtactctttcccagatttaagaaattcttcccaatatctctattgcacatgtatcaatttgttcttctatagtgtcttctcgatgtgctatgggttttgttttttccactaaaatcttcaaattacataaaaatgattttttttcatcccagtgctatccttttgcactgatctacacgatctctatcatttatccgtacttataagaatttgggttggtatttgtatattcttttttgtttcattgaactttttaatttatctatacaataatttcacttagatgtaatcactatatctttattataaatcttgaaatcagtaggacttgtctctctttttttttttttcctgtagagtatttgtttcatttcactctctgaacttatttacatattgtagaatcaggttgtcaaaatccatgaaaagtcttttgggatttaaaagactagaattccattgactctattaatcaatttaaggcaagttgatgactacacaatatttattctttatttctacccaataatgaggtatataattataaatatttagctcttcttcaggtattttcaatgaagttttgtaatttattttcataaaatatatatttttctaggcatgttatcatatttttgatatgtataatgattcttatttacttaagtataaattctaactttagctggttagaaaatgatttttacatgttgatttttgcatttagtaacttaaaaaaattcgtattaattccataaatttgtctatgtgtttttttttagttttctacatcacgtgaaaataataaaaacgtaacttttttcttaaaagaacttacctttattccttacaaactcttaagattctctaatataatacgaaatagaagtagtgactatggacatccttgatttgttttggattataaagaaatactttcaatattttaccattaaatataatatttactgataggatcattgtgtacaggaatacatggactttatgaatttatggaattttcatagtatttctaatttgctaatttttttctaaatcatgaacatgtgtttatataattcaaaatattttaaaatttattgagtttattatattttattctcccttttttaatgcaatgaattactttaaacaatttttttacactaaagcaaacttaaattctggaattaaaaccaacaagtataccttttttataacttcttcattcaatatttttatattatcattagaaattttgcaagtgaatctgtgattttaatttcttgcatggtatttattataaaatttacctaatttttgtttgccccataaaatgagttgaggaaaatttattattttattattctcaggatcatttggtataaaattggacgcattatttccttaaatatataatatataatatgatttgtcttatgactagaaccttttacttactgttatgcatatgattcccataagttacccagattgggaaggtcctaggttcatttcttacttccaatgaactcagggctctcaaagcagaggataaagctttccaggttttgaaagaattctcagtatgatcgttggtctttaaagctttctttcttgagtgttcctgctttcactttgtttggaggatctacagatttcttaatgttatgttagctcttacatttatttaaaaagatatgttgtaaaatctcctacctagattagcattccagttcagagggtcattgagagtatctaatctgctatactatcacgacctatattttttctgatattacttgatattttacagtttgattaatatatatggtcttgatttccggttgaccatcagtaaataagagacaccaaaacagaaatctaagtttctttgcaacccagccagtctttttttcaggtagtttatgattagtatattaactgtatattaatttaaaagtatactcccttaaaaataaccctgtgattcattatctgttgaaaaagaggaatggtttctgaaatctatccacatttttcagtttgggcaagttagggctgttatacagtaggcacaccttagttcttgtaaatacttacaaaaattttttcttcctggattcattctgaaatatatcgcagagtagattcaagtagtgaaaaagaacctgtacaccactgtgataattcaccctgctttcctggaagcatacaaaactagtataatgacagactgctaaaaacagctaatgatctaagtttgttgttgttattatattccccaagatgtactgtaatgtagaactcgtctcagagcttgtcagctctgagatgatttttcttcactctactcaatatgtgcctataagcaacagctctattatgctgctaccattagcagagtaattaggaaagctatcatggtctcaaactctataagtgtttgagactccgcctcataaaatgtccattagaggacaaattaccacattttaaatagagaaaacaatatcttgaaatatgtcttttctgatccccactgccaatgtctcaggttttgtttactactgtttttcattattacagtcattaggactagctaagcttggaaggaatcatgttcagaatataatttttgagcattaactcaacattaaaaaaagccttgtggtacttgtctgaatggacagaaaaagatacatcataaactacatgtcaatgcagtcaaaggttatgaacagatatgttaatatgcggttgagattgcatttaacacgtatagtagcaatctccatggatagctttgctacttcaaaggaattaaacagaatagtcattttttgtctttttttgaaagggagagtaacatatcttttcatgaatattaaaaaaaagttaaaaacctaaagaatcttaagttgtgggtagacagtttatacatatatattaatttagattttcatgttttattgtaaataattattctattttccttttttgtctttcatatctgtttatattttcttttaaatagagacaaggtttctctcactatgttggtcaggctggttacgaactcctggcctcaagtgatcctcccgtctcggcctccaaaagtgctaggattacaggcatgagccaccacatctggccatatctgattttgatttacaaaattttaataagcttgttatgttcagacaatgatcagttttatccatatcaacagtaggattagcttcaataaataaagagctaaatagtaattaagataattcatttaaccagaatcagtaagaatttataatttggatggttcttatttgaaatatgcatttgtaaacttttaaagaatatttataaattgacaagacaaatgaaaaataccattgaatcagaggattatgttttgagagtttcttattcttaccttctctctctttcatttacaatttctcagacaggattctgtaattcctgacaaactgaaaagtacccagagtctgagctttcctgatagtgtacaaagcctcaggcaaacccacactctaaaacaggctgcttcaattttatactccatttaacacttcatttgattctcaaacttcattttagtctgcagtgttaacattccagcatttacgtgagttgggcaataggtgtggattcaatactcctgaaagatagtttgggcaaatctaagcttcgatgcccgagatgagtgagagccattccgtttacaactgtgaaaatcttacttgatttttaaaactaagaccataaagttacataaaagggagcctaacttcaaaaagaactgcaacttatactctgaaaataatgggagcatcactaataggtggtgcatagatcatctaattgatatgcgatctctgaggagttgtcagaaaaacagtctgtgtagtagatgtgcgtggaaattacacagatatttaaattcagaaaagtacagcaaggacacaaattttcagccttttttggaaaggagtgtgagctctgagagacaaatattggaaataaatattagatttcctttgaaatgaactttgagattctgactttgttctctcaggattgcttacatgtcttctgattaggctgacttgataagcgaccggcatacctacacagggtccacacttagaagagcctcatgcttagtttaatgctgtttcattgccatcttgaaattcttcagaattttttaacaagaagccccacatttgcattttgtattgggtcccagaaattatgtaatcagccttgtttctgctatataatacaaattgaacttaaaaatagcaatctccaaaacatcaatagaaagagatatcatttttccctggattggttgtacgattgacagaaatgggactacaataaggactgagcccatgagtgatcatattgaggtcctcatggctatttaggcttatcaaaacaaaatgctcagcaaatactgttcttcctattcaaaaccacagttttcgattttctatattaacttacagtttagttggtgagagatggcattttttaatattaggagcttttgaagttctgttttcttaaaaagtaaacataataatatccaccagcctatcagggttccacataacataagcaagatgatttattgctagacatttattttccaaaagtaagaattcaaatagcatctctttgccataaaagacaagcaggtgaacaaaagtaatagatgcagcccatttggcaaattgaaatttcatgatatagagagagctgggcaatctcctttggaagaaatgtgaattcagtcacatatgtcagtatctctcaattgcttggacaaagacaaaagctgtgctatggaaaggatggggttattttgattcttttttttttttttttttttttttttgagacggtgttttgctctgtgacccaggctggagtgcaagtagtgtgatctcagctcactgcaacctccgcctcccgggttcaagggattctctcgcctcagcctcctgagtagctgggattataggtatctgacactgcacccagctattttttttttttttttttttttttagtagagacagggttttaccaagttggtcaggctgctcttgaactcctgacctcaggtgatccacccccctcggcctcccaaagtgctgggattacaggcgtgagccaccgtgccaggcctgttgattctttataagctgtatttgttgaataatgttaaacagggagatgttgattatatctttatcacagtaatgatgatgttctatttttactgaatatactttctatgtagatagagtctagtaaaccgcattcacctagaagaactaaaactaagatttattttatctctctctagttaaattcacatttataaattgtccttttcatgaccacctcaatgttctgcttcaactcaatattaaaccatgtgctatgaaatattaatgagaaaagtcagatccatttatatttcatgctgaaatgtagccaattcttccatagtgataatacaattactgaactgattttgaagtgcataatggatttttaaaagttaacttatccataataggctgtagccagatgttatgtaagatactgatggagaaaaaagactctaatactatagcatattaacagtttagtaaaagaatatctgcaatgctatgcagccaataaatgtgtaaaaaatattattttcccccttatgtttgttttctgtagcatcacaaatgtagtttcttcttttatcccaagtaataggaagccactcagaaattcagaggtcaagtttagtgtagggcatgagaatttggaataataataacagaagaaaaataatttataatctgtcttcattttcttatttctcacttgctccactttattgcctccttcatcatttcaccacaggttttccaggggagctttagtaaactgtatactattaaatttcatgtttttttttaatctcacccctcattaccactatacaaataaaaacacattttttttttctttttctttttttaataaaactcttaccatctccgacatgagaatctctctttttctttctttgtcactggctatttctattcattttcataagcagattccgcctaccctttttattgaataaaggcttatttctgatcatttaactcttattttttcacagaaaattgtattcatcccagtgcttcacttatcatctatatgacaatgactcgcacatgtgtctccgcaccaatcatcatctccgtggatcaaatccatatattaacctggctcacaaaaacttaaattcttcaaagacagtgaaaacatatgaaaccaaacttctcactctacacaaaaagagtcctattccagaattttctcttttgataaatgccataactgtatgtccagttacagaaccctgtaatatgatatttattccttatactttctctccttctaaaacttttctaagttctatgattttgctccgaaatatttataaaaaagtctacacttcttctcagaaacaaactccttagtctaaattaccattatatctgacctggactaatgaaatagcttcataactattatatccatattgactttggctaacccttttccccagcgccaagaaagagcaatgttttaaaaatgcaaattcaatcacttaattcctctatttgaactatcaatagctacccgttattcctatggtcaagaccaagatccttaataataatactgtttgtaagactctgtacctcacttcctgacctctagccatgctgccctcctttagtgccttttagataccagactcttccacacactaagcctttgcatatgctggtttgtctatctgcagtacctgctctgccttctcatctctcattttcacctggttaactctctcttaatttccaaagctcagttcaaatatcattccttgatttaagacttcttcagttgctctactcatgactggatctattttacactgttattacactatgtcctcaaatttaagcactattcacagattgaattttacattaagttttaataatttggtgaatatatacacatatataaattatctttaataggtcaggctttctgagagtaaattcaattgcaacttatttgatgaagactttaattcaacagactttgttggattaaagtctccataaaagaagttacagtttatgtttatttacaaatataattttttgttcttataaatgattaagtaattaattaaaatgtttataagaataaattaattaactaatcaacatatgacagacaacttgcccaaactgtttagaaacatttcagtaagtttaagcgagagctttcaataatttcatcaatagatttgaaatcacctttgcaaaaattataactgagaaagttattgcagtgaaagagacctgacctaaccaaccccattttgcttctaatctccaagctgttcttgttcattcctgggtttaggcctaagtaacttttggaggaacttactttatagttgaactttgaaacaaagaaaataacagtattttcccaaaacaaacactcttcctgcctggggaccacactgcctttgcagggctaacaaattagccatgagattagaaattatggtttaggagtcatgcagctggaggctgtaagtttccaaacctccctaaattgctcctgggaataacatcagtattgtaaaacctaagatcagtgtttgagatatttcgcagaccctgcactggatgaatcagctggcaccacccagttcaataagctgttttatctggtctcgtggcccttacccaagaaatgactcagcgcacgaggacagcttcaactccctatgatttcatcttggacccaatcaaccagcacccttgactaaatggtgccttaaccaccaaagtatccttaaaaactctgatccctgaattcgtggggagactgatttgaataataacaaaactcacctctctggtacagccagctctgcatgaattaaactctttctctattgcaattcccctgtcttgataaattggctctgtcaaggcagcgggcaaggaaaacccactgggcagttacagacacagcttctttccttccttactacttttcttattactattcttccttttgtcctgtcttcctccattcttgcccacctgctttctatccagtcactattaagtacttggtatagagctttgtgcatcctagatgctcaaaaacctttgtaaaatgaattaatgaatcagaatatcaattttcatatggcttgtaacactttctagttatacaatgttaactaggttatgtttgccttctaatagtctgtcaaatagaataagaaatgcaacgtctactaaaagttgtttggaaactaagtggaaaaagaagaacaactcatagaaatactttttaaaattaaaaagttgttatagctgtcatcatcatttttgaatgtctattactatttgttctgtaaactatgcaaatcaaaattaagctctatacaatacatggctttgtatattacagtgctttagtattaaactcaatcttgactcttaagtcatttccatggagttctcttgtgaaacccagagatattgcaatggatgctttggttttcataaaattccacacaaatcccacataatacagactgctgtctatggttttctaacgaaaacatttcgttcttttgtgagttatgtgtcctttagatagctactcaggcctatgctattgaggttaaaggtcttcagagaatgcttctaagccttcgttaggacagttaaaggcagctatcccagtaaatcaggatggacagccgactgatagtatactcaatttaccttttagataaactacactgagagtaagttctcaacaggaaataaaggtgaatttcacaatgggtacaggccattccccagtgttttcacagggatttgaaaattaaaaaaataagtgagggtatgtatcactcagaatcagtgctgtattgctcaaaagaatgagttatggtcataaaggtacagtttatgcagaaactctgatataaaaaatgattctatgactctgacctttgcacttgttttctgcatattattttttctatttttcattgttacataccaataattgatttcagtcagtcactcaatctgtatttaccatagtaaaaattttagggcatattttctttactatcccactgtttgaatctctaacctgtcttttgcctttggacttaaatacttctatttaagttttcacgtcacatgtaaattaactgccacttggccagggaagtcagacatatatttatcatgggggagttacaagagcatcagaaatgaatgctaaaatcttggtgtgtatttttagaaccattatatggtttatgtagtgctaatgtttggcttcttctgaatattcatagggaatcagagtctagataaagaaaagaaatagtcaaagacggtataaacaacaaagggattctggttttgaagaaaaaagtaggggaagtgagatcgcttcaaattcttatttagagtatattaaatattaactatagttgaatagttttcttaatctctctgaagatattgagctttccatctatgttttctataattcttttatatggtaaatacaagtttaccatataaacttgtatttatatggtaaatacaagtttaccatataaacttgtatttatatggtaaatacaagtttaccatataaacttgtatttatatggtaaatataaatacaatatatttatttatacagtttctgcagacataaaatcgatttttaaaaatggtattcttccataacattatgaaccacacataaaatcaactaattttttaatatatatttaagaagtacttttatacacataggtacatatattattatgatttgtccaaattgtttttcagcatgcatattttatttaggaagatattgtgaatatattttccattaatgggcattaataacaaacatcattttctaggtttgatgatatttaacttagtaagtccccttttattagaactataggatgttcattttttttcttttttctttcttaatttatagacttcttttatgaaatctttgtttctacttaacatatttttttcttaggattaattcctatagctagcacttctgggtagtgaggtgaaatatgaaacgtaagttctcaacaaatgcttgttgagggaaaattttgaatgaacaaagaaataaatgattgtaagatgtggtacctccctggatttcatccccttctcaaagagttaatagaaaataagacacagtcatgacattaagatggttctggaatggcaagctatgactctgttttttattcaacatgaaatcatctagctgtgccaagcagcttcatttattaaaactgctttagtgaagcatatactgatatttaacctaaatttgagtacagatacacttgtgagaaaagaagttgtttcatttcttttgattttcgtgcattattcaaagatttaaacaataacagctgtgatgataaatctgaaatgttatgaacatgaaactctcattttaagattcacatgacaataagtaaagaacactcatataatacctacgcatgtttctttcttttccattaaaattatccaaactataaagaaaaatcggccttttaaaacttcacttgcaggctactattatgttacaatcattctttcttcatagaaaatgactgcattaaaaaaatactaagcaacaattacagttttctaaacagcatgctctgtattttatctaattgctaattcatataaattttactgtcagtccccttacaaagtatttgaatatgagaaatttttaaaactatatacctatacctgtttgtagctatatattgatttatatttctttgcagtacataagttattgtaatacagagtttaactttataatgaaaacctcattaggtttggtcatatctgtagctgtagtctatgagggttttttttttttggtctatgtaatttcttcattcattcagcaaatatttattgaatgccacctatgttgtccttgctgtaggtgctacaaatacaaggaaaacagcaggcaaaacatcaaacctgcaatttacacagatgtattttaaaacttggccaagtctgaggccaaaatgagcttcccatttgacctctgctgaattgaatttatcccatcagttatagcctttgcctatattttgcataatcaattttcatattgaaaagtcaggcttcttccatttccagtactcatgatgaaggatattcctctttgcatccttgcactttcttaagttttattatatatttcttttcatgcatttgtattagccaagtacagagttaatggacttactattttaggatccatttgttaaaatttcaattttcttttaaactctcaaatcacttttatgaattaaagctagcatatcattacttccttacttttgcctaaaatagggcattcatttattttatatttagaactcaaaagctttatttttcattaatacagacacacagtgctaattaataaaagctattgattacaatatcttaaatattcacaataagaaaaaaatcagtaacttcaagttgcctcagcacaaagtaatagagtcttgtgttgagaagaaggttctactcaaaagtctgtctcaagttgaagatgcaatgagtctgtaatcagtttgcttaaaggtcagccaatttaaaatttatgtgcaaattttacaacgagactttgttatattcacctacatagcccctgctcctataatatgcctaacatttaataagcattaaatattgtttaattaatgaataaatcattaaacttatatgagttggtaacctagccaatacgatcatgaaatgactgtcaattagtgatttgaaaagtgttatccttgggaaactatcttagtaaggctacacgttcctctttaatattcataaaaagaaaaggataatttcaccagcaggtggactatgttcaatgcctgagttgcattcagagtaagctagggcagtgacagtaagctttgagcactatgctagatgctgctctctctccaggtctaatgacaagtatgatctgaaaatattaagtcagcttttttcttgtgtagtgtgtgtgtatgtgtgtgttttaattttctttaattttctttctctttgatagttcaatggggaaaatactatacaaattagaaagggaagtgaattgtaaaatgtgcttagccgttaggacatgcaagaaaagtactggaatgcaaaatctcagagaccacatatcttccattccactattctcatatttcagccacaccaaattattattaatctttaaacaaccttcaagtctagcatcatgtttaggggtgtgaaaactagaacaaggctgagttcactcagctgggtcatttattaatcaaagtattgagatatatttaaaatgcaaattaatttatatatttgtaaatatgtgttgagtactgaatactgacacgatacttaatatatatatattaatttatatatatatgtgtaagattttctctaaaaatattcttctgtttttcacattgtaaaatgctactgacatcaatttttctgctttcatatgcccaggtatagagtaacggcacacgtaggctaacttgaagaaaaaaaaattgggagaaaaataatgctttaaaatttgtttatctagtatcgaatagacatgttcatattcaaaattaaacgtattgtaggatgtaagcatctgattttaaccacatagcaatctcaactaagcaaagtaaataaaactaaacccacatctaagcacatcagagaaaaactgaagaaacgtgaatcaaaagaaaatgtgtaagtacacaatgtggtattgctaactctaggtactgttgtgcagaggatctctagagcttattcatcttgcctaacagaaaccctgtatcttttaactaatatcttcctacttctccctcctccagcaaccaccagtctattctctgcctgtatgagtttaattaatgtattaaatagataactcacataagtggaaccatgtagtacttgttctattttaattggcttattccacttagcgaatgttttccaggttcatccatgtcgttacaaattgcaggatctcctttttggtaaataccgaataagatttcattgtatgtacataccacattttctttatccgtttatgtggatttgttttaaaaccttgactattgtgaataatgttgcaataaacattagagtgaggctatttcttccagcttatgacttcaattctattagatatatatatatatatatctagaacttggattggtggattatacagtaattctatttttaatttttttgaaaaaccaccaaattgtttcccatatccagggctttttggtcagctatttaaattttataatttgctatcatttctttaatcattctaaatatttacttaccaacataaaacataaagtaccaatcaaatgaaatgtcattatttgcaataattatctgttaatctacagctgcgtactaaagtctatcattgtattcttttctacaggagagaagacacctctgtatttgtaggctctccccacatcttgtgagtcactaaagaaaaaccagttgttccaattgttttaacaaaaccaggaactgagattctaaatttacatactctcataccattttatgtttatgagaaatacaaatctagaatgtggaagttaagaactgcctgtttaataaaatcatcttgaaacagaaagaaggcaggaagggaaaaaagaaagaaagaaggagacagaaaaagagaaagaaaacaaggaaagaaactaggaaaagaggaaggcaggaacaaaagaaggaatggaaggagagagtgaggaagggagggggagaggaaaagaaggaaagaagaaagaaaagtgttaaaaaaaagaccaaaggaagaagagagatgatctaaaaagaagaaaacattactctagagcttctcaaactggcatcttatggacccctaagaatttgtgcattttatatagggatccataaatttcctaaaattgtatccaaattgttccatttaattaatctatctatctaaatatctattgctatggtttgaatgtatcccccaacagttcatgtgttggaaacttaatcactattgtaacaatattaacaggtgggtcttttaagagatgatagggtcaccagggtggagctcttgtgaatggattaatatcatcatctagggtgtgagttctcttgggagtgaatcagttttcacgggactgagtgagttttcttgagagtgggttgtagtaaaagcaagctggctgcctctgtgatttcctttgcttgtgctcagcagttcttctgctcttctgtcataagaaaacataaagaagaccctcactagatacctgagtcatgttcttgaactccccagcctccagaactgtaataaataaatttttctttataaactacccagtctatgatattttgttatagcaacagaaaataaacaaaggcatctatcattgtattactagatataatatacataaattttatacaaaccgtacatgtttgtgtgaattgaattgtgtccctcaaggagatgggttgaagtcctaattctgatacctattaatgtctataaatgtgtatattcctatgtatgtattagagtaattaaatgtttaatacttttaatatcttaaacatcacagtgtgtattggggagggataatgtttagagatcacctctgctattgacaataaaggtattggggtgaagtgtcttcatattttctgtatgttttgcatactttaagtgtttcaaagttaaaacttaatgaatacacagcattttttattgtgttaaggaaagtgaaaatttgcttttattgggtaattttaatttggaccctaacttactaaataagagcatttccctgaccactttctgtatccaactccaacctctttaatatacataatacctaataccactgtatcattgcatttcatcttagcaagatgaaaatgggttctaagtatcttccagaagaaccaagttgacataagcttcaacacagactataatattttgtttcttattttttaggtgccaatacctccaaatagtgacagttacaataatatagaattagccatggaaatgaaaaatatagaacaaataatgggaaataaaattagaaaacaagaaaaggtatgttgaaagaaaaaaagatgggaggaggaaatttatctatatctctgattaatgtgtgtttaaagaacggtagattgttaacagttatgaaacgtccagaactgaaaaattctaagtgtcttccttaaattcccaacacaacatttttagccaaatgtgtaagtagtgatcttaagatttcataaatttcaaggataaaaattctggtgtttataatgacattcttattagaaaagaaaaataatcttttctgatgtttctctctttctctctttccccccggcccctcccaaatttcatgtcctcacatttcaaaaacaatcatgccttcccaacagttccccaaagtcttaactcatttcattaacttccctacaggagaaagttaagaaaatctgagaaaagcgttaagcaacacaagacaacacatacttaaaacttaatacaatgacaaccaaacatttcatctctggtttctctgctttagaaacacctgaatatatgattgaagcaaaggacaagtctttattcacagcttgtttatcagcattctaaaatctgtatattctattactatctgatgttaagccagagtttcaagaaaatacattcttaataatgtttaaaatgacaacagcacttctgttatacaatttaaaagatcaactgaaatgagaaatggaaagaatgttaattttgccaaaagattaaataagtgaaatccctggaatttttgaccaatagcagatgtctttactaagttaaagaaaagacaatgtaattcaatgaagaaaatttaccaagctctcagatgatgactgacttctttgaagtcacaaaagggaaaaagaacataagcttgttgtattagtccatttttacactgctggtaaagacatacctaagactgggcaatttacaaaataaaggagtttaatggacttacagtgccacatggctggggaagtctcatgatcatggcagaaggcaaggaagagggagtcatgtcttacatggatggcagcagacagagagagtttgtgcagggaaactgccccctataaaaccactagatcttgtgaagcttattcactatcacaagaacagtatgggaaagacctgcccacatgactcaattacctccaactgagtccttctcacaacacatgggaattcaagataagatttgggcaggaacacagccaaaccatattattcccccctagccccttccagatctcatgtcctcacatttcaaaaccaatcatgccttcccaacagtcccccaaagtcttaactcatttcagcattaactcacaagttcacagtccaaagtctcatctgagacaaggcaagtcccttctgcctataagccttaaaatcaaaagcaagttagttacttcctagatacaatgaggtaacaggcatttgggtaaatacacccatgtcaaataggagaaattggccaaaacaaaggggctacaggccccaagcaaatctaaaatccagcagggcagtcaaatcttattttatattttattttattttatttcatgttgttttttgagatggagtctcactcttgctacccaggctggagtgcaatggcatgatctcggctcactgctacctccatctcccgggttcaagcaattctccagcttcagctcctggagtagctgatataacaggtgctcgccaccacgaccggctaatttttgtatttttagtagagatgcagtttcaccatgttggccaggctggtctcgaaattctaacctcaggtgatctacccacctcggccttccaaagtgctgggattagaggtgtgagccaccacacccgtcccaggcagtcaaaccttaaagctcgaaaatgatctctttaactccatgtttcacatccaggtcacgctgaagcaagaggtcagctcccatggccttgggcagttctgcccctgtggctttgcagggtatattctcactcctggctgcttttatgggctggtgtttagtgtctgaagcttttccaggcaaacagtgcaagctgtaagtaaatctgcaattctggggtctggaggatggcagccctcttctcatagctccactggcagtgccccagtagggactctgtgtgggggctccgactccatatttcccttctgtactgccctagcagaggttctccatgagggccgggcccctgcagcaaacttctgcctgggcatccaggcatttccatacatcctctgaagtctaggggtagggtcccaaaccccaattcttgacttctttgcacccactggctccataccacatgggagctgccaaggcttgggttttgcactccctgaagccatggcttgagctctgtgttgacccctatcagccacagccagagaagctgtgacacagagcaccaagtcactaggttgcacatagcataaagatgctgggcctggcttacaaaaccattttgtcctcttaggcctcagggcctgtgatggatggggctgccatgaagaactttgacattgcctcagggacattttccccatttcttggggattaacattcaactccgtcttacttatgcaaatttctgcagcagacttgaatttctcctcagaaaatgggatattcttttctatcgcattgttaggctgcaaatttttcaaacttttatgctctgcttcccttataaaactgaatgcctttaacagcacccaagtcacatcttgaacactttgctgcttagaaatttcttcaaccagataccctaaatcatctctctcaggttcaaagttccacaaatctctagggcagaagcaaatgctgccagcctctttgctaaaacataacaagagttacctttgctccacttcccaacaagttcctcatcttcatctgtgaccacttcagcctggacttcattgtccatatcattttcagcattttgatcaaagccattcaactagtctctaggaagttccaaactttcccacatttccagtcttcttctgagccctccaagctgttcccatctctgcctgttacccagttccaaagtcgcttccacattttggggtatcttttcagcagcacccacttttctggtagcaatttaatgtattatttcatttccatactgctaataagacatgctcaagactgggcaatttacaaaataaagaagtttaatggacttaacagttccacatggctgaggaggtctcatagtcatggcagaaagcaagggggaggaagtcacatcttacatggatggcagcaggcaaagagagagcttgtgctgggaaactcccccttataaaaccaccagatatcatgatacttattcactataacaagaacaaaacaggaaaaacctgtccccatgattcaattacctcccactggctccttcccacaacacgtgggaattcacgatgagatttgggtagggacccagccataccatgtcaattcttattaatgctctggattgctcacggttagttatggttatgtatagctaggtgttgaactaaaaatgtcagaattagtggttaaatttcctggctttcatctgctaccactgtctctaacttcatactgaagtaatgatcccagggagatgttctgaagtaaatgttcttggtgaaggatgaagatgaatcaggggaaataattcaccattactggaaaatacttcactgttcttgactcagaaatgtattatttttgttattatgataatttattttgatatgttctgctcattaaatgtcctgttcatattaatctgtaaccaaatctctgtgataatgctttgcatataggagtccaatgtgttcatcattcccaataagcctatgaacatattgaatagtcagttatgtaaggacctgaactcaggaattgctcactctcacatataatgtacatattctggaccaaggttactgcatttcatatttgtcaattctgcatttgagtaatttccaaataataaaaatagcttagaactttaagtggcaagcagaacacatcaaaattcattatatttttccgtattaaaatttttctctgatctggttaaaaggtaaatagtacttttcctgagctatttttattaaaatattagtattacaagttccacctctttttagataatgctttcacttaaaggtgcttatccacattagctgctatttcaaaggctgaagactcttgaagtctgttttctgataacattcataagatagatataagaaagttttgtgtcaacatcatttaaaagaaaaatattgtatctaatttctaacataccactcctgtgtacatatgcaaaatctagtctcaattatactttctcccttttttattcctacttactgcttctcttcattttctaaaagtatttcaggtttaaaaatacatcaaaagcaaaaccagtttgaaactacagtttcagcattaaccttcacataacacagcaaggattcttccttgttatgatttcagccttgcgcacttccacaaatccatgcacagaaagtcaggctcaggccaaggatttctttcaatttgttgagagaaaccagcaatgtgattaataagaattatttaagtattgttgcaaggcaaggtgtcaaaaaataccatgctacaaacttcccgtgctctcgccttcatagaaaaaggagaaggaaatcttttgtattaggtaatgaaaaatgatttacctaaacatattctgggatgtccaatttctctctcactttgtgggactagcagtaagatgcatgctttcactccttcttttaacttatctccatagaatattatttgaggtaaaaagaaaactttatttttctttttattcacacaacacttctgacaccaaatgtgtgggatattttttttcccacaccaaccaattctccaactctctggacaccaatagagtgtcctaaaattcatgtctgacactaattacctagagttttagcacggacatcacaagttaagggctcagcctcacaacatttccccacacttcagacactaatcacaaaacatttccccacacttcagacactaatcacaagtcccaggtagtcacttgcactctaaccacctgtaaattaggggttcccacaaccctcttcttagatcttatactttgctgtaatgactcacgattcagggaaatactttcttattactggtttattatagaggatacaactcagaaaaaaatgaaaaataagtgatgcatggggcaaggtgtggattatggggtgtggagcttccatggtttttcaaggtgtgctaccctcccaacacctccattgttcaccaacccagaagctctgtgaacctcattgtttagaggttttatgaagttttcaccaaataggcatggatgagtaaatcattggcactttgtgactgaactcaatctgtagcccctctccttccctggagattgaaggatggtgctgaaagttccaaccctgtgataccatggttgctttctctgtcaatcaatgcccattctccaaaagtcatcttattagcataaccttggatgtggttaaagaaagcttattatgaacagcaaaagatgttcctttcacccgtatcacttagtaaattccaaaggtttttgaagctcttgtgttaggaacctgggacgaagaccaagtattataacaaaagattttcccattactcctattattcaggaagttataagggttttagaagctctgtaacaggagctgagggcagagactaaatctgtatattttattccgtcacagaagcattaatacattgatttgcagaacgctttcattgaaaacggacctgctttttaatttattttttttaaacttagacatagtaaaattcactttttctgtgtgtatagttccataaatcttgacaaacacattgtcacatcactaccatcatagtcaaaatacataattatttcatcaacaccccccaaaatcatctcatattgtccctttgtacctccttcaaatacaaaaacaaacactataagactaacttctgttgttctattttgtaattgtataattgtattttataatttttgtgggatgtactttacttttaaaaaaagtttgctgaagtaatcttattttttcaatgaatattaaatagctactacaaaccaggtactccataagtcatctgggacagagcagtaaatagaaaagccttatggtgtttacatatttcaatgggggaaaggatgagtagcaaaaaataagcattataaataagaacattatacagtatgttagaaaaaaaataccctaaagaaagaaaaaagaaagagagagattggaagtgataagctgaagataaatgattgcaaatttatatagggtgatcattaaaaaagtaattccatggttataaacattactcaaattccaaatctttacctgatgataatctggatttcataaaatctattttagtgaatttacattaaaatgtgtttaaatcagtcttaattgaattcacagaaccatgtcactgattttccttttctctatattacattgtttttatttgtaatttaagtccatctctttcatgtatttgaaaactgcagaggtaggaaataaatcttaaaatccatttgtaaaattataaatttttagaaaaatttggaaatatgtcatattttggttgtaatttaagcacatgaaattatatcttcattctctcaagactcaatttatatgactttaaatgattaaaaaatttattaattcatatgtatgaatgatgtcagcacatttcttaaagctggaaaactgaatactaaggtgtttgcctaaatgaaaccagcctatctgacctctaggaccctagtaaggggctggggcatgactgagaaaagaatgaaaaatgaacacaaatttacaaactaaatagttgcacagataaaattatgagattatctccttacttcctttagtaactccccacccactagcaatcatagatatttgctctccaagcaggagactggaggatcctttcctggtgaaactgaccattctagaagtaaagccctccacaatactaacatttgggagaggagatggagtggctcttaaagaaatgaatgaatttgctcctggtttttaaaagtgtaacttgttagtcaacaagccctgctcagccacacagagctcccggacagatttcaacacttcactcttacatgggaaaagatggccaggaatcattggattagagaaaaagcctttaatatccatgaacaagcccaaaatactcataaggagaaaaggggaataagaatgcatttaaacccaggattttcacaaagcacaatatacttcaaacagaaaaataatgtaaaaaaatattgatcattccatgcaattatgtttacaagattttaaatttaggaacagctaaccaatttgtttcttagaatcctcagctgcaggaatattccttgaaagaaaggacatatgaaagagtttctgtaggtaagtcctagattaaataggatttcacagattctgagcatggaagtgaacagatctaagttagtgaaaattgaactctgtaaatgaacaaaaccataaatctttcaatttgggagtacagttaatggaaagagaaactagtacttgaataccttatagaataccaactggatagtgtcgacttatttatttatttttttttttaaggaatttcactgtcacccaggctggagtgtagtggagtgatctgggctcactgcaacctccacctgccagttcaagtgattctcctgcctccacctcccgagtagctgggactaccagcgtgtgccaccacacctaacgaattttttctttttagtagagacggtttcaccacgtttgccaggctggtctccaactcctgacctcaggtgatctgcccaccttggcctcccaaagagctgggattacaggcatgagccaccgtgcccggcgatagtgtcgacttttatttgaaatacatatccaatgtctcaagtagcttctataattttctcataagtattagcttcaatgccatgtacctagaaggtccctctcaaaaatctcttttggactgcaatgagatggctacttacaacatagtatgcaggctaacagctgatttctaaaatattattacttcactgtatatctgaatctataatctgactttaatataattgattgaaatgaataatctatttttggtcctggtttcgtcccattttatgatttattccagactatacaaaagataggccctccttcatgatgaattgagacctgtggtaactttctcaactcttggacagatagaaataagatgtaacccatcaattctcatggaggtcattaaaatgaccattcaaagcacagcaaatgcaatgtgttgtggcttttttaattaaaggtgttacttgtcaacccatagataagtgagctatgccattactcctcttgcagatgagagtgaactccccacatcttacgttataagcctattttcataaattagataatcagaaaatgatgtctttcatgtacagcagtgttgacctggttaatagaattatatgcttccctaatatgcacataattcgggagggatctgaaattagtggaattttctaattcgccaagctttggcaaaatctttatctggcaataattggcctttaattagcaaattcatatacttttacagtttcaactctttcagatttcttacacttctcaatgagggatgtgacagacataaagaagaccttgatccaaatgctaatactcagaattggaccaacctccaataaaatatgacactcaagtccctagctaatttaagtattcaattataattgaaccaaatggcaacaggcaagaaagttttagagttcttcacaaggcagcattctcgccattaaaactcactaattacactggtcatactatatatgaagttgggttaacaatgaatggttaaagaacatgaatgcggcatgtcacataaagaatacagaattatataaacaacttataacatttttgtttattttctaagaatattctaaatgcattcgttttatcaatttcatattaataaatgcaatatatatagttagcaaatttgattagacaattctcacactgctttttaaaatacttattacagtctgtattgtatggtgacctgagactacattttaccacttccacttgttatccagagtttaccctacattagcctctgaaatattttattgttctccacagaaattgaaatccaaatttaacctactattctacagtgatatttttctttagaggccactgctcaaaatgaggtgcttgttttcagtacatacagacaccatctaaatggcttcctggatgatcttagccttcaacagaggtgatatgttgacatgcataccacacgaagacacgttatgcaagatgcactcatcaaagagatacaacctgtaggcacagtgagaatccaagacagaggaaaaggattctgaaaatcccgcatcattttctgtcaagcaatatacctctctacatgtcacaatgtcaatgatactttatagaagcataaggaaactctcgttaacaaaaaatcagcacattaaaaattggaaattcacccaatatttacatcaacattttcatattttatctaaataatgatgagatttttccgggaattcttaaaaaattaagctcaagtattacattcaaaattgattcaatttagaaaaacatgtataggaagcttatgagaaatttttatatcacacaacatgctgaacactgattagagccagtctgattttttaaatgagataactgtaacttcaaatgtcaatttaaaaaataatgcagacagatcttatctgccctttacccagtttggaccgaagacaacatattgcacaattttagaacaatattacaaccataatattgacattgatgtaggcatctatagaatattttcatcaacacaaatatctctcatggtgcccttttatagtcacatctacatggtatcataagttcttaaaacatgtaccttttgaaggacatctgtgtggtttctagattttggctattatgtataaagctaccataaacaaacatttgtgaacaggcttttgcattaacataaatttttatttctctaggataagtgcacaggagtgctgtaatgtatcatatgatagttgtatgtttaatttggcaacaaactgttcaaagtgttttccaagttggtaatgcaattttacattcccaccagcaatgtactgtgagtaaatttctctgaatccttcccagtgtttgctgttataattgttacttattgtatccattctgataggtgtgaagcgatgcctccttatggttttcacttgcatttccttaatggctaatgacatttaatgtattttcatgtgcttaattgcttatgacttctttggcaaattacctatttctgtatttttgccccattttctaattgttttttttttcttttttaaagttgcacattgaaaattatattctagatgttagccccttattgtatgtgtggtttgcaaatattttctcccagtcttcaaattctttcatccttttaacagtatcgtttgtacagcaaaacttttaatcttgatgaagcccaattatcaatttttccttttataaattatacttttgatatcaagtctaagaacactttgctttgctctattgcctaaaggatgttttctaagtttttattctaaaagttttataattttacattttagtccatgatccagtttgagttaatgttttactaacttttgagacttctgttgaaattcattttattatatatggatgttcaattgctccagcaaaatttattaaaaaggctatctttcctacattgaattgcttttgcacttttgtcaaaaagcagttggaaatttgcatggaactgtctgagttctctgttctgttttattgaactatatgtctatccttcagccaaaacagcactgtcttgattatcgtgactagaaaattagacgaagttagtagaatgctatcttccactttattattttacaaaattgtttcagctgtgttagttccattgcctttccatatacatgttagaatattattgtctaaaatttgataggaattttatcaaacctgtatctcaaattttttgtaagaattaggttaaatgtatgccaatgtagacagaattggcataattaccatgctgaatattccactctatgaaaaaagtgtgtttcttcatttatttaggtttttattaatttatttcataaagttctatagttttaatataaaaacactgcatatgttttactagatatttcattcaattttgagaaattgtaaatggtattgtgttcaaatattcattactaatatacataaatataatggagagagagatgggagagagaaatttgtgtgaagaaattgcctcatatgaccatgaaagctagtaagtacagaatctgcagggtaagttggcaggctgaccaaggaaaaccgtattttgcacctagagtgtcaagacaggctgtaggcagatttctctctccctcaggggagccagccttttctttttaaggcttcaagtggttggataaagcctatctaaattaaggaagttaacctcctttactcaaactctgctgatttaaacggttatctcatctcaaaaataacttcaaagcaatatccagactagcatttgaccaaatagctggataccatgtcctaacctttatgtatacctagtttatttaaatataaaattaaacatcaaaagtccaaaccttgtaaacttgtcacacatttctttaatccatactaaatcttcaagcaaagacaataacaaagtcatatttcttgttttcatgatacaagtacccagcatacaaccacaaatgcactaactcttgccgaggaaaaggatgcaaagaccttgagtgatcttcacttatctccttaatatcctgtaactaaaatactacaacacaaagttaacattacttaaatgctatgatatgaagtcaatacatgttatgttctataataaggttataagataagaaaacaaagatatttgagatatatatatatatatatacacacacacacggaaatgtttttgtaacaaaataagaaatattcatgacagttatagtcctatcatttctgtaagtgattatgggtcatagctagtatttatgactaccttcttctaatccattctgcattctctttgcccgcagcaaagtgggcattctttacttggtggaataagctaaaatttcattactgaagggtttgggctgttagtagtcttgcttgaatcagattgttgtagtttactgttgacattaatcatagggaatggtgatactaagagatgccctaagttatctcctgtattttaggcatgctcttccttatttccattgtggactaacagtccaatttccccttggtaatcggataaaacaccacaaccacacagtaactctcttatttgcctgttgactcagaggaatgagggttttgaactggccaggcagcagtcttgatttccagctcaatttccttactagttatagggctattcaaattatctatttcatattgagtgaattttggtagttggtgttttttttggtagaaataggtgtatttcatctaagttgtctattttatgtgtatagagttgtttgtaatattatcttattatccttttgatatctatagagtctttagtgatattctttatttcattcatgatattgataaattgtgcctgtctctgtttttgtcagactgtctaaaggcttattttattgatttttcaaagaacagacatggttgcctctatagattttcctttgttctcaattttatttattctgatcatatattatttccttcattctgttgcatagcattaattttgcacttcattttttttagttattagaaaggagcttgcattattaatttgagaggttttcctctcttcaaatgtatgtatttagtgctttacatttccctctaataaccattttatctgtgtctcacaaattttgatgtgtttggagtagctagtaactgtgcagcaagagaggctcctcatttgcactctgctggtctgggtgggtgtgaccagagtttttttcttggtgtttgactgcagaactgcaagtagggcctaaaggttttctgtcatgctcagctgcacttttcctggtatttggatggaaataataggtttttgggaggttttcctttttgcttttgtctgaacctatttggtgctttcaggttatcaccttctccagaacacaatttaggatacgtgagaaaaaaataaaacctaagtatatcactgcactgttaattatttgagttccatggttcctagccagtctgccttcctgccatcttttctccacctttcaggtttttatgttttacgtatataaatgtaacttatattaacataacatgtttttaagttgtacttagtgggtgaaataaggaaaagtgcatctacttcatcttccttataatctacttttgactcactccaaactgcttttataagtccttcagaaaagaaaaaaaagcattgttttcaaatccacatacattaaaatggtgtacaagttctgaactaattgagaaaggaatgtagttcttatctgcactgagctactcagtttgaactaattccagtcatttaatgtatactggcttaagttctcacttaggaaagagggctaactataggttagcatctacaggccagagtaccaacctgcttggcaatatccaatgattatctgtatatggatgttgtaaagttctcttatatcatacttgataattaaagaaaactaatatcaattctaatattcaatgtaatatacatactgattgaactatttccctcaagtagatagtattttcataatatttcaaatacagattgttttgaagaatcataaaaccatagggcttaagctcatagtattccagaagaagtaacgctatctgtgaaaaaagaagccactgcttccatattccatccagaacaaaaaggtaactattacctcggcttatcttgcaagtgaacattctgatctatctatccctttgctcattcagtgaatgcaacttcatagaaatcattgtattaggtgctgctggtaacagaacaaggagtcaaaactttgggctagatgactagctcatgacccaccagttgaattggatctgcctggtttcataatttaatttcaattgaaagcttttggctcaagccaagcatatgaatttgaaagggatatcacacagaagcagagatgaaatgtttcaatatcacaacaaccaatatatcctgggcagacagggacatctgatggctcagaggcagagaggcagagtggcattgtcctcataccaaagtgaaagcctgtagccagctgaggcccccaggcactgttgtccctcatggcacagagctgcctttgccattaaagaagaaagagaaacaaagaatgggaagttgaaggatgacatgtgatttatttctttcctcaagacttaacataatgtctgggacattacaggacaaataggcactgcaaaactattcaatgggaataaactactctgatttacaattctttcccttgctgtccaacactggataaggcagtgcttcactgagaatgtcaattttcccatttgtaaaataggaatgaaaataatattatgttgtttcaaggacagaatttgtcaatgtccataaatgtactttgtgaattttaaagtgctatgaaaatttaaaggaaataaaatttatctaccatgcctaccttcctccttgtagacatgaacatgcccaatgacaaaacattattactattctatttaatgaataatttaaattgcaataatccccacacaaagcataataaagtaatatttattttttacatttaaaaacaactttagcctgaaactgattttttaattaacattgaatttaccaataaaatggcaatcatgtataattttaaatgtaaatggtagacccacccaagctatcattaacattgtgaaaatatggataatctatcaatttccaaaatcaatcaagagtttaccgtaaggtaaaacatgaaatctaataaaaagaatcaaccatgagccatcagtattttattactattgaacttgcccacctgaaagttgagataaagctcgttaactcagcaagattttaattctaatttcctagaatgaaaacataagttttataccaactgaaatgttttacacttgggctttgcgatgaaatgtttttccccttacacagttcctatcaatctttcacctcctgcatttaccctgaatctaaaactaatgaggggatctttttggtaaggacacaaatcatgaatcataaatctccctcttggagagtatagtgttaaaaaaatatattctgaaaattgagacaacggcagtaaaaactgtgataatagagcattctcaggactgcagagttctgagtattctataaatttcaagtgtcaagaacctggaaggagtgtaaaagaagttaccatttaatttaatagaggcatagtagatttaatagaaactcgagattctcagaattagaactctaataagagatgcttattgattgccacaggggcagagtaaagtgaaatcttacattattcatgttgaaaatcttgaaatagaatgttcagacagatttcggtatgaacatgtttgcattcatattcccattcaaagatgagtatacagaagaaaagaaatggcaaagttccaatggcaaaaaataacatggcacaatgaaggaaaaatacatcttcttgaagacgtgggaaaagtgtagatctttgaatacctgatagagaaactaaaatattaaggcaaaaaagttgtgttcaatatttttagaaatatatacatatatgtatatatacattaagcttcctaaaggaataattgtaataatgctatcattatgtcttctcaataaaatacatcttaaaatatttttctgctatgtaatatgtattttatatataacttttatattcttattggaaatatcagatattttaaaaattatataaggtatattttacatttctaatctcttgctttcttttaaaaatttgtattttcggactggcgtggtagctcacgtctgtaatcccagcactttgggaggccgaggcaggcggatcacgaggtcaggaaatccagaccatcctggctaacacgtgaaaccctgtctccactaaaaatacaaaaaaaattagccgggcatggtggcaggcgcctgtaatcccagctactcgggaggctgaggcaggagaatggcgtgaacccgggaggctgagcttgcagtgagccaagatcgcaccactgcactccagcctgggcaacagagcagagcgagactccatctcaaaaaaaaaaaaaattatattttctttcccaaaagttaatcttaaattaatcttacaaaattatacattttatcttttcttttctgctttctaacttactttcttcttctctctctctctgcctctctatttttttctttttccttattgttatatcacaaagagatttgccacacctcctacccatcttctgttagtcttcttgatccaacttgccccccaaacaaaataattaaaatatttttaaaaatttattcttcctcagacaccataaaaacatacttcctaataataattttagatgcctatcctactaattatttttgattttataaatattgaaattataattacagaaaaaataacattatgcaattattactaacgagagagaaaaatgtttataatttgctctttttgaataaaaataattttctttaaacaaattagaaatttttattcaataatcacatccctctgagttagagattaatgagagtcatactaacatgcattcctattagtgcattatcattaaaaattactttaaaaagtttattttaatgcatcacaataaatattatagaaaacatttttctattatcaagtgagtttcactaaataaaatggatagttggggagattataatgagacctaattaatctgattaaatgtgaaaaggagtaagctatttaattctctccatgggcccttggttttgagatgtgtgtctctataacaagcggtgaattattgagctcaccactaccagacagggcacacaagtggagaaagcaaactagagaatggaagttggctgtgctggagtaagcattaaattctgatctctttagatgatagccagaaacactttccactcgtataccttctggattggagactggcaaaggaataatgcatcagctggacaggaaagatggtccacgaagagcatggtgtctgttgttaatctcattattttgagtaggaaagtgccttacctataagcacattctatctgaaatcattttctaatacagagatcagagcattgaactctgaaagcaaagaaaataatcgtttaaaatataaaacaaacataaaactagaacttcaaatatacttatatcttaggtgcctcattgtccctgtcctcccagcatagacttaaaatcacctgttcctacttaccttagtgaaaagaggaaagaactattccagaagaccaagctataattataagtagttttccttaaacagcaatccttcatttaagagaattttagcaaaagaaaaccacattgctaaagacttttgtggatatttacatagaattataacacagtttcaaaggtaagctattttgaacttgtggccatgttcaatttggaggtcagtttgcaaggaaagcaatatatttactcctttttaatctcagcaacttgaatgtgagtcacaaagcaatacagatgggaccataaacaatagtctcatgacaaaaactgcttagttttaagaaagaaactaaaagagccaatatattttcatgttacaggaatactacaactcagacatatttcacctttccaactaaaatccagtcattgtaatttaagcgttctcttacaatggctgctcttttagctatttatttgcaaatttcaatttttaatatattcaagttgtataatattctctatgtatgacaataaaaacagttaaaaggctgggtgctgtagcttacacctgtaatccctgcatttttgggcagctgagacaggagaatcgctggaagccaggagttcaataccagcctgggcaacaaagcaagaccccacctttatgaagaattttaaaaattagtcaggggtggtggcatgtgcttgtattctcacctattcaagaggttgaggtgggaggatcacttgaacccagtaggtcgaggctgcagcgagctatgatcatgccactgcactactctcattctggacaacagaacgagaccttatcttttaaaaaaaaaaaaaagttaaaagatactttctttgacattgtgcttttgctgaacctaatgatatttttcaggagccagagaaaatactgaactaggataagaatataacataaatcaatgggtgatcacaataggaaaaaaatagtttctgattaaactttaagtgggaaatctattgattaaaaacagattactacatttgtttcccaacaaattctgtgtgcaccttcattatcttaactgtaaagtgttctttaaaaagagttacattccaccatgtcccacttcaggttaaaatcaatcctttaatgtcttcccttacttgagatgaatcccaatccatcaccttggctagaagggtcatgactgctcttcatgttgcttgacttatttagcctattttgatgctctttctctatgcctattctacttccatttttttccctttcctatctcaagtttttgctcacctttcctcccatccttgaaatgcatttttttcacttttatattttcctccatggctacatttattttcctttttggagcttacactaaatatcttctaggagaacttaaacccatatcaagcatgttcttctcatcgtttaattcaaaacacttatttgtttttttatcacattaaaaatctataattatttcctttatttatttcttataagtcagccttctcctctagcatgtgaaaactccaaaagcaggaaatatttctattttattatgcccccagcatgtgtctgacacataatgggttcttaataaatttttcgtaattattctattcttttataaatattgttgaatcagcaaacattataaaacatagtggaagtaaatgaatttgatcactttgagaaaataaaactgttattacctttttttcatttctaaaagaacttgttaattctaacctatttgttttcccaatccaggctaactttttatttaagaattttgaatctgaactggtaaaattatgctaaagaaaataatgtgccatataaacacatacagcatgtgttaaaaagttgaaaattaaccagtgaatttgatatggatagactattagcttacataattctatttaaaaatgatagactggataaagaaaatgtggcacatatacaccatggaattctatgcagctgtaaaaaagaatgagttcatcatatccttttcagggacatagataaagctggaagccatcatccacagcaaactaacacaggtacaggaaaccaaatactgcatgttctcaatcctaagtgggagttgaacaatgagaacacatggacacagggaagggaatatcatacactgaggactgtcaggtggtgaggggctaggggagggatagcattaggagaaatacctaatgtagatgacaggttgatggatgcagaaaatcaccatggcatgtgtatacctatgtaacaaaactgcacatgtatcacaaaacttaaagtataataattttaaaaaaatgatagtggtttgtgatctgtgcaattcaaatgaaatataacattgcaaaagtattattttatggtgtgttataaaagatgacttccagagaaggtggctttaggagatcattaacacactgttgaataagaatcagttctatcagatttcacaatatgttcctcagtaacataaaatttggtaatgcatgctaaagtctactttgcttttaaaattttcagatgggacagcttatttacgcttttatctcataaggatcagagagtgtcagtgagctattcagtctctatccatcagcttgttaatatgagattcccctaaagcaggaagttattcagtcctgcattcaagagtgcctccatagcggtgactgtggaaccttgatcatcttgaatacagtgattacatcttagttatttttctatcttcccgctgtatcacagtgcctggcatatattagtgccccatgaaggtttaccgaaggtatttaaccaaatgcattagccatagtttatctagcattcttgaaaagttataaaaaggattacaatggcaccttagtagaatattcatgaaatagaccttttggaaaaatgaggagattgagtagatttttgaagatcaggtagtaggtaggcagcctgatcaattctaggttcacagaggaaggctccacagaagtgtgttctcttctttgcggctaaaggatgctgaagagcacaaatcaaaatgtagacttcagtcctaattacaggtaactcactgtacactcacaaaatcagacaagtagactccatgtgtgctaatactcttccaacagccaaaaaaggttgtttcttaaaattttgatcttagatgcagaactcaattttcaatatttatgtattcagtatgttaggtgccatttgatgataaagcgatgaatcatccaactctagaacaattggaaacagcttctgatttttacatgctgtgaatcaagggagtagcactctattaaaagaggttgtaatgtggagattgtgaatttcatctgctgtgagtcactgtgatggtaaacttttgtattaattgtgttttcatgttgctcgagggcaaactgctgaaaggagattattgtaaataagccattagtataaaaacccattcgtgtcatatcaagaaaaaagccgaagaaagctattaactttactctgtcagttagctatgtaactcatgcatcctagaggttttctgttgtaaggtaaaaaatgctatatgaatgcaatggtaaagggtatcagttattaaaaaaacaaaaatattttatttaaaaagggtgaaaatattttgcattgcctaagagattctaaaagcttaagaaatgtgagcagctggaggtccatctgttagtatgaacataatgagacaatttctcatggagtagacagcaacccacattatgccatgcactgtataataagtgtagcttgctgtgtgtcttacttaaaaaaaggcaaaatgtgagtttcccatgatgctctcattgaatatataaaaggaatatgagcatggattctttatcatagatgttgactgctctaagtaatagagttttttttttttttagacgtagtttcactcttgttgcccaggctggagcgcaatggcacaatctaggctcaccgcaacctccgccttctgggttcaagcgattctcctgcctcagcctcccgagtagctgagattacaggcatgcaccaccatgcccagctaattttgcatttttagtagagacagggattctccatgttggtcaggctggtcttgaactcccaacctcaagtgatccacccgcctcggcctcccaaagtgctgagattacaggcgtaagccactgcgccctgccaggaatagagatatttaaaggtccatattatggtatgctgatgctgtatttagcacagaactatagtccaacatctaagaaatagaattcttaaattcattatcactatttgtgaactaaaaataatagtgaaatactagaaataagaaaatgtacttaggagttcctgtccccatagaacttctattttagaaagaagccatagtgctctaaatattgctcctctgctctcctacacataagacactactcatacatatatattccaaatgtctcttttgaggagaagatattgaaaaaaaacaaaactgtttagaaccttaaaatattaaatatcactaattataaatattataaaacaaatcctcttcagtacagtggttcccttcttttctgcagctctgatttgaagggcttgagaaatggggaattaacaaaaaatacaattcttatacattttttagaattccaaaatttcagttaaattccttctatttaaaagtgcaactgtggagaactaacctcgtaacagaaaattttgtgtaaaggttaccctttgggatggcgttacggatgttgaaagaaatggtaaaaatgtaagcttctgaagtttgtaatgttttaaagttgacccattgcttgctagtgcataggacaattaatctttgaattattaggcaaataaaaatttctatagtggtattttacttagttgtaaatagttccgtcttcacatatttctttaggttttatgctatgagttgattaattatattgcacattctattataaaatgctatatgccagacttctatttacctgggaaagtggaatagaataatgtgcagtggcttattaaactgaagggacctgaaaaacattgctggaccaattatgttgaaaaacatgttacatatattgtgagtaaaacaaaatgtgtatacctataaaaatatgctatttgtgttctacttagacataagtggcttttgatgagggaggtagacagtgtaggggatcaggaagagagaaaagcagaataacttgtgggaactttttcacaatacaggaacataatcttccttttagggtaaagcaaatttaggcttattaagtttaaattattgaatgcatgatgcacacccagttactagcagatatagatttgaacccagatatattctgtcttgaaattccatcttcttatctactttgttctatgtagacatcatttataatatataataaattataattatatatacattatatatgtttgtgtgtatatatatatatatatatatgtaatgataatatctcagtgttcgtcattaccctggggaaccactctttctggactgttatatattatagctacctttctctttatacattttctctaatgttgacctaactcagaacatattggtgggaaaaaggacatttaactgctgaagaaaaacaaaaataataattgtcaagaaaagacagctgagatagaggcagagtcctcctgaaaccctggctctcatcataatgggaaacaattccatgtcattcattcttgggttaacagagtttgtagctatttcttactatccgacactgcctgggtttgtcgccacaatattcgtcattatatatattacagagctctctaaacaaaaaaaaaaattccaactgcctgtaactttttttccctttcactacagtatagtcactaccaagagacaaaagaatcagttatatttcttaaaatccaaaacaaaggcatcaaatgtagtagaattgtcttcttattcttatcttaagtagctcagttacgtttttccacatctaagtttattgagtttctataatgtggcttttgaaaatgatttacagagaacacagaagaaaagctgtatgttaaaatatacacttcttgatattttgttcagtgatgacattcagagtgagatgactgtaatgttggatattgtttcacaatgaattaaaataattgaatacattattattaagaatcacagaaacatactataaatacctggtgattcataatgatacgtgtttgtaatatttatacatctgtgtactttgttcatttataaacacagaagatatagttggtgttctacttaaagatcagaaagaaatctatatagttttagacttattcttctagttaatatatatgtgaacatacttatttgtcatatacttactgtactttctttctataatagtagataataatatttgacaatacataattatatttgaatttcaaaagatcactcagccacagttaagaattggtatttttcttagactatattataaaaactattcttttttaagtcttgcaaagtttttgtaaaataattacaaatgcaaatgtataaaatgcaacaacacggaaaagggtgaaatgtattaagtatgattttaaaatatactagagtttaattcaagtgctgtagatgacaaaaccttattgaaaaatatttccaaagatataaattataggcaaagttacacagtttattaatagtctatattgtgctaaatctctagtctctcagtctctcaaatcagtcctcccaatcacctagccacaactgtgttaaattatttctgtgtcttggtcatactttttattccaccctcatcaccatccccacatttacatatctactcatcaaccttgcttttttataatattgatttatgcaggggaaaaatgtccatatttattcattcagtacttctcaggagtaatgaagtctgcaaactttctatagaaatacaaatattttggctgggcttggtggctcctgcctgcaatcccagcgctttgggaggctgaggcaggcagatcacgaggtcagaagttcaagaccatactgaccaacatggtgaaactccgtctctactaaaaatacaaaaatttgccaggcgtggtggtgcatgcctataatcccagctacttgggaggctgaagcaggagaatcacttgaacctgggaggcagaggttgcagtgagcctagactgcaccattgcattccagccttggcaatagagcaaggctccttctaaaaacaaaacaaaacaaaataaaaaatacaaaatgtttctaatcaaaaggactcacacaaaagttggatctaaaaatgtttttttgtaaatgagtatatgtcccaaaaatttttccattttctgtatatttgaaattatttaagaagttgagtacctacaccaatacatatgctactgtaaataaataatattgtcactggtcattaatgccattacagcattttttctcaaactcagtgattacctgtcagggaaacttacagcttgacaagacatgaaccacaaagagattcacaacctagattaataaattattttaaatgtagaattacatagacatgattttcagaacattgcaaatgatataaatcttaacattcataaataaaacttctagaattgccagatgtttatatcagttcttaatattttgtgaaaaagtatattgaattttaatatcagttgcaggatattaataatatttataaaattatcatttcctattaattcttttaaagaatctatcattacaaagtttctacaacttttcctgagcccatttgtagcttcagcttgtatttgttttggaatacattaatgaagacagattttataaagaaaggaagcatgttttggagtcagatacagaggctgttaattcatttttctaaattttgtcactcttttcgaacagataacttctaagtatcagtttccttttctgtaatacaggcacattaatatgttattcataatgttattttgaaattgaaaatgagaaaataaaagtgttaaatttcttaacacagtgcctacaacataaattcaataaatagtggctaatattgttctgattattatttgcataattatagctctcatactgagctttcccccagcactagactcaaatttgaaatctgactagattctaaatctcaacgtttctaaacagaatttagcatctttacccatataaatcagttttgcttaaagctggcttagcttttctcatgacgcttatatcaactggcactactattcattgtcatcataataaaatactagctctactgcacactggttgggaaccaggggcagataggggaggagggcataagagaagaaactgagccttaatttcaacatctttaaagtagaaacatttttaagattggtctcaacacattgttgtgattaaatgttagtatacacaaagaacttaactttaccagccacaaagcaatgattcaataaatgctaacaattgttactttattattaaattaaaattttcttttaatcacaaatgtatttcttacatcaaaaaaattaagaactctaatagggccttataggcagttttcccctatatgtacactattctttcccatgtgttttaatatcttacccttttaatgattttaacaactccaggatatgcaagagaggcttaatagtgttttttttttctctattctccttaagatttcttatcaatagggttatagtctataatgaacttattaagagtttttaataatttcagcttgaagctcttcaaaatttataaatggagtgctttaacatgaaaagctgaacattcaatttggacagaactctctcatactatagtcacccagaaaaggttgttaaaatacagcaataagaaatattttagtgcaaaacccagcttaaaacagaaaaaaaaaaacagaatagaaaatcctcaggtgatacaagcgaaaaaggtaatcaaagtcagatggggaaaagtaaagacagttttacacatggctgaacgcccaaggggttggtcgcctgcacgcatggaactggaaaggcaccttctagatcacggaaagcaaggttacatgaattatgtttgggtctgctaaaaactattccttcagttaaaataaaagaaagaaggtggagatctgactcacttgttgagagcaatagtgggaaaaattgtcgtctacataaagtcttagtgaaagatcagaagcactgacctgtagttacaggagttccaagtttagagcgtaaaacaacaatcagacaagaacgactgaattcctttggtactgatggagcaaaataaaaaccactccgctggaacatttttataccatagtcattggtgtaccatatgaaaaatttaaccctcggaaaaaagaaaagtttatgaaaaaaacacacgagagagagagagggagagagagtacatgagtatgtgttgggggcaggggtgtggatatcaatgagctcaaactacaggacaaataatatctgaataactggaaataatacattactttgaaggagacaataaattaagtatgttgacataagaaataaaagcagacatagattcataatgaaaatatagttcattttgaaaactgaaaactcagatttaaaacaaaaagaatgctcaaaatttggaaagagtgataaaaatcgaaagttcaatggataaatcagactagattagggaattctgaagaggaaaaaacgtggtctgggagacagaaatgaagaagtacccagaattcagtgcagagaaaatataaaaaatatgaaaagaggcatggcaaagaaaaggtaaagttagaagatgtaaattatgcttaattgaaaatcaaaatgtaaaaaataatatgatgagagaaaatatttgaaagtataatatcccaaaattgctcaagtacatttatttccaaactaaaggcactaagtgcaggtcaagataaataaaaacaaatctgtaattagacacatgttggtgaaactagaacaacaagaaaactcaaagaaacttgcctttttcaaactggaattttctcaaagggaagaaaaagcattttttttctggcaaatcataaccatactttgcacataacataggttttggagtgccttctcacctttagtgtggtgtaaaaatttttaaggtgagaatcttatttgtagtagtttggagttattatgtccatatgaaccttgcaaaaacaagaaaacaaacaaaacacacacacacacacacacacaaacacacacgattcccctatggagtagtacaatttcaatcctgccatcaaataattcccataagcacagttctaagaaaaaggagcagttcaaagtaaacagtctcaaaagacacaaggaccaaaggctctgtgagtgaatcacagaagaaaataacacatatacaaaccagacttcaagagaatttgggtactggaattataaaacatgacttaaaatgcaatatttcatatttaaatgcaagtatataaatgtgtgtgtgtcaattgttaacataaatggaacaaggagaaaacaaaggagtttcattgcaaaattaaacaaatataaaacatatagaaattttaaaaatagatagggctaactagagggtggcaagatggctgactagacatagccaggatgaacatttaccaccaagggactgggtcaccgggaagactgacgcactccaagcagatcttcagagggaagactttgtgggggatggagggaggacacagacactgggctgaagcatggtacctggaaatcctgcatagggttatcgcaaaccaggacttgttcctggctcccaacaactccttgaaaaggggtgagttgagcaggaaaagaacaactcgctctggctatggacctctggaatcctgtcagcaagataccctacaactcccatggacatctgagttggcagggacagctgcttagacaggtgatagtggcagaactccagatggtgcagagtccagagggtttggtgtgggagcatctgcagtggagcatagccagtgacacccatctcccagggcttgccttgctcccacagtagactttagccttaggggtactgttggatctgaacagagcagggtgatcttgcccatgagacagggtgagtccaacctgagtatccctgtctgctggcctctcccagggccccagcctggccacacctgcatttagtgcagcctccccaaactggagcctcctctgtgccctcctcagactggagcctcctctgtgctgctttgccagcatgcacttgcccacggccacacaccacatcactttgtcaatgcatgtgtgcataggcagaccttgctgcttgttctctacaggtgctgtgtgtgcttggactccactgtgccactgttgctggtatgagtgcaaactaccccaccaccacttggccattgctggcacacacacacacacgtggatgtcagcagctctgctgcctccctcagcaccccctccaaccccactccaaacctccccaccccagtccacaccatgcccccaccaccaccactgcaaacacctgcatagaggccagtactgctatgcctgccagcgccccagtacagtcagcaagcatgcaccctgccatgttgcccactgctggcctgtgtaaaagagcaaagttcctgctgtcactgcctgataaagtgctttggctgacatcacccattggaatactgtgatcagcagtcctggaaaaccttggcccttccagtgcagcaagcttctaatgtgaagtcagggagaaaaagccaggggcctgatgccaccccccccagaattagagtatgcagagccttggctccctaaagtcctccagaaatgatgccagttgactgaacccctgttataacatgatcaaacccccaaggatatcaaagataaaagaaaaataaaaagctcactcaaaggaaagcaatgccaaagactgaaggaatatcagcacacgaagataagaaagaaccagtgttataactctagtaactcaaaaagccagagtatcttcttacttccaaatgaccacactagttccataccaatggttcctatccaggctgaaatggctgaaatgacagaaacagaaagcagaatatggatattcaataagaacacatattattgaaaatcaggagaaagtcaagcccaattcaaagattctatgccttacactttcactacataggagatgaaagatgaaatggccattgaaaagaaagaaggaaggaaggaaggaaagagagagaaagagaaaggaaaagaaaagaaaaggaaaagaaaaagaaactactctgatagagttgaaaaactcacttcaagaatttcagaatacaaacacaagtattaactacataatgaaccaagatgaggaaagtatctcagagctagaagactggctcacttaaatgacacagacaaacatttttaaaaaataaaggagaatgaataaaatgtccaagaaatatgagattatataaagagaccaagtctatgactcattatcatccctgaaaagagaatgagagaaagcaagcaacttgaaaaacaactgagaatattgtatattgaagactggagaatttacccaacctcactagagaggccaacattcaaattcagtaaatgcaaataacccctgcaaaatactacacaaaaagaccatcctgaagacacacagtcatcagatttaccaaggtcaaaatgaaagaaaaaaatgttaaaggcagctagagagaaaggactggtcacctacaaagggaaccccatcaggctaacagcagacctttcagtggaaaccctataagcaagaagagatttggggcctatgtttagcattcttaaagaaaataaattccaaccaagaatttcatatccagccaaattaagcttcataagtgaagaagaaagaagattattttcagacaagtaaatgctaaagaaattcattacaaccagacctaccttacacaaggatttgaaggaagttctaaacatggaaaggaaaactagttactagccactacaaaaacatacttcagaatatagaccagtgacactttaaagcaaccacacaaacaagtctgcataataaccagctaacaacacagtgatgggatcaaaactgcaaatatcaatactaattggtatggtttgtctgagtccccacccaagtctcacctcgaattgtaataatcctcatgtgtcaagggcaaggccaggtatagataattgaatcatgggaggggtatcccccacactgttcttggggtagtgaataagtatcatgaggtctgatggttttataaatgcgaactcccctacccatgatctcttgcctgctaccatgtaagaggtgcctttgcttttcttttgccttacaccattattgtgaggcctccccagccatgtggaactgtaagtccattaaacctctttcctttataaattacccagtcttgggtatgtctttattagcagaatgggaatagactaaaacagtaagttggtactgggtagtggggcactgctgtaaagatatccaaaaatgtggaagcacatttggaactgggtaacaggcagaggctggaacagtttggagggctcagaagaagatagaaaaatgtgggaatgtttagaacttcctggagacttgctgaatggctttgcccaaaatgctgatagtgatatagataataaagtccaggctgaggtggccttagatggagatgaggaacttgttgaactggagtaaagaacactattgccatgcaaagggaatggtcacatgttgcccctaccctagagatctgtggaactttgaacgtgtgagagataatttagggtatctggcagaaggtcaaagggttcaagaggaagcagagcataaagaattggaaaatttgcagcctgatgatgcaacagaaaaaaaaaatggggggggagaaattcaagcaagttgcagaaatttgcataagtaacaagcattcaaatgttaatcaccaaggtaatagggaaaatgtctctggggcatgtcagagaccttcaaggcagcccctgccatcaggcttagaagggaaaaatggttttatggactgggcccagggactcctgctctatgcagactccagacaagtcgccctgtgtcccagctgcttcagctcaagccattgctaaaaggggccaacttgaagctcaggcttgagttcaagctcaagtttcaaagggtgcagtttccaagtcttggcagcttacatgtggcattgggcatgcaggtgcagagaaatcaaaaattgagatttgggaacttccatctagatttcagaggacgtacggaaatgcttgtatgtccaggctgaagtttgctgcagggacaggaccctaacagaaaaccactgctagggcagtgcagaagggaattgtgggtccccacacagagtccccactggggcactgcctagtggagctgtgagaagagggccattgtcctccaaaccccagaatggtagatccactgacagcttctactgtgtgcttggaaaagccagagacactcaacaacagcctatgaaagcggcctggaggagggctataccctgtaaagccacagaggcagagctgcccaagatcatgggaacccaactcttgcatcagtgtgacctggatgtgagacatggagtcaaaggagatcattctggagctttaagatttgactgccccactggattatggagttgtatgggcctgtagttcctttgtttaggccaatttctccaatttgaaatgggtgtatttacccaaatgcccattacattgtatctaggaagtaactaacttgcttttgattttacaggctcataggcagaagggacttttctcagatgaggctttggactgtggagttttgagttaatgctgaaatcagttaagactttgcaggactgttggagaggcatgattggtcttgaaatgtgaggacatgagatttaggaggtgttggggtagaatgataggtttggctgtgtccttaccctaatctcaccttgaattgtaataatgcccatgcatcaaggatggggccaggtggggataattgaatcatgggggatgtttcccccatgccattttcctggtaatgaataagtctcacaagatctgaagctttttcaaatgggagttccactgcacaagttctcttctgtgttgtaagacatgcctttgcttctcctttcgtggactgggcccaggcatcctcagccatgattttgaggaatcctcagccatgtggaactgttagtccattaaatttatttcctttacaagttacccagtcccaggtttatctttactggcagtgtgagaacagactaatacactaacctagtatataaatgagctaaatgtcccaattaaaagtcacagagtggcaagttgaataaagaagcaagacccaactgtatgctgcctttaagagaaccatctaacaagcaatgacacgcatagactcaaagtaaagggatggagaaaaatctaccaagcaaaaggtaaacagaataaaagcaagagttgttattcaaatttcattcaaaaccgactttaaatcaacaaaaattttaaaacaacaaaaagagtattacataacggtaaaggcaagaactaagtatcctaaataggcatgcacccaacacaggtgcacccagatttataaagcaagtacttagagacctatgaagagacttagataaccaaacaatcatagtgggagacttcaacacaccactgagagtattagactgatcattgaggtagaaaactacaatttttttttagtttaattcagggcctgaactcaacaactgaccaaatagaccaaatagacatctacagaaatctaaagagagaaagtcaaactatcccagttttcagatgatacaattctataaatagaaaatcccacagtctctacccaaaagcttcttgagctaataaataaatacaggaaagtttcaggacacaaaattaatgtgcaaaaattagcagcatttctatacaccaagaatatccaacctgagagtcaaatcaagaacgcaatcccattcacaattgccacaagaagaatgaaatacataggaatacagctaatcagagaggtaagaaatctctacaacaagaattacaaaacattactcaaaaaaataggaaatgacacaaagaaacagaaaaacattccctattcatggacaggaagaagcaatattgttaaaatggtcatactgcccaaagcaatttatagattcaatgccattcctatcaaactaacaatgacactctttaaataatgagaaaaaatgatcttaaaattcatatggaaccaaaaaaagctcaaatagcttgggcaaccctaagcaaaaataacaaagcctgagacatgatgttacaggatttcaaagtacactacaaggctacagtgaccaaatagcatggtatggtacagaaacagacacatagaccagtggaacagaataaagatcccagaaataatgctgaacccccatgatcatcagatctttgacaaagtcaacaaaaacaaaagatggggaaaggattccctattcattagatagcgctaggataactggctaactatacgcagaagatcaaaactggaccccttacttacaccgtatacaaaaatcaactcaaaatggattgaagacttaaatataaacctaaaactataaacatcctggatgataccttagaaaactggacataagaactggcaaagatttcatgccaaagacaccaaaagcaattgcaacaaaagcaaaaattgacaaatgggacctaattaaactaaagtgcttcagtgcagcaaaacaaaacaaacaaacaacaacaccaacaacacaatctatcaacagactaaacagacaacctacagaatgggagaatatatttgcaaactatgttgtctgataaagatctaaattcagaatccataaagaacttaagtcgacaagcataaaagaaacaaccccattaaaaagtggccaaaggcatgaagagacacttttcaaaagaagacatacgtgcagcctacaagtatatgaaaaaaaatgctcagcgtcactaatcattagagaaatccaaatcaaagccaaaaagtgatatcatctcacatgagtcagtatagttattattagaacatcaaaaaataacagatgctggtgaggttgcagagaaaagagaacaccttgctggtgggaatgtaaattcattcagcctttacagaaatcagtttgacaatttctgaaaggactcaaagcaaagttaccatttaacccagaaatcccattattgtgtgtatacccaaagggatattaattattctgtcaaaaagacacaggcacacatatgttcactgcagccttatttacaatagcaaagacatgtaatcaacccaaatgcccatcaacagtagactaataaagaaaatgtagtacatgcatagcatggaatgctgcacagacataaaaatcaatgagatcagttcttttaaggatcatggatggagctggaggccattatcctaaatgaactaacacaggaaaataaaaccaaatactgcagcttgcctgtataacaaacatgcacatgtatacatgaacctaaaagttaaaaaagacagaatattaaaaaaaatgaaactgcaatttaatacatagtttaaatagtaagtcatattttaaaaaattaagtagttagcaaataaacagttaacagaaagagaaatttaaattatttgcaatataacaaaaggaacaaaagatgtaaaatatgacacaaatttaaagaaaacaacaaaatctaacacatacctaacagaaatccacaaaggtatactgtaaaaaaaattgagaaggattacgaagagataatgaaaagtaaattccagatattctcaaagataaatactcagatctagacagtgccaaaaaactcaagcatggtacatttaaaaatactttctaaacaaatgatgctggaatggttaccacatgtaaaaacaaatgtatttctagacatagaccttacatagtttacagaaaaataacacagaaattcagaatggatcataaatgttgctgtggaatgactgtttatgtccacacaaaagcggtaaaatccaaaatcccaaagtaatggtaataggaggtgaggcctttgagatatgattaggatgtaggaccagaaccctcatgaatagaattagtgccccataaacgagaccccagcaatatatctggccccttctgccatgtgaggatacattacaaagtcagccatctatgaaccaggatgtgagctcttaccagacaccaattctgctggtgccttgatgatgaacttccgagtcttcaaaattgtgagaaataaatttcttctgtttataagtcatttagcctatggcatttttgttacagaagtttgaatgaaataatatagacccaatgtgaaatgcaaaataatgaaagcaaaagagaagaaaaggaaagaagaactgaaagaagggaaaatgttgaggctgttatcagaagaatcatactaaaggcaagtttaacatacaacagaaaaggattaatttcatcacacattaattcttggcaaacatgttatattcaataccaagatcatttactacatttaaaatgtactttaatgagtcaaaagtcaatgtaatcaattttcagagtaaaaaaaatcagcataatgtctgatatatttaaatactgattttcatttaataagtaattgactgaagcatttgtttccaattttaattgcataaaagttttgaatttaacatatgcatgttaatagctgacacctaaatttacctggaaactaaagccatgatatgaatactacgctaaaaatagtaaaaatgtgtttgtttttttgttttccaattattaaccctctccctctacagtccatgtatggcaagatagtaatcacccaaagacttcattcatgtttattggctgtcagtcacttagtcaggatacaaaacatatgattacttccttcactgttttattatttttgtttatgctattgttgtttggaaagatttaatacaataacatacaacttttttatatgaaatacattgcttggggaaagtgattctaataaaacgaaactttgtatgctgttagttgaacagatataaccatctttcccttatatgagaaacatatttataataattacagtgttgatgccgtacaaaattgtatatacacatacacacatacacactacactatgcatatatattttacaataggacaaaactatatatatatagaaatacagtcattcattgcttaataatgggatacattctgataaatgagtcattaggttttttgtagttgtgtgaatatcattgagcgtacctacacaaatttatgtggtgcagcctactacacatgtatatggtctagtctattgctcctaggctacaaacctgtgccacattttactatactgaatactgtaggcaattgaaacacaatggtatttgtttatctaaacctagctaaacatataatggtacagtaaaaatacggtattataatcttatgggatcgccattatatatacagtccatcattggcatcattattcagcacatggctgtatatatactcaacactccatattcattggttccatatatgaggattcaataaactctcagtcaaaattttgaggggaaaaaaaaccctgtgtctgcactgaacacatacaatttattgtcataattccctaaacaatacagtacaattatttacataatatttacattttattcggtaccgtaggtcatctagagattatttaaagcatatagggggatgtgcatagattatatgtaatattatgccactttatatgaagttcttgagcatctacaaattttggtatcaaccccacagattgtgaaagatgactgtatattttcacacaaacatatatatatatatatatatatatatatatatatataaaatatataatatggggatgtacacaaacatttggaaatatattccattttcgtgtgtgtgtgtgtgtgtgtgtgtttgtgtgtgtgtgtatggaaatatgaagtaatgggttattgaaacctaaagttaaataagacatgctccatggggggaaacattgtacagagaagagacttgtaagacaataatggtatggaatatttctaaaaatatctcgtgaggacacttggggtccccaagaccctttcatgggatctgggaattcaaattattttatataatataatgctttatttgccattttcactctcattttctcatgataaccatgaagttttaaaaggctacatgtattgtgagtacattgttactctgagagctagcaaaatatgtattcttgtgtttaaaaatattgttttaatttctaatagagtaatgtcaatagatataacccacataaacagaagctctttggagtcctcaataattttaagagagaaaaagggtcttgaaagcaaaaaaaaattcagaaccactttttagataggacatgaattctattgagaaatgcaaaaggtgtttagggaaatgaggagaaaatttactaagaaaattatagtttgttaagggagcaagatgagggactgctaaaatagactcaggttagccctgaaaattcagtcttgtttacccagtcttattatttcccaatgacatgaaacctatagagagtggggaagtctcaataaagggagagatttgtgtataattttgagatgccaaccaataatataggttctaagaatatatgattaaacaggaaacagattacttatacagagttttagctgaaatgagtccacctaaggattgggcatatttttttccatacaaagggaggtattaacaccttcccaagacctattaaggtgacaaatatgtaactgtttaattagggtaatagagactccaatgtggacacttcataatgcaactgacatgctatgaactgccattttactgagtcacattactttctttcactgtaaatgacataattgacatgttatgaactgcctttttattgagacacattatttctttcactgtaaatgacatatctcagatatcctaaaatataatttaaaactcttagtaaaatcaaattttcttaaattcatatactattatttagtgattaaacttattttaatagttaaatttaaaatatgtttagtatctagatatttgaggcttttatacatgatgtttgcattcaaggatcatgagattcagaaagttaaaatcaagcttttatttgcctaagaaacaagatatatttgcctcgcttttgacagtattataaaaggcatcactgatgaaaaccacttatacatataaagccactttaacagatgtaaagaacattgttgataagaaaccaccaatattaggtattatattttattaggtattttagattcagtggcactggcactggtgattatttcttccttttcctaaagaataaaaagatctgtcaaattgcttatcttttctacatgcatttccactgaaaaaatattcagggttgtcaagtcctaatacattattgggaaattatagctgttatttttaacataaattaagcagtcctagatattttacatgacaggtttacaattttcactgagaatgaccatgtagatactttagaaaagccatcaatgtgtgactcatcattacattattgcagtgttcatgttgaaaggaacaccagataagcttagctttttgatcctgatgacgaaggtctccatattaccaataaaaataagtgaacctggtgatttctcattatctctcttaaatagatagatttatttatgtgtgtgtgtgtgtgtgtgtgtgtgtgtgtatgtgtatgtgtatgagggaatactctgcttcattttagcttaagtattaattttgagctgttgaaaatgctttgcagactcaggaaattttgaaggatggagcatcgccactctcctatccaatattatttagtaaaattatgcctgacatgttatccattatacttaagatacttacgatttcttaagaaattctcttctcaagagggaaatgatgctaacaacaatggtaacaaggcttttctccttcatctcttcatttttctcatctatattttaaaaacttcctttgccaaaaacagtgtgttaatagtgtcaccatctgagtgtattctgtcaaaatatagcttgcacaactcacgagtgttactaatatttttgggtatttcctattgatatttttaagaatgatttgtagtactgtaggtgatgtgccatatatgagactattttctcaacaataatctttatatatactttggatcaacttttgtcttatcagaattattattaatgtatttgatgttccaatggttacaatattttttagtatagtaatagtaagtagaattgctttaaaaaaaggaatgatatgtatctgtccaagaaccaagatacctaccattgagagcctcttgaaaacctaaagaaagcagctttgagattcctgagagtttaaacaaagtggttgtaggggagagtctacaacattatggtaactgtgcacaaggatatcctttgatataaaacacagccatgaagctctcattgtagaaacaagcaaggtgggtctccagaaagaaactgcggctgtatatttacctctattctgctactcacaaatggtctgaaagagtggcctttgtgaacaaggtaacctcttaagaaacatcttggaattcttgatttgaaagtttgaaaaagcattattaacgggtaacaggatataagaaatggcaaaatacatcttcaatagtgtaaatctcactcaccacaataaaatctattaactgaatatgacagcgttccatgataatggaaaacaaatgcaagaggaaggaagtgaagatgacatgcaaaataatcactaatattcatgatataggagatgtacatcaaaactggctgccatttacagtcactacaagggaaattaacttaaaaagtttgacataaaagagtaaatagaaacaagtggtgtaacatttatttttctatgtaaatgtcaattatttgtgaagaccaatatggtttattaggatacttgtttctcttattctctggttaccaaattaaacattgagatattttagtataaaatagcaaaaggtgataaagatatatgtcttttatataaacattaaatatgatacttttgctgttcattaaataacgttttctaggtctcacattttatggcagttaatggatatttgatactatttaaggtttaaaccaaaagccagatatcaaataaaactatagtacttgatttgattgtgaactggaagaggtcccccattggcaaaggataaggcaaattgtgtgtcaataacaagagctaaaataaatagaactagatcaaatccataacttccaattgacactaaaaatatatctcatattgatgacatttggaggatactagagaaccaaattattgatcataaaactaatcaatatcagtaaagaataaagtatcttgctgacatggtttggctgtgtccccacccaaatctcatcttgaactgtagctcccacaattcctatgtgttgtgaaagggacccagtgggagataattgaatcatgggagtggtttaccccacaatgttctcataatattgaataagtgtcaaaagatctgatggttttataaggagtttccttttttagcttggctttcattctcttttgcctgccaccatgtaagacacgcctttcgccttctgccttgattgtgagacctctccagccatgtggaactgtgaatccattaaaccttttcttctttataaattaccctgagtcaggtgtgtctttatcagcagcatgaaaacaaactaatacacctgcttttcctttataagatgtgcaagagacagacttgccacacatcttttacatgacaacagaaaactatttcttgaatgcatacttttactagctaataaaacacatgaaagtcactacttttaacatataaagatagagtcaacaaatataataaaataatgtggtaatttggagtgtataaattatgctcaaacaaacttgaacccaattataactttaacatcataataagagagagaactcagaatttatgtgattaccaatgcaagtacccagcaccatagaataaatatttctataaacaaacaaatgaacaggaactctgaatcagattaatactttacagatttaggggaaatgtaggggagagagggtgagactggcaaaactcaaagtaaggggaactgtacagtacaaatcatcttttttttggttgttgttgtttgtttcaataagaatttcaagaaatagaaataaaagaggatgtattttaaatggcagggaagagacaagaaaaatatgtgaaatttttagtaaacaaaataacagaaatcagtaaacaattgggagaactgagcactggttagtttggttaatatttgatgctgtcaagaattaactgttaattttttaaatattatggtattattatttaaagaattcatatattttagatatttacagaggatgttatttgatgtattaaaataatacaattatgtaggtaagcagaaaacaagatttgtcatgatctactaattattgaagtgttgggggtatggaacaggaacgttggaatttcttataatattccatgtcagtgccggttacataatttttcttaataaaaatttcaagaaaaaaaagctaaagaaaacataaaaggaaacttgatggccatggttctttagcttttgtatggaactagtcttaaatgtaaaggaatgtaaaccttggcaatccttggagagggaaaggattattagcatccatgcaaactggaaagcttattgtccatttattttaaaataaatgctgatatttatatgttccttacatttttcatactttaaaataaataaaatgatattttatttctaataattgtcatttatatttttggcttatttatacttctagcacgccacttcaagccctaggtataggtatagtcagtgtgcacatatgtagcagttgaattaccagatatttgattttgtgaaatgcatttagtttcccgtatctcattactctgatgttcataactagggtgctccatatatatatatatatatatatgtgtgtgtgtgtgtgtgtgtgtgtgtgtgtgtgtgtgtgtgtatgtgtatatatctatatatatatatatattttttttttgagacagagtttcgctcttgttgcccaggctggagtgcaatggcgtgatctcggctcaccgcaacctctgtctcccgggttcaagcgattatcctgcctcagccccccaagtaggtgggattacaaacatgtgccaccatgcctggctaattttgtatttttagtaaagacatggcttctccatgttggtcaggctggtctcaaactcctgacctcaggtcatccgcctgcctcagcttcccaaagtgctggcattacaggcgtgagccatggtgcccggctgggtgctccatatttttatttttttctatctgtattgtatttcactgtttttatttttataaagagtaatgattcttaaactgagactctgaatgtctagttttccacaatatttaaaaagtctgatattccaatatcaaaaaatctagattgttatttggtaataactttattttggtatgaagacatttttaaaacatggctctatggagaaaataattacctccttggtgctaaaaatgtaaaggattatttatacagagtatgctgaatgctttaaaacagaactattattagattatacctcctcatatgtagtccctgtattttagtattgtcaccatttgtcttgaatattttcattaataaaaacctgttataactgactgaaataaagataatttatatttaggtagtcaaaacatttaaagagtggattgcaatctgctatggggtctcaaacatagttgtgcttcttcctaagtatccatagcccctttttgctgtttacgctgattcccaagaataaggacaaaacccagaagtgcagctttttcaatttcttcttcctttcaacttatagataagttaatcaatgacctcccattagatctgcctccaagggtatggtactattgtcttactaaatgatggagatatggagagcctgagaagggggagggcaggtgaaaaagttctggagaataagagaggaactgtgtgaaacatatgtgagagtgtcagagagggaaagagcaaaagtgactttaaagcaaaaagaaaatccttgttggttaaacgtttactgattaggagattagggaatgaaaaaataaaaaacaagaaaatcatgtgatatttaaaaatctttgaaagactttcccttcccttggtgattcacatactatcagctatcagaggtcagcatgacgtagggataattgctagtaatttgcttgtggtaattaagaaagtttaaagagatacttccagataaatcaacagcaaagcattaatgacaggttggaaagactggagagatcagagtcacacaggaaacgcacagtttgttattatagttgtccagcccacttaccaaaggaaattataaactatgattttttttaatctaaatctaaaaacacagttagaagatgggttgtgctgcaaagatgacctttctcttgagaaaaggggtaacttgtagttcctcataatagctatagttttaaatgttatatgattaagtatcatttgagaagcttgtttaaaaagcagacgccttagtctttagacccttgcaaattttatgattcaatgaccttggggtggtacccattttttgttgatctgtgtaccacaactttaaaaatacttttctagaatgaggtttctcaatctcagaactattgacattttggcccagatagttctttgttgtggggaattggtttgtgtattgtaggatgtgatgtgtttcagcacatgctatcccaaaatatggcaccttggtatttgaaaaaaaaaaaaaaaaaaaaaaaaaaaaaacagtagaagttggaagttctctctgactttctcccttgcagcagggcataaaacaattctctgggccgggcgcagtggctcctgcctgtaatcccagcactttgtgagggcgacacgggtggatcaagaggtcaagggattgagaccatcctggccaacatggtgaaaccccctctctactaaaaatacaaaaattacctgggcatggtggtgcccacctgtagtcccaactactcaggaggctgaggcaggacaatcgcttgaacccaggaggcagaggttgcagtgagccaaggtcacaccactgcactccagcctggcaacagagctagactctgtgtcaaaataaataaataaataaacaaataaaaataattatctgatcttcctctaaagtaattcataaaacctttattccagagggtctgtcctatcctaaacgtggaggaaagtaatgtccttatttctgaagacactgagacacaaagaagaatctgaataaacagggcttgctaaattccatcctctaccctttcaccccctcatccccatttattactattagatcagaccctttcgctctccaaacaaacttctctacagctgtccatgaaaaacatagctttccgtttcttcatttctgaaggctcccgtgttacttaaagcttgtacaaaataagtacaataatctgtaggcttttctcttgttaatctgctttttgttatacgggagtctcagccatgaacctagcaattggtgaggaaatacatcttttctgtgctacaaaagtttagcagcaccattggcctctacccactagatgccaatagcagccctgaccccaactccctcaattgtaacagctaaaagtctctccgttcagtgtcaaatacccacgagtgcataattgtttccagttgaggatctcagaaagtataaggagttttaaggcagagtctggtatttcagaaacacaaaataagaaatacagagcctcaagatgaaaaataaaactaaaatctcagatgataaaatgaaaaataaaataggcagaagagtgggttgggttggagaaaaaaattatggttctactggagccagatggtgaatatgaaacttttcacacagaaaattatttccacaaggacagttgtctgtaatgtcacataacagcaatactgagaggaatcatacccagggtcgagaatataaaaatgcattgctgacctcaaacttcatcagtatgcctgatgtgttatcccttgtctctgcttccaaagccccatagattaaactaaatccatttattccttcttccaatttataattgtaatgtgggaaataatgatatgaaaggaatcggatattaactgtagtaacatactagaatgtatggtccttggcaagggattagtttataaattttgtatcaggcattctgattcggcaaagtgtactttggatagggtaaaaaaattcaaaggtacttattaatagtttcatatcagtctccacatgttggtctctaataatatattagaaagctctgttgtaggacatgaccttttcaacatttatcaatgagattagtaaagatgtagaaggtgcatttatcacattttccataaatgaaaaatttaagggatagtggtgacagaataaaaatatcctaagtaggtataagaatgaaaggaaataattaacgaaatatagagacaattcacagaatgggagaaaatctttgaaaactatccatctgacaaaggcttaataaccagaatatattaggagctcaagcaattcaataggaaaaaaatagtctaattaaaaaatagcaaaagatctctagacatttatcaaaagaagagatacaaatagccaaaaactatatggaaaaaaagctcaacattaataatcattagagaaatgcaaatcagattacaatgagatatcatctcaccccagttaaaatggttttatcccaacaagaggcaataactaatgcaggagaggatgtggtgaaaggggaactctcaaacactgttggtgggaatgtaagttagtacaaccacaacagtataaacgtccctcaaaaaaactaaaagtaaaattaccatatgatccagcaatcccacttctgggtatatatctgaaaaaaaggaatcaacatggtgaagagatacctgcactcctatgcttattgtatgactattcgcaatgaccaagatatggaatcaactgaattgtctatcaacagataaatcaataaatagcaggtagtacacatacacaaaagaatattattcttaaaatccttattattaaaatcctggctggggacagtggctcacgcctgtatcccagcactcggggagaccaagacaggcggatcacttgaggtcaggagttcaagaccagcttggccaacatggtgaaatcctgtctctactaaaaatataaaaactagctgagagtggtggggtgcacttgtaatccctgccacttgggatgctgaagcaggggaatcgcttggacccaggagggagatggcaaatgttgcagtgagccgagaccatgtcactgcactccagctcaggtgacagagactgagactccatctcaaaaacaaaacaaaacaaaaaaacaaacaaacaaaatcctttgattggcaacaacgtggatggaactggaggacattatgttaagggatgtaagccaggcaccgtaaaacaaatgtggcatgttcttattcacatgtgaaagctaaaaataaagaagaagaataaaagaaagactactctggagtagaattattgttaccagaggcttggaagagtagctggtagagggggtaaagataggatggctagtgggtacaaaaacacagttagatagcatgaataagatttactatttggtagcacaataatgtgatcatagttaacaagaatctattatgtattttaaaatactgaaagagtagaattggaattttcttaacacaaaggaatggtaaatgcttgtggttctgaatatcccaattaccctaatttaattattacatactgtatgcctgtattaaaacatcacatgtgcccaataaatacatacaacaattatgtaaccataacaattaacaacaacaacaacaacaacaacaaagaatttactacaatgaggacatttggagtaacctgctgtcggaccaaggatctagtaatgaggatataggatagtgaattctggttctgtacatggaacatgtataaacaagatgtaagggttccattgaaataaaacaatgcattttaacagcatagtggaaatacaaaaatgccagtgtatttttagttgcattaatcaatgtatacataacagatacaaaaggtttttctatgctgcattggttagatcccatcaagagttttataaatagtttcaggacacataagaaaaataacattgagaaattagaacacacccaggactctataaataaaatgataaactgttttgaagccatcttacagagggactgattgacagtccagactataaaatagcaaatcggatcttaccagcttttagttaataattggccactcgagtctaattttaaataaaaatttatgaaaaacacttgagtacatggaaaggtgtataaagagaaatcagtattaagccaagtataatctaactttattgttttctttagtccactttgactaaggagggagcttgctccaccaatgaaatcttacctggaaacattaaacaaagaaaaaaaaaacccacaaatagttgttttttgaaagagaaagataaagagactgtcgtatcttatctacacaattctgtagagcattatacaaaagtaactctcattaattgaattgtatatttttaaatttccatttagtattaagaagttaatatttaaatagaaaaaagtatagattctacaaaatatacatatagacacccatgtatagacacacatacatatatatagtaccaatatactttatgtaaaatataatctgtataattgtatatatataaaatacatacacatactaatgtaatatatacatatattacatttcatatatcttatatatggtatttttacatttattatggtcaccataagagcacataacctggtttacatggaacaatgttggtttatacctgtagcactggagtgattgttgcagcatctcctacacccaaaattatcctggtataaatgataaagtatatggttttcttatgatgggaagttaatcatctcatactagactactcagtgtgcatttgttatgtttcagggaatatgccacaatcacataaaacttcacgtatctgcatggattactgcctttgagaatttttttaattatggaaatcagcaatataatatattcgtgtacaacaaatatcttatttttagtaatcttctttccaagaaataatattattaacttaataaataactaaagcagatcagaaaatcaagaatcttttctctcaatataaaaataagagtgaaaatattttatattttattaatgatagcatgaagtatgataatgaatctatgagattttgtaatatttcagccaaatgagttttatgtaacaaacatttatacttctcaagattaaagaaatttaatggatttattgtgcctaataattaaaggctgatttgataagctcagtgacttattcatttagaatacatcttacgattcacattcttatagactataatttgtcaaaataccccaggattccaaaatttacacaatttgaaatctcattttcttttattttgttttctttttcactctggtaggacctttaaagcttttcattcaccttcaattttttaaatcacatcaaagctcttagtagtaaatttaattagccaaatagtggagattaattgcttaaataatacatgtcaagatataatacccttggtacaaaatcaagctcttacacattatatttaaaagccctttctttcacatttaaaggctactataattccctacggtacctatcaacaatagattcatctatatacacatttatcctatgtaaaattaattttaaaaacacataagcaatagaaataatatcatttatgaaaaaagtctttacctataatatttttgaaagtaagtaactatcatactcaatgacaaattggaatgttataaaatgggagaatttaacaagaatttgatttttaagctaatgatagtaataaaagtatttattcagtaattgccaatttaatcaataattattctaaatgctttgcatgtatcaactttgtatcaatttccaaacccatcttatgaggtagacactattattttttctcatattctagattagcatccttttttttttttttgagacagagtctctccctgtcgcctgactggagtgcactgacgcgatcttggcttactccaaccacccgctcccgggttcaagtgattctctagcctcagcctcccgagtagctgggactacaggcatgcgccaccacgcccagctaattttttttgtatatacatacatatgcatatatatatatatatatatatatatatatatatatatatatattttttttttttttttttttttttttagtagagatggggtttcaccatgttgcccaggatggtatccatctgaccttgtgatctgcccacctcagccagcctaagagctgggatcacaggcaggagccacccttcccggacacaactttttttttaattgatcaagttttggattatcaattagatttgaacaggattagagcactagtagaacagatattaacatcagccaggtcaaaaaattaatatttccaagaaaatcaatcttttcattttatttgaatatgtatattgttaatggcaaaaataaaattttattttccctgaatcaatttttttaatatttctttttagtagcattgtttctatttttcctttgttttgtgaatgacctacaagattatacccattttttcaaatttctttagatcaattataggattaatacaattgggaaatcattatttgaatcttatgattaaactgtacattatattaaagcacatacaatgttataaagcatttaatttaaaagtagtttatataatttgttttatctgtcttttctaatattctagaaattggagaaattatattaggtcatagaattgtgcatagtaatattaatttgtgtttgttttactttttattatttatttatttattttttagtttttaaattttttaaaaggtggggtcttgctgtgtttcccaggctggcctcaaactcctgggctcaagcaatcctcctgtttcagcctccaaagtagttgggactacagatgtgaatcattgtgcctgtggttgttttaaatagataaccaggcttttaatttcttgtcacactgattttggcaggactaaaattagaagcagcctctctcctggtcttaaaatatgatggactccttaacaaaattctcccagtgtctcacagactcttctttaagggagatgaaaagtacctctgagaagaaataagctgaggagggcacatttctggagactagagagacagaaaaggtggtattttgttttataagcatcagggacttgagttttgtctgttctccagaaggacctgagagtgtaagggctgtgagctgtttctaggaagcctgagtccttgcagtatgatggatctcataaccaaatttcctatactccaaatttggaatgggaaaaccaaatgcatagaggcataagggaccatgcaggacacaacaaagtgcttttcaacagaaaccaatatgggtctctgaacaaaaggacctgacaaagtatcttcctggacttatgcacaattttagcaggccaagttgggtgggagtgagtagaacatttaatgactagatatgagtttatagccagcttgaaaggagaaattcttgaaggcagaatcaggtaatttaccaaactaaggaattaaaagatgttttcagttgtgtcagagtgaaatgcatgctgtctacaattgtgaaaaacagagatatatgtatgctatcaaaaacaaaaaccaacttttattctagagttaattgatggtatgacctggaattgaaatggtaacatcattagagatggcctttacctccttgtacttttctccatctgttctattctctgccctctaccaaatatctttctctctttactcaggcttcttttttctctgatctattatcttttcacatgtcacctcttcttaccttatttatatcataatcttccttttcccccccaatataactggcaagattcctgtagttaacaattcaaatatctgaaaaagagattctaattgattcagcccatcttgaaaaaaaaaaatcacatgcctaaggtcttgggtcactaaataatatgtgtattgactggtggtgtagcttgtatccaactctgatcaattggtattagctgagggtggaagtaaatgatttacatggtttgaacttttattaacttattcaaacaaggaaacaaataactattgaacacatattacgtgccaggcatgttctatgcacagtcaataaaatagttagaaaaacagaaaaaaactcaatgccttcaaaaagcttacatggtaaattttaaaataaccacatttaatatgttaaatatattgaatgatatttggcggaggttgcagagaaaaataaagcataataggtgataaagaggaggtgttataattttaggtagggtgaatgaggagatatttattggagaggtagtatttgaatacacaatttaaggaagtgagcaaacaagtcatagagataccaggcagaaaagccttacaggaagaatgagatgaaatatatatgtattcagatggaagtgtgcttggcaatattcaaggaatattaagaagtccactgtggctgcaatggggtgagcctggaagaaatgataggagtatatgttttgtaaatcattgtgattatcttggcttttaatcagagttatatagatagccgttagaaaatttccatctgaggatacacacatttggattttggtttgaagagatttctattctagctactattttatgaataaaattcatggggttcaggggaaagcagagagataaattaggagtttattgcagtaatttaaagcagagatgacagtgactaggaccagaacaatgagaaggggtcaaacacactttgaagttaaaatcaaaacttttcactaacagattttacatgatgtgggaataaaagaagacagtcaaagattatccaaaagagactgttggtccacgcaactagtaggagggaatagctgtaaactgaggtgggaaagacttgacagaagcagctttagaggaaaaataatcagaagctcagtttgggtcagattatgtttgagatattcaaccagagatggctaataggcagttgattatagacttcaaggaataggtccacgcttgaaaaacaaatttaggagtaattactgtatggattggatttacggttctgtgactgaaagacacaatcaagggaattcatatgcactaaagaaaaaaggtccaaggattgcactctgggtctgccagagcagagaggataacactataaagttgtacttagaaagcagtaagtaacataatgctacgtattacaatagtattttatcgaccctctttatcttccttttgaaggattttgcataaatgttttctgggtcatgatctaggtcaagcaaaaaaatctcagaatagagattatttaagaagtctcttactatatctctatatctctctgtttctttgtattaaaatctctcaaatatactatgtcctaaaagtgtgtgtgtgtgtctctctctctctctctatatatatatatatggtcagaattatagttatattgatacttatttttgattaaaaaagttgtcttttaatcaacattttcaggaaaattctatttgctagccatgacataatttaaaatataccgaaagccagtatacccattcatggtgatgactggtgcattcctgtctaaaaacaaggagtatatctcagtgtttgaggatgctatatatcacctcaaggctctcaaagtgccatccatcatcatgttgtataaaatgaaaggtgaaccactttactgtgagaataactatatagcaccacttcaaagccctaagccagagttgaactatggcaattcctccaccctcttgtcggtcctgtactctataaatcagacctatatgattgctgaaaacatcagctaaaatttacagtagtttaaaaactcaaggatagaaaaatcaaattttttcaattctcattttatttgcaatggtacactgtccctgatactactattttcttgtgttgtgtgatactttttactcttgttttgaagatcttcatgttttgtataacaacttattttgccttcataagatgttttattatttgtaatattcttatacactctactgaataaatttccaaatttttgagaggatttttttcaagttatacatatatgtaagtcaaagaaattacatttagttttgttattagtaacagtaatatgataaatagtttataatggtgtttgccctgtttattgtggatattaacagtcattagattactcaccataattaacctatgaacaaacactggtaagtaaggatggtatataaaataagatgtaagactatttcaaaaaaaactctaacaacacgcagaatagaattgtgatgccatactcacaaaccttagctaaactaacaaataacctgctattttttgacacatgtaacactacacaatagctcatttgtcatttctaacccacacaaataaaacatataaatacttatatggaagaggtaacaaatagtcttgatcaaagagctaaacagttatagatatttaaaaagtatcaaagaaaaatgaacaaatctgttggtctcaaatatagaagtgttgcatgtgtacacattgcaatgaagaagacactctttttatccaaaattatgtctgaatctttctcctacaatcagaaattctatgtggtcaggaatatggaagtaggaatgtagctttataattgatcttgattttctttggaggatcagctttcccttaattcttataatatactctgattttaatttggggtttatatggatccagcaaaatttatcatagaatgaaacctcctttagatacataaattccattgaatgatccaatgtcgagcatgttttcaaactgaaaacattgaatctctggacctttgcagtgaatgcaaaaagcaaaacaaacaaacgaattaccccacgcattttggaatcatgcaatatgcgttaaactaagcccaggttattcctatctttggacttttttttttttttgctctacaatgagaggttaatatattagtttaagatagtctaaatagagtattatttcttgcagacaggagcattttgactgatgtaggtccaccttggctgctcacggttcctgtgagatgaaagttcaagtgattgagagcagagaatccaggagaagttgggatattagagatatagtcagtacaggttactataaattaggagggtaaaaagattaaagtgagttgggcgcggtgactcacacatgtaatcccagcactttggggggctgaggtgggaggatcacttggctcaggagttcaagaccagactgggcaacatggcaaaaccccatctctacaaaaaataaaaaaaattagccaggcgtggtggcacatacctgtagtcccagctacttgggaggctgtgctgggaggattgcttgaacctaggagctggaggttgtagtgagatgagatcgtgcaactgcactccagcctgggaaatagagggagactggcaaataaaaaataaataaataaaaaatttaagaaaaagagtatagtggaagtttttttacataaaggggaaggcagtttacttaaatgcaaagctataaaatatgctgaggtaatccttaggaagtcaagagctagtgaactgttggtttttacttcaaacagaaataattaacctaagctaatatagttattaacattaaagcctcctgaaacacataaataagtacaataaaactaattatcaatggcttaagcaaccataaattatacacacacaaataaatacatactatttttcattgtatatttaattctttttaggacaaaaattagtggtttagttctacacatgtacttcagcaataggaggcagtcatttctatttcatgtaaattaattaccctagggcattgagaatgctcccagggttgcattgttataaataatagcttcattgaaaacacatttaacctgaatctgattatttcattggtgaatttctacacatgaaattgaagggtcaaagtctttgttttatatattttaaacaaaattatttaagtctgtgcccacaggtcaactagagagctgcctgggcaggagtcattatagaaataattgtttaatacatgttttgcaatttgaaaatcaaaatgttatatttctttttatttttatttgattctcatcagctaaaacttgaaccttttatttataatattataatttcttatatcatacaattgaattgtaagcctaagtcaaaacaaggtctttgaagtctgcttggaatttttgataatgtagggcaattattacaaataatacaaaaatttccatgagtatttttaaaaattttaatcacacaaggaatacttgggcccacatgctgtactagaagacctagttatatatctgcctctgtcattgtcccatgcttccctttccaatattatagacatttagctatttaaatttaattcaatttaaaaaatacaaaatataattcctcaatttcacaagccacatttcaaaggttgaatagactcttttgtctagtggctactatatgaatacacatatagaatatttgcatcattgaagaaaaatatattggagagtgttggtcctgttacgtgtgtttgaaataacacacaaattccattcctttttcctgtgctttctttcattcattccaacaataataacaataataacgaggccctaatgcttgctggagacaagaatttggtaatgaacaaacaaacccctggctttgtgaagaaaacaaacccctgctcacatatatggaagggaagtaaataagtaaacacacaaacatagtgttttatagtaagaaatacattaaagatactaaaatttagaaagttgtattagttaagcttgtctgtgaaatataagaagactatcttggtagagacttaaatgaagagaaggaaaataaaaactttaaggatgtctgtaaatgaaacattccctgtggagggaatagtgcaaatgtgctgagacagggtttttcttactgtgggtcaaggaagaacaataatcccagtgtaactgaaaggaaagaatggtatcaagggccagattacctccatgctgcatctttgaagtcctttaaaggattttggattatacaatgaaataagagagaaagccattggaaacttccaagcaagaggtgagtaatttccttattaatggcatcattctgtctgtcttgtggagaacaaaacattgtggacatgagcaggaatggaaacaaagctaccagagagatgactgggcaggagtctaggtgacagattgcatggacttgatcaatctggcaacaatggaagtgaggagaactattgggtctattgagaatgatgcattctctactggatttattatgtctcccatgtttcttctgtagtcatggaccaggaagacagtgtccagagacttatattgtgctagattgttatttctgttgaggtgtgaagtcccagtgtcctctacctttcctaatcaccagtgctagaagaccctgccaactctcaaaagcactgggctgtttgaaagtaattccagaaccaatgttcatagctaaacaatcatgaacaggctcaagaaaagaatagttttcatgtattttttcattaaaatatttttctagtcacattgacagacatctattcacatcctgtatcttaatgaccatttttctcttgccagttacaaaatgactgcttcctggtgctcttgttttttcaagatataatggttaccatggatacatcaatagattttggatattttgctttttagctctgaaaaattacctcttctcacagcacataacatattgtgtaatgaaaatgaattcaatgagagatcaaatggtaactaaaaaaaagatactatgaaaatagtacattaatagaacatttgctgtaaatacgcaggttcaaatgctcaaagaatcttaaagcaaaatatttataaagatttttcattttcattatcctattgtaagataaagagagtcatggcagaaaagataatctggctgaatccctcttttggaacttttgccttagagagagagcatgcaagctataaagatatctacaaatattttagtattaaataagttgaagagtttaactcatggagggagattccaataactatattgttatcagcttttttttacttcctttctacacttggtataataatccattccatgatatatataatctggtaccatccaactcactctactatcctttcacccagctctaagccacttcctctcaattttctacagaagtaacactcaatccctttcaccatttttccatatagcagacatttaatgttttagagtattggttccagaattgattctgacacaactataaatatctccaaggaaataatttatcatgaatgcattcacacacaggtgtgtatatgtaggggtgaatatataccatatataaactcatatatatatatatatatatatatatatatatatatatatacacacacacacacacacatacatacacacacaaacatacatacatatcattatttaaatgatctgagtactaggaagcctcctaggccaccagggaggtaggaaagtgcgaatgggtactttagaataatgactaattttcaaaatcctttttttcttaacctcctcttctaaaagagaggaaagataattcagagcagagggaagatagataaatagattattatgactttatggagagaaatattagaaataaggagaatgaagtgatgaagaaacagaacagtactgacattctagaatttccacttctagacatcaagtgttcaaattgagcattctgttcatcgaagatagaaaatggagttttaaaaaacaagcaggtgctgacttttactagaaagtgtcaaatcaaaggattttcactgataatttttttcatgttattaaacctaaataggaaaattttctgagaattttggtgcagctctaaagttgaaaaattatctgaatgttttatttttcttttcttgtttttttacacagtatttagtaacatgggaaattctcacacaactgtttggattctaccaattggctcttctcaattgtttaaaaataaatcataacatatctgatttaatcatatgtttttaagtacgtgtggtccacatgttttattatttcttcttcttcttcctcttcctcttcctcttcctcctccccctgtctcctccccctccctctctccctgcttcctccccctctccctcctccccctcccctccccccgctgctgcctcctcctcctcctcctccttcttcttctccttcttcttcttctgccatgtgttagacaaatttaaacctacctaaagagtggcttttcttactgtgttttctcctaatactgtctctgcattcttccaaactactttcaaatttaaaatatcttatatcttctcattcacttctcctccctttatgcgtgactcatgaatacatcctttcaatgacaatttttctatttgaaattggcttcagaggaagaaaaaaaataagtgttgtattatctcatacttttcaactgtattcagtactaaattgatgctttttcatccacgattctattcctactaaccttataagtgggacataatctgtgttttatgcaatttccattatatcattgttgctcaagtaatctggaacataaaacaataataaataagccttctctagggattcaacagtaatccgctttttcactctgataaaattaagtctttataatcccctttttgtttcaaattcaaaccaagccacttcaagtctctttattgtcattgtttgctttctccactgaattcaactgtttatctctttgtctgagaaactcatttattctttcgcttgatattggttcttttcatactgaccatcctaccatacactgctcccaaatctgtgctaatgtttgcttttcaaggaattaatgttttccctttcaaataatgttaaagttgctttcatatgtaatttaatcttctcctaagtagtttccttgattcaacatctctgcgtgttcctgaatgttaagtctcattgctctcttgtcaaaattcctattattttacaaatactgctattattacaagtacaataatactaataaattttgagaggctcttatgtgccacttgtggtgctaaatactttgcatgtatcaattatgtgcattctctccctaaacctttgcataaatattcatctttttattgtttatcagtgaaaatcggagctgaaaatgttaattactcaacttcaaagagctaatgttggtgcaaaaataattgcagtttttgcattgttgaaatttaccatttgataatggaatacatttttgaataaatgtggttatattatacatcactttaatatgtgtttatcactttttttgctaatggcttattacttgctgtttattttatgtttattttagactatggaaattttgttagacaaaaagcaaatttgagtgattttcttattcgagttcaaaaacgggttgtaaagcagcagagacaacttcaaacatgaacgatgcatttggctcaggagttgctaataattttacagtgcagtggtggttcaagaagttttgcaatggagatgagaggctgaaagatgaggaacatagtggccagccatcagaagttgacaatgagcagttgaaagcaatcatcgaagctgatcctcttacaactacaagagaagttgccaaagaacacaatgccaaccattctacggttgttcagaatttgaagcaaatagaaaagtgaaaaagctcgctaagttgttgcctcatgagctgagcgaaaatcaaaaaagtcatcgttttgaagtgttgtctcctcttattttaagcaaaagtaaggctccatttctcttttggactatgatgtgtaccaaaaagtggattttatatgacaaccggtgatgaccagctgagtggttggactgagaagaagctccaaagcacttcacaaagccaaacttgcaccaaaaaaaggtcatagtcactgtttgatggtctgctgctggtctgatccactacggctttcttaatccaggcaaaaccattacatctgaaagtatgctcagcaaatctatgagatgcaccaaaaactgcaacacctgcagctggcattggtcaacagaaagggcccaattctccataacaacacccgactgcacattgcacaaccaatgctttaaaagtagaactaattgggttatgaagttttgcctcatctaccatattcatctgatgtctgaccatccgactaccacttcttcaagcatctctacaactttttgcagggaaaacgcttccacaaccaggagaatgcagaaaatgcttcccaagaggtcgtcaaatcccaaagcacagatttttacactataggaataaacatactcacttctcattggcaaaaatgtgttgattgtattgattcttattttgattaatatagatgtgtttgagcctagttataatgacttaaaattcatggtctgaaaccgcaattacttttgcaccaacctacaaagtggcagagctaggatttgaagtcaactggagaatgttagtggaaagagcaagtgttggttattaaataaaaaatatcctggttctagaccagaaatttgagagaaattttacagaaattttacagaaaaataaaactgatattcctaccttaaaggcagtgtgtgaaagagcaggcaagtgtatacagtatctctttgtcaactttagatctgcttggcctcacatatttatcataccaacagttgctatagcactgagtcctgtgtggactctaataaagttcaggcagatgcaacctgactgagtcttgtttcataacctcatcacacatcacataccttgcacttctacctcaaaggctcttctgatgatcataaagcacacaacagtacaaaaccctccttggtgcctaaatatctacgattgcaggagtactgtcccgtgggttgtatatttgatcaatgaaaatgtgaaagtgagtggataaatgatttcctttctctcttataaaaatcttgttctaacatcattatttgtcttaccttcttggacactgcttgtattcagcagttgatagctcagagacgattctttatatttgatcttcatatttccttgcccaacaccccttcaccctcactcctgatgcctgagattcctaatacaacttatgccctcgtctgatttttggggaaaccaagaatagagttggagccacatagtgatagtttattccaaaatatcactgagtaaagtaaaacaatgagacatacaatggtaattatatctcacagtaaactagatatcatatccagattttgacctcccatcagtttggatacctgtaaccaacctctgcctctatcaccccattactctgatccctgaaaacaatcatttgatatatgtggagtgagagtcaaatataaaatgtttggtttgtgtcacacattgagcttaataatgagaattccgaattaaatagggcacaatcggacttaaagcagctcagggtacaatagagaaacagagatgtcaattaataaataacaatacaacaggataagtataaaagtttgggttaccgacgacctcatattttctcaaatcattttcctaatattcatcttctacaacactaccaggtagatttcaataagataattatccttttattcacataagtcataaacagtttataagaatatgtgttaaaaatataaattcctgagtctatattcctgacttactgacttaacattcatcagtgaaattcagacaattcataatagggctgctttcaaatcctggctgtgcttcagaactagagagctttttggttggtgattttgtttaattttaatttttaaattaacataaaataaaatatttttgcggaatgtacagttttataaatattaacacaagtattgatttgtgaattgtgaatctaccaccaaaatcaagacacagagcaattctatcacggaaaaaatcactcaggcttaccctttgtagttacacctttctcccatccttacactctggcaaccactgggatattctccctcccaataattttatcattttgataatgtcatttaaatgtaattggaaaggaattaactttttaaagactgtcttatttcatttaggagaatgcctttgaggtttacccaagatgttatatttataaatagtccattcatttttatttctgggtagtattccaatgcatggaggtatcacactttacttactcattgccccactgctggacatttaaattgttttcagtttttgatgattctgaatagagctgctacaaacatttgcatgtagatttttgtgtgaaaatcagtgttcatttctctagataaagtaaatgccgaagattggattgctcggtcacatagaaagagtacatttaactttataagaaagtgatcgagtgttttccagcgtcccaccagcattattcaagtattctcatttctccacatccacatcagcatttggtgttgtagttttgtttattgtgtgtgatattctcataagtatgtgatggtgccgcaacatggttttaatgcatttccctgattacttatgttgtcgcacatattttcatgggctaatttcacacatttatatcttcctgggttaagtgtcccaggtcttttccaatttttaaaaaactgaatttttactttgtttctatttgttactgtcgagtgtttcgagttcttaatatttttgtatacaattctcttgttaatatgtgacttgcaaacgttttctctcagtttgtagcttgtttcctcttaatagtgccattcacattaaaaagttttctttaactttttaaaaatgttgattactggtgaaagatttaaattatacacattatagtttccaacccactttgacctactaatcataacatctagatgtgacatccaagaatatatattttaaaaataaaactttccatgtgattcttaacctggattaacatgctttattccagagtaaggtcagcaaataatatgccaagacatattttcctacacacccttggctactttatcgaacatcacagatttaacaataacttctctgtttgtaactctgaaatatttaatgttcttgatctctcataaaccaggtatatgctggatatgtagctccaactacattctactaattccgacacaactaattaagtgttcaacaatttgaagtcattattaactgcaaattgctgccctgtgttcagccctttttttgttaatttctcaacacctagtattataaaaaaattgaaaactaataaaagggaaagaaataaaaaaagaaagatgaaagaaaagaatgagagagggaaagaataagagatgggagaaaggagagtggcaaggaagaacacaaagaaaaaaaggagaagaggaaaaaatgaaagaaaagagaataatagtttacagttctctttgatcctccactatttttgcctcaaacagtggttatgacttgccactgaggagctaatattggtaataggatggacataaaaaacatggcctggtaagttttatttttgtttttgttttttctgatctcatcagcctgaatcagagggatgataaaaatttaaatatctataaaacaaaggtatgctgaacaaaagaaacacagaattgattcgttcatttattcaatcactcatttttaaaaatatttaagctctatgaaattgtgtattataaaaataacagacgttgtttactagatatctggaatgatactaaatacttttcatttattaaccaatttagttgttataattaccctgtaagatatgtgtgtgactatatttatttttcagatgattaagctgagacagacaaataagtaacattccgagattacatcatttgtagtagaagactcaaaattgtattcagtgttctgtttacttccaaggcagtgcatttagctatagtttttggcctttgctatgattccctttgtatgtagattaaaggtacacctctacttttcatattctgaaacttcaaggaaagttctgcaggcaatttaaaaatgaggaaacacatagtgccctgtaacaccaatatgttaaagattagagaaaatatgtgtagagaaaatcacttgaacagtttgctctgtgagcaagagtacatagcaacaagtacaaatgtgtaaaaataaaaaatcgctgggcagtttaaccagaaaaagatgtaaacaagtcaaaagcttaatactttttgaaaaatgaaattatattgaaaaattcaaacatgaataaatctatttccttaatcttatctatgaaacataaatatacaacaaaagtatttagaatattttttaaaccactgcattaaaaaaaataagattctagaataaaacacagattggccaaactttttaacagaattaaattgtgtgtttccctgcacttttttagtgtgcaacaaagaatactacacagaattaaatctctaaggtagaaactttcaatagaaggaagtgaggagtggactgtgagggtcaattccgattctaccatcagttagctatgtcatctggttttatttattaattatcttattatactcaatgttttttaagtgtcagggatagtagtaccttcctttagagatttttgggaaagattgaattagacagtatctataaaatgctctttgtagtatctagcacataactacttctaataaattgtagcattaatttattctatatacatattcatctataataagacttatctcaggttgaccagtcacacattaatataaagcatatgccagcctatagagattgtaagaaaacatacttttggtggtatttgtctgagctttgttaatcctaaataaaaagtgctcaaactcaatacatctctagtttctactgcccccatacatttcagtgtttcccaaagataaataaaatgaattatatgataatcatttagatcctaaacatatcatttataaaccaacagagatagcaagcacctggtgccaagaaaatcactcttattgggtggatttccatttgcagagactgagaagaatattagcataaagcagcccaacacaagagtaaaagctattttaatgctttgaagtgggggtgaagagctctcaaatccagtactgggtttattaacaatcattggcattggccctgtaaattataagttacgcatacaaggaatatatctgtaaactgaacacttctttcactccttaaagggtaccttgaggatgataatgcaaaacagtgaaatttagaggaaacattttgtatgatttgaataatttgcattatttgattcaggcatgatttgaatgatttgcatgattctctattagcaaggatggtagaaatgttagttatgtaaggttaattatatgtataattaaccaagaataaaaatgaccttcagatagtcttatttcagcaaacaatatgccaatcatttccatttatcattcctatgaatgattcttctaatttgtctttggtatcagatggtattacactcacaatacttagttatatgtaatcatgtcctactatagtgaatttcaagaggatatcagcatatctcacagagtgtagttgttgtaataatataatagttgccacctaaagtaaaagcaatctacttttcacattccaactcttatcttggataattttaataaaattataaatattcccattttgcagtagatggaattttggtttaaagaaatttaatgactaatctttgcacatgtgttaacagttactgccacccactgacaccgcaactacattctgaatgttgaaacaaaacaggcttatttttgccagagatgaaagttgcttattagtttgcttttcgtaatagttccaatttactttgtgtcatttttaggaaaaataagtgtcaggaaaacaacatataattatttaaaatattttaaggaccatgcatgatggctcaggcctgtagtcccagcgctttaagaggctgaaatgggaagatctttcgaggccaggacttcaagaccagcctgagcaacatagtgagactccttctctaaaaacaataatttataaaaatataactaggcatagtggcacatgcctggagtcctagctccttgggaggctgaagtgggaggattgcttatgcccaaaaatctaagctgctgtgagttagggtggcaccactgcaccccagcctgggtgacagagtgagactgtgtttcaaaaaaaaaagtaaaataaattagttttttttttaaatggcacaagtatactaaaatccccttgtgaatagtcaatatatccattacatatttgagtttgtataaattttaaaatgtgctataattatgctccatatttatcttctcttcatgccatcctttaatgaaaatttagctgaaattcttaagacagttatgtttttgaaaattataacaatttttatatgtgctgccaaagcaagcatagtggtgaggatgtggaaaaatggcaattcatgtacactattggtggatatgtaaattagtatagccaatatgacagtatggcatttccttaaaaaaatgaaaattgaacagccacatgaaccagaaatcccacaactgggaataaatttaaaggaaatgaaatcagtatgtcatagatgtctgtattcccatgtttattcagcattattcacaatcaccaagatatatattcaaccaaactccctatcaatagatgaacaaataaagaaaatgtggtgtatatatatatatatatatatatatatacacacacacacacacacacacacatatatatatataaacaatgaaatactattcagcttttgaaaagaaggagattctgtcattggtgacaatctagatgaacttgtagggttttatgctaagtgaaataagccaggcacacaaagacaaatagctcaggacttcacttaaatgtagaatctaaaaaagtctaattcatttaagcagagagtagaaaggtgattaccggggctgggaatataggaaaggaatgaagacacattggttaaaggttacaaaaatttcagttaggaagaacaagttctagagatctatcaatagtaactacagttgataacaatatattgtttacttgaaactttcaatggagcttttaaatgttctcaccacaaaaactgctaagaatgtgaagtgatgaatatgtcattccaaaatgtatttattcatcaaaacatccccttgtacaccataaatatatataatttacatttgtcaatttaaaatataaaaattgtgtgtatatgataaaatacatgaattgtgtgtgtatatatgataagatgttaaaaaataataagaggctatcttcatgaccttaggataatcaagggtttattagaacacacaacatgccaacaaggagaaaaatcaattaattgtacttaacataattaagagaccattaagacagtaagtacaatgacaagccacagaatgggaggaaaaaaattgtatatctaggaaacatatgtaacaacaacaaaacaacaaaggcaggtaatgcaatagagaattggggaatttgagcctgcaattcataaaagagaatacccaaatggataatacacatatataatggggctgaacttgattcattatcatagcaatgcaaattaaaactacaataggatatctctatgtactcacctcaaggctcaaacaatgaatggatattctattctatgactagatcttgtttacagcagaggtagagtatggattggtacaatcactctgggtaacattttgacagcatttaacaataatgaacctacacatttctcattacttagaaattctatatctgttataaaccatacaaaaatgcatagttaagctcatgaaaagataagcatgagaatgttcatagaatcacttcaaaatatctcaaactggaaacaacccaaatacgtattcagaataaactgatgaataaatgatggtatattcatagaggagaatactacatagcaacacgaacgaactgcattttctgaatggaccacaattgcaaccaaaaacatgaatgaatccccaaagtgtgttgagtaaaataagccactcacaaaagagtatatattgcatgatatcattaatataaagttcaaaaataggttattctaaggtgttagaagttgtaacagtggttatccttggtggtggtggtggtagaataaaatgagattagatacagcccaagtatgtgcttcagaaatgctttgtttctttatgtggtgctatttacagtgatgttttttattttctaaaatttcactgggtgtgcccttgttaattatcttctttttataaaattaaactaattgtataaatagtcaaacatactggaaaatcaaatcatagctagccatgattctcctctgtagtctaacgaacttgtaatctataacactgaatattctaagtaaaacgattagaaatttgataagctttttctaacatgatttttcattaggtacaagctcatattgtttactctgctttgatttgatttaaaaagtttcaaaataacctgagtgagataaaggaattatttgatagttgctaatcatagaaaatagcctcaaatatatgaccaataataatgtctgtggaaatgaaatggcatagaagataaaagaatataggaatgaagttcacttcataaatatgacataatttgaattattgaaggtgaaggagtttttactgtcatttatttatatcttttatctttcaagccttactatcagaccaataggagcaaaaggctgtgatatttcattacaaatgtacagtgttatatagaatacaggttttcatttattattcttaaaatgaatacccaagatcatataaaataattcactttgaagtgaaggggggctaaataattcatgtattacgtttaccatggaccttctctagtctgcttgtggagaaaatctcctttcttggatgagaaattacattggaaatatataaacagcggcacagtcatgtgatttcttctgctcaccttaatagaaattagatgcttatatcatctgtggctatttaagacatagtattgaccatttttccattggtcatgtttctttcatgatggaaaaataggctaacttacttaataaaagagaaaaaaatgtctgagatttcaacccataaaattaagcacttctctttaaaatatttttatctaactctcaataagcctaaaaaactactcgtggtacttttttattttgcagaatttcattattttatttaggaattcattacagaaatatttatggcacattcataccatgccaggctagattcttggaatacagtgctaagctctggaaaaacaaagaacaacctttcctcaagatgtgtagtggaagagacagatttttaagattgtgccagctattaaagagaactaatcagctcccctctaaatgtgatctagacaaacttggagaaaatgacactgtagttgatttgaatgtgttcccacctaatttctcttaatggtaatatcttgtgtaaatatagtacagtatcacaaccatgaaattgatggatataatttttggccttaatcagaattcatcacttttacatgcactcgtgtgtgtgtgtgtgtgtgcacatgcatgtgtgcatgtttaggtctatgcgattttctctcttgtgtagattcatgtgattaccaccacagtcaagatacaaaagagttcctcgtgatgtcctttaacagccatagctacttccttgctccccttcctaatctatagaaatcactgaattcttctttatctctataatttggtcatttcaagaagatcacaggtgtgtccaatcttttggcatccctgggccacactggaagaagaattgtcttgggccacacataaaatacactaatgatacctgatgagctaataaaataaaataaaatttctcataatgttttaagaaagtttacaaatttgggttgggccacattcaaagctgtaaagctgtcctggaccacatgcagtccatgggctgtgggttggaaagcttgggttaaagaactggagtcatttcttatgtaaccatttgagatagacttcgttttcactcagcataatttcctagagacctatccaagaggtcttgcacatttcaatgtaccgatgaatattcagtacattcttacatgtatcaatttttaatagctctttccatgtcactgttgaggagtatttaatggcatgaataaatgtatattcagttaaacacagttttaccagtaaaacactgaaagacatagaggttgtttccaattttaactgttataaataaagtgactatcaatagtcacatatagtttatgtgtgaatatcagttttattttatttgaaataaatgccccagattgtagttgttagatcatgtggtaagtgtatgttttgtttagcttcattagaaattgacagttatgtacagtaagaacactgacccactatctttacattttctagtaacacaatatatcatcattagctatagttaccaggctgtacaatgaatcccttgaacttatttgatacgtttcggcttttcttttttctttttttggttgggatgtggggggacggaatttcgctcttgttgcacaggctggagtgcaatggcgcgatatcggctcactgcaacctccgcctcttgagttcaagcgattctcctgcatcagcctaccaagtagccagtattacaggcatgcaccaccacaccccactaacttttttcatattttagtagacacgagatttcactatgttagccaggttggtctggaactctgacctcaagtgatcagcccgcctcagcctcccaaagtgctgggattataagcgtgagccactgtgcccagcctgtttttgtccccatccaaatctcatcttgaattgtaatcctcataatccccatatgtcaacggagagatcaggtggaggtaattgaaacatgggggtggtttcccccatgctgttctcatgatagtgagtgagtgagttctcacgaaatctattggttttataaggggctctccccactccgcttggcactgcttcctgccaccttgcgaagaaagggccttgcttccccttccccttccccttctgccatgattgtaagtttcctgaggcctccccagccatgctgaactgtgagtcaatgaaacctctttcctttataaattacccagtctcaggcagttcttcatagcagtaagcaaaacggattaatacattattcctcatatctaagtcattacatattcttttttagtggatatagaattctggcttcacagttcttttctgtcagcactttaaaaatgtcttctggtttccatggtttcttctgagaaatgtacagtcattgagtcattgttctttcgtatataatgtattttttttctggatgtttacaacatttatttatatatctctggtctttagcagttttattgtgatgccatgggcatatgtttctttggatttcccttgtttggttttcacagaggcacatggctatattattttgtgtcttttgcctaattagaaagttttcaggctcatgtcttcaatttttttctgttccataatatttatccttcttttctgagatagtcatggaatgaatgttagaccttttgatattgtcctcacagattcctaaagttgtgctaaatttccatgcagtgtttttccctagtcctatagattaaaagatttctattgatgtattttcaagttcacacattctgccctcttttgtctcccttctgctattgagccctgtatttttaataaattaaaaatagaatacaatacaaaatatacaattttttgtcaattataaattttttgtcaattataaatttttcaattggttctttaaaaaaattatcttatttgtctgccaagattttctgtctttccatgtgtttcaacatgttttgccatgtcttcttggagcataattatagttattcctttaaagttatggtccagtaatttcaacatttttttcttctcaggtttgacatctgttgattttctttttccttgaaaatgtgtcagacttcctcaattctttgtaagttgtgttagccagaatagaagatggcccaccatgcaccccagggacagacttaactcattgtttagttccttcccacagtaggaacaatatgtttaaccagcagtttgcagcaggtttgatgtatgttatttctaaagtgaagttataacaagaccctgtggtttctatgttggacactgtccttctcctttccccttggatcattcactctgtggaatgcacttgtcttgtcatgagcagctctataacaaggagctggagctttctgcaaataaccttgtgagtgagcatgatcttcccacattaatctttcagataatggcaacctagctgatatggtttgggtgtgttcacacccaaatctcatcttgaattataactcccacaattcctacatgtcatgggaggaacccagtgggaggtgattgcattatgggggagggtctttcctgcgctgttctcatgagagagaatgagtaccacgagatatatggttttaaaaaggggagttcccctgcacaagctctcttctcttgtttgccgcaatctgagacatgcctttcaccttccgccatgactgtgaggcttccccagccatgtggaactgtaagcccaacaaactctttcttttgtaaattgcccagtcttgagtacatctttatcagcagcatgaaaacagacttatacactagatgatagattcatgagaaactcatgagatacttcccattgtatcctatcagtagttccctttccactccttagattagaaagagaaggcttcatctggagttacttactcatgtctgtacccagtgaatagctctaggatttatcctgtcaagagtcaaagctaggagatatggaaggggtggagaaactcatcatcagatcatttgtactttaaatacttgtttcttacccaacatgcctactgtctcttacttcttagagtactgaaatacggactgcatgcattttcttcgtaaattttagttgaaattagtgacaatagtagggtgaagtgggctttttccatctttcctggaagtagatataagattttgtttagttggttgctttggtttgtttgattcctgctttgttttttataatagagtgataactttatgaataagaccaataaagtaaaacataagcaattctgctgacttatttttatatttatttgtagaaaattataaatattataaacagttgttcccaaacaataataaatttgaatccataatgaaactattaacattcctatgtaccctggataataaaatgtttcttttttacttctctagattatgagagaaattataatgtgtttacaaccctcagatatctgataggtacctgagagatttttcatagcaaacttcaataaattgtaacactcttataagctaactatagtaggctgaaagaaaatacttcgacagaagttaacaaaccatttttaggatgcatagacaattaatgtagaatgttcactaagttctgacaaaataatccttagcaataatattgatttaataaggtttatatagcaatctttttacctatgtagctcagaagtactgtagcagctgacatctactcaattagtttcgattttacctggcagaagcctaaatgcggaatttggcacttaaaaaatttctaaaatgtatctattttctcaaaagtgttcagttattgtttttaatgggtgtttgcatgtgtgtgtgtttcatttgtttgcgtgtgtgtgtgtgtgtgtgtgtttcacttgcttggttctatagaaaatttaataggagagttagaggtagggtgtttatttttaacattttatatgtcctttcacccctccattctctgggattatgggattacgggattctggggaagtgaggtctacatcatcttccacatatcactcagggtttgtgaggttttcccctcttcttccttccctctcccatattttctcatttggagcttttatagtcttacctttaaaaaaatgcatgaatagtttccactgttaaaataaatctttaaacaaaataaatttaacagagttaatttgagcattaaagaattgatgataaagcagcactcaaactggaagaagtggccagatgcctcggctcacacatgtaatcctagaactttgtggggctgaggcaggagaatctcttgagcccaggagtttgagaccagcctaggaaacatagggaggccccacctcgccacataataaaaaagttagttggacatggtgctgcgtgcctggagtccctgctacttgggaggctgaggtgggaaggtaacttgggctcagaaagtcaagactgaagtgagccatgatcatgccactgtacctcagcctgggcaaaatagtgagaccctctctcaagaaaacaaaacaaaacaaaacaaacaaaagacaaaaacaaacaaaaaaaagaggttcagagatttctattttaacataatgagcagaaggctttcataggttgaacacagaagcaaaggaaacatttgattggctacagctaggtgtttgccttatttgggctggatccagcaggaagtccctagttagagaaaagtggacagtttctgattggttaagcttaagttttgttttactatttacctcagactttagttttcctacctaggaacccaacacattggagcaatctgagcctttaaattaattttttaacactgtttatctacttatttcttccaaatacaggatttctcaagagtaatttaagtgtaaaaaatctctggcctcccattacacacacgcttttcttttgacagataaatattaaaactacttaatcctttagtttttgctgtatttatcaattatgacttataataggatggtccaataataatgttattaagtatagtgcaaaaataccttagggattaaatcttaaagcaataaagacagaatgatatttattctcattctctctcactctccattttatttttatgaatagacatagtttttgtcaatgatttcatgtaatcaacaatggcaaggaaccaattttcagtgtacacataacatcattttatattgtttataaataattatttttcttagcattgccctaacataggcatgtgagcataaatgcatacactacaaatatacacacagcctctcaactgggtttattttgtaaattaaaaataaccacatataaagacccctgagctgaattttcttataaatcacttaaagttattctggaagcctaagaaactctgacactctaggtgatcttaaaatatgcctgcatttaagtttgattgctctatctgtagaacaactatctcttagagtcactgaaatgtgtctatgtctgttaaagtacacagtctgaaatcttagagttacttgccattatttataatttgtgaaatggacagctaataatatctataacactggtagttctaagaataatgccatatctacacagtaagacttaatgagtattggctgaaagccctttaagtaagtataatgtactttttccattgctacgaataactcctaagaaaatgacactcttttgacacttgaatcagctgtagctcactgaatgctttactgaaaccatacaagtgtattttttatatgtaagcagaaaactacaggttgcgtaagaagaatatgtgttgagatcattaattgagaaagcagacaatttttttattcttttggtggttataataaccaaagtgtctttataaaatcatttattacttattatgcagcttggatagtcctgatctcatttttgggaccaaaaaaaaaaaaaaaaaaaaaaaccccagcaagaacattgaaacatgatcatagtcagaaggtcaattccttttcttatcctcagtttcagtttttcagtttctattcatatttctcacagcaccaaatctctctgtaaccttatcaactaaagcaagtataggatattgacacagagacttcttactgcctagagttctcagtaggaaatccagcatttcagctaaaacataaaattgttcataatgctaggtaagtagtttctgcacacttttaagggtaatttcacctctatcaagcacctggctctctaactcaaataaaattaaaatttatcacaggtctctgaatatatgagccagatagaaatcaacaaagtgtatattgagtacctacagttggcaagactagatgctattaataagtataaaaacaaaaaagtacccttggtcacagtggtgcaagagcatttatccaagagtgacaatggaacagattaactagtattttattttgcaccgtactaaataaattaaatgcaccagactatacaaatacattaactaaaaatataatctaaaatgcaacagaatatcctataattcctgtgttttttaaccacagattaattcctaaagttttactttgatacctacaaatttaaagttagcagccacctatattaagacttcttccacaggcatgtgagatcatattatctaatgccttgccttacttattcaacagtcatgcctcataacccagaataaacatgtaattggtcagccaattgtgtacaattttcagaatgaaaaaaagaatattaatacttccattaggaaaacagatgtaaagagggtctgtcctggactgagacacatgcttattccaatgaactggtctatctttggctagaaagcaaaatggtcaagtaatggcaatagcttgaaaaaaaatcagggaccatccatcaaattatataacctaaattttaaatgatcacagaaaataacttgaacatatttcaaatgtttagcatttttaaaagatctgatatccacttgtagggagagtctgtaagtaaccaaagaacctcaaaaatctagactattccttaaatctcatgcacattaagcttctcattgtctgtttgaaataaatggggaggacacagaggccttcacataatcactaaatgacaaagaacagatgtgaaccatttacgggtaaatgtgcacactggcaaagaaaaaacacaataaaacagcatgcattgaaccaaccagattggcttttaaatgactcatacttgtgtgattgctaaagacagcaaaaaaaattaaaaagctcacttgactagggctaatacacttcagttactttaaattaaccactaatcatgcctttttcttgtgcatttctttttgacagccaaattgaaatatgcctttttctgaatttataagaacaaaaacaactaatgaatcgcctgttaggtcattattggttttgcaaccaactgttcttctggataaaagtaccctttcttaattataaactgtctattcagaatcgcttctgaagttcagagtcctaattaatgttatatttagtgatccttacaaattgcttcttgttttatgttagtatcctttttatattttgaaataaagcaggaatcatctctttaaagtaaatcagaagtgtacctttaagccacagttgctgagcaggccaactctctttcttccgattatcttcaaactcacctctactatggttcacactatccctaacatataatccatccaattgactcactctgcagtagcatagctattacttctcatgccaaacataggtattggtgcccaattatattatcacttcttgaaagcaaaatcaggtcctgacaaatggcctgtaactttgaggttgcatctgaatttgggtgtgtgacaacagagaaaagctagtagctcatttttttgatttacgaaaatgaagacaaggccaatcttttcatgagtttctattgttttgttgcatcatagttttagcatggtttcaaatttcatgtaagagggtaaaatatagccatgtaaaacaatttaaggaaaggacaatttttaaagataggatagagatacggagagtatagattaaaaggatgagaaattaaactcagagaagttaattatagggagactactacagactgattattctcaaatgtgatctcataccagcacaaattaccacatttctggcaacttgctaaaattaaaattcttgagccttaccccaaacttcagaatcagaaattcgtggaggggccttataatcacttttaaaagccctctagctgattctgaaggatgctaaaaatttcagaaccactgcaatagtgatatgatttggctctgtgtcctcacccaaatctcatgttgaattgtaatccccactgttgaaggagggaactgagggaagttgattggatcatgggggccgaatttctcaccttgctgttcttgtgatactgaatgagtgctcaaaagatctggttgtttgaaagtgtgtagcacttcccccatcactctctctctctctctttctctcccatggtaaagacatgcttgcttccccttcacccttacaccatgattgtatgtttcctgaagcctcccagccatgtttcctgtatagcctgcagagctgtgagtcaattaaacctcttttcttcataaattacccagtctcaggtagttttttatagctgtgtgaaaatggagtaatacaaacagatatgtagttttcaatccaaataaatggaaaaaaatttaatcagttactaagtaatatgttttaatatcttaaggaagtatgtaggtaaaggtggtaaaaaagtaaattcatgtttacattaagattttttaaagtccaaggtaatttctctaaatagaaagttgcattgctcaacttcaaacagattcatacaagtgagctggaagcatagaaatttagatattttaaagaagaataatttgaacaatcatcagctaattgtttcaattaaataaaatcacaatagaaacttaatataatcatcccatccatgctcccatttgatcttcataacaaacctggaaaatgtatagggcacatatttattatttttctacacttatagagaaatgcatttactcaagattctctagctcttaaatgtccaagctctgaaaccacacatttctcattttaattcaagttttcttcctcttgtttccacctgcacacccacccatatggcaggcaccatgctaagaacttagtttttgcataggagaaatatggggtaaaatctttcactcttttgtagaaaatattaaactggaaatatatacaaaaactactttataatcccttaaaaatcaaaaaaccaaaggatatcttcaagattattacaacccagttaggtcagtaatatttagacacatagacatgtatgaacagtgtgcatgagggaaaatagtcaaagctgtatgtattctagagaatgatgctaagtagaatcagagcaagaggaggcttttcacatgcttcatccaaattccaaatccctcatgatgaggcaaagccaaacttaagccaaattgataatgtgtcattatacctgtgctcatgcagctctccttccaaaatcttcaaccacttctctcatatcaccagggcctcttatgaagatgcccttctgacacatcatttctgtaatacatagtcttctcccaagactttgagagtactagacaagcaatggatttaaaccaagttggaacataatgagtaaacatatatccacgtaaaaacattctatttattacattctatttatttctaaaggatatcaacaagaaaaaaattgataaataaatgcagctaatttaatacaccatgatatttttaggaggttgtagcctttgtgagtctagtgctgagctagacattaagattcaaaaaataattaaaaatgactgacctgaaagaattcttagtccagcaagaaccaaagccatagagacagcaacaaacctaccagacaggtttatcaggagacaaataactatgttgaaaattctaaagaagcagcagaagtaaatttatgctattaaggggaaagctccatgacttaggagttatggaactttaatcatttatgtagctatatacaaagattatttcaggcagctctgatacctttattaaaaatacaggagtagaaaaatccatggtatctttgggcacaacaaggtgaactacttagctggaacaaagtctttccatgggggaaagtatcaattaagaatttgtgctagaacgggcagatgataattccttctataaaaatataggtgcaaatagggatataatctcaaaatggcagcatttccaagtaattactctagaaaaatgcaagaaagctgagtgatatcatacctagacctcattaaaatacagaaggacagtacaggtaatctaaaaaaaaatgtccagtgcccaaggaaaaataatttaagaatggaggaaaacatgaggccaccatgttagtgcgagatcagagaggctcttatgataacaacatgaaataatagggagtgatgctgttaggaaaggtagacttgtacatggaggcttcagacccccacccaactacgtaagaatgagctttggtccatgcctatgtcctgaatggtattgcctaggttttcttctagggattttatggtttcaggtcttacgtttaagtctttaatcacctcattatcaacagactaacgcaggaacagaaaagcaaacactgcacataagtgggagttgaacaatgagaacacatggacacagggaggggaacatcacacaccgaggccggtggtggggtggggggctgggggagggacagcattaggagaaatatctaatgtagatgacaggttgatggatgcagcaaaccaccatgcatgtgtatacctatgtaacacacctgcacgttctgcacatgtatcccagaacttaaagtataataataataataataataataataataataataataaaagaatgggctttgggctttgattcttccttactaagagatacagtctgtgctggacttgctttgtgtcatatggcacctagccaacaccactgctgtatttgtcccctgtgaggaaggggtggagatttggtcttttgtttttcagcagaagagggatgtgtgcaggccaatggccttgagtcagctactgggagaggccctctggccatggaggactgacacccactactaaagctgatcttgctctgttttttctctatgtgtgtaaagctttgttcattccagtgcttgactgaattatgttttccttgaggactccattaccaagatgcagtgagaagaggtgtttgggcctctactcctggtgataggcaatagatatcacttgcttgacagatgccaagtagaatagcttcccatgacatactcaagagtcagaaacttaatatgagaaaaaaagtgcagctttaaatcggcatgcattttaccccaaattcataattaaataaatattaatactattagtatatgtaaaaataaaaagattctatacagttactacccatgaatacaaaaagggatgaaatgattttaatatttactttttatttatcaacttatttttgagatgcctgaaagcataatttttgttgtgaaaaattgagtgatgcacggcagccattacacggtacctcactggcattccataaatatgatttgaataaacataaatgaataaatgaaggaattattgatctgaccaacaatataaaaatagagtagaaaggaaactctataaaatgacattctacataaacatttactatgatgaatcttgttaaaatttttatgagatctacacttcagttaccaagtaactatcttctatcttttcatccagagtttgttacacagctgcttccagttcctcaccacatatatgttgtgttagctatgtaggagttattggaacagacaaatgacctcttttggtaattgtgttatgtggtaatgtcaattctgagtttgccacagcaagtactaagggctaatacttttgattttttctctgccaaaaaagcattcaatatgtggctgctttccggtgagtgttcctgaaaggtatcaaatttctttaaggaaaacttaagaaagaatggcagggaagtaatatttaaatcgatttttaagtgattttttttcctgtgatcaaaattagtcaaaattagtgaaggctggaatatgggatgttctcataatgaatcatgatttcctagtcattgtttcctgtaatcgtggtttatttaaagtttttctaaaattttaaagtcctcattaaattatctcatctgcatcatcacaatttctgtatcagaatattaattgccaaaacttctaaagtctttgttcttttgcatctttaaatgctatggggagagtgtcttctctatgtctaatttatgacaatccaaataaaagttatcagatttatttccccaaattgcttgcatctgatatcttagagtacttgcactggtttcccctccacagccagaattacaaagacaaaagctttttgttagctaccttcaatcccttgtgatgttcacttgcttaataagccagatgattttttttttacttcctacctaattaacactttctctttagcatttgctcttgggaattgcagaaaatttagtagaataaaaaatttaacaaacatcagaaaaatatgattagatatactgtttttaccaccaatctatatatcaggggagtaaaaactatgtaatttttgaaaatactatgttaataaatatgagtgtttattttattcgtagtgtctataaaaatagttaatataacattttagtttaggaccatatttatcacactagatcataacttttataagtgcttatattcctcaaaagattattacagaaattaatcataacagaatatattagatgataactatttcctaatatttaaaaattccacctttcctgttcttcatctgcatgtttggtttgagattaaatttcagtattatgtagaactccacaggcaaccaaatactatgtaggatattttattttaattttctattttgtgaagatgaatccagttttcgatccacttagatatgttataagttaggttatcccacaggatttgcattatgttaagcggtacgactatgagaaaactgagacttcaaaagaattcttgcccttggcgtctcaggtttcatcacaggagccattattcatggaatatcattatttttggcttctatttaagcttatctctttgtccttgatttttaaagcaatgatttctttctacaagggccagaagtatttatctggcttttgacttacagtatctgaatcatgttctgctttagttttccagagactcccatttttagctttgattattgaagaagaaggtatgtaatattcccatataaatatggccctttaataattaacattttgatcttattggcttatttcaactaaaattttgtatagcttcaagattgcaaattagttcaggactttcagattttactgttgttcttggagagtcaatacacctataagcggatttttcaaatgaaatttaactctgaaatatgtagatcctttgtgaaaatggtttaactatttcagatatgttcttcatcagaaattgtggctttacttttactaagcaggtcaaaatgtagtattagtgttacatttgatgaaatgtaaatagaatagtctaggcaagaatgttaaatatttgcttcctggcttaaaattataaccctatttttaaaaaactagctattaagtcatattttaaaaggaacacattttctcaatgataggcaaggaatttgtgtttaaatgtaattgatgagaaagcactattagaatattagttcatatattgggcaattgtgccagggctttgaagtgcttcttggctattaactttgtgataactctttcttcactaaaaaaaaaaaaaaaaagaaaagaaaaacagactggaagtactgtcaccaggcaggctcttaagtgtccaaggcaaactattttaagttacaacaaaaagagggaaacattaataattctacaagcagtttgacttgctatatgtcataagaaaattattttctacccgacagtgccagtatttggggtagagtaaaagagaactatcttataaagtctatcttattaaaataaattattcattaatttgtgatttggaaaggaaaacaagtattcctggtttatttaaaaacaggaaaattttgatttgcgtattctataaaaatagcttacttatatttaattactatattttttatatttagtaaaatagcttactatatttagtaaaatagcttgctatatttagttgctatatgtttcaagttctcataaaaataattcaataaaataagtcattttttatgacatttatatttgacctttacatagaggcctctttgatcattacaacttggtttacctggtactaaccttttaccactatatatattcttttatgcttttcatttcacgtatactttctgagtacctagtataaaagatattatgacatgtatgtttattgctgttcagaatagcaaagacttggaaccaacccaagtgcccatcaatcatagactggatgaagaaaatgtggcacatataaatcatggaatactatgcagccataaaaaataatgaggtcatgtccttcgtggcgacatagatgaagctggaaaccatcactctcagcaaactgacacaggaacagaaaaccaaacaccgcatgttctcactcataagtgggagttgaacaatgagaacacatggacacagggaggggaacatcacacaccagggcctgttgagggttagggtgctacggggagggatagcattaggagaaatatctaatgtagatgacgggttgatgggtgcagcagaccaccatggcacgtttatacctatgtaacaaacctgcagattctgcacctgtatcccagaacttaaagtataataataataaaagatattatgacagctattggcagtggtttccaagatgaagtagacatgaaacaagtcttcaagaggcttatagaacataggtggatatgggacatacacattagcaattgtcaaagaagggagaatgagatgaatcataatatgttgaaaaaatgctctgggatttcagaagagaatactgttggaatttggtgctattctcatacttgactcagcacatattgtaaaatagcaatatatatccccttaaaaggaactacacatttgaagcattattcacttagcaaaaagtactgaagggatatgcttaactttttatggaactatttacctcatttttgattcacaccatgaattacaaccaaaaacgtacaaaatatctttagaaagtaaacaaaaaaattctataaccatttgtttccagaacaaacttctccattcctcaattcaacagttttagatagcattctagggaataaatgaaagcatcaatgaaagaattatgatcaatacatttgaccaaatgaggcataacaccttactaactagcattagggttttcaatttatataaatccatcccctctccctccctcctttttctcactctcttttctctttctcttttccctctcttcctttctttgtgtaactctccccatctctctctctctctctctctctctctctctcacatatgcccttaatgtacttataaatagaatgaaaatattcaattgcttatttttcccgtatcatagtccatacaacctttaacttattttttcactgtcccaacccagtggttttgacattttgggaagagagtcacttgaaattatttctaaaacaaacttgtaatgaacatcagaatgccaggcacatacattgatatatatatatatatgtatgtatggcgcctattaattttttttgggaaaacaaatctttgttaagagcctcagatcaagaatctgcctttcccctacagatgtaactgtaaataatcacctcccctgttatcctgtctaaggcctttggtaatcacagacgctttcttcaatgtgttattctcctaatgtacccctgtcaatatactaacagtccaggagtgtagaactatgggtaagaaaataattatttaaagggtaaaagagaaaaagtggaaaaaaagctgaatcagtataaaaaatcatttagaaagtgatatataaagtaatatattggtatttattttgtactttattaattattgttaaatgatcaattatttagtacatagtaggttataggtcacgaatatcaatatatctattccctttaaaaacactactttatatatgggcaaattaagacagggagaagttaagtaattcacccaaggctacagctaaatacttatttagctgtaaatacttatttacaaacccaggcagtcaggctccagaatccataacctcaaatactatatttacccccacatacatagtatttcatttaaaagcaagatttctgatttgggctccttgagaggctagttcacaagtataaagggcaacaaagtgtatcagactcacttgtttactacagggaaaaaagagggggaaacaatattaggaaacatagctctaattttgtctcctatggctgataaaaatctgtttctaccagagaaggcagttattctagaagtgctaagggtactaaagagtaaagaaaatatagtaatactaaccaaagaataaaacactgaaaatgtaggccaataatccaatgaaagtcaataacttagagtcaaagagaaggattaaaaaaataagttagagacagtcaggtcaattacaaactattagagaaaaatgactgtgatcagagccagaactcacatgagaaaaataaacactggtctattaccctcaatttataaatgtctcataaagtgacaggcaatgtatggaggtagaaagaattataaagagagtaaatggtgtaacagtcatccaaagaatattcagtgggcaaaaataaatacaatgtcactaaaaagacatagggaaagaaatatgtgaaaacattggtttttaagtcatagtttgaagaatttaagaactctctgatactacaagtctggtgattaatgatacagggtgtacttatgagagacaattctctatgggtctttccagtttctatacatcttttgagtaaagaaataatagcttttgttctgtcactttttcaaggatgttagtattgcaaacaactttagaagatagtgcaaaaagcaaatttgtttgctgaaaagtattataaaataatgcccccttagtgggtgaagcttagaagaatttgctagtggcctcttccaaaagctgagatttttctagtctcagtgtttctgacctgtcatacaatcccactgtgtatgcggtattcacctcaatccacctctgcattggccacgcaggacttggagaagggacaaggggccaagaatgcaaacatgatgctcatattgcccactacaccataaataataaagttctttgtctctcatttggaaatctcatgacttctgccagcatccatgaaactgtggctagataacgtgttatcttgcaaagtaaaacgtcagacccttcacagtcattgatagatttgatgacaaaagtgagatacagagacacagatatttagaagatgagaggttcaaagccctctgaaagtttatttgaagttataaagagcctctttgggataaggtagtaaatgttcttacccaagtggtaggaaagaataaggatttcctaatgtccaacctgttaataaatgttgagaggctgagcaatgagaggagggacagaaacaattttcccctgatgtgctttggttgttggttgtttactctcctccaggcaggagcagaaaagtgagctcctatgacaataaagacaagagtttcatagcccattatcacaaaaggcagtgtttgtctccactgagtcaaagggtcctgtagacagaatcaatagtatcaaacaatgaggatgtagagctttggattgaccaaaaccagaagtctggttagttgagccagtacatagcagacaacttgaaaccaaaaataaatgtggtttacatgctgatctagagccactctctctctccagcacctttgatttcctctctttttctcccctgatgtcaactgctttaaagagaaaaatgattaggagtagaaacaagatatgtccccaagagagatgaaaggtcatggtcatccaacagagcatactggagaacaagagagagaggaggaatttaagtctttataattctacagggtatgggcctccaaatcaccatcctgtctaagcccatgatgggaaggggtggaaggtacaagcctgactgaaggcactgagagctgcagggcagatactcaccaaaatgcataggaaaaacaaaaataaaaaataaagaagaagacctggatatacacagaagcacagatggtattgcccctgtggtgaaaagccaaaaagaattttaaaagtaaaagaagaaaaagaaaggaaaacaaaagcctctaagttgatccggccactcaccaccagctgttttaccttctgcccatcatcccatccaatcccaatacccctcacgctgattggctggaggaaacaagtttgcactctgaaagaaaagttgtctgagaaagaagtcagcccttgaaaagtagaggtgagagatggagaggataaaaccagatcctaaaagaaatttgtttgaatctctatatccagctacagctataagtcatcctaccctcagcaatatagatatgaaagctaaataatttcaccttcttaagcctgtttgggtcacattttgaaacactggatatacaaaaaattcctaattgatactagccacaaattcatctgataattgttaccatgacatctgccttgtttttactttattatttttttaattcctctgccttggtaggcagaataatggtcccctaaagaggcttatatccaaatccctgcgagctgcgatcatgttatattgcatggaaacaaaaattaaggctgctaatcagctaactttaaataagaaaattaacctgatgaaactaatgtaatcacaggggtcctgaaattagatgaaggagactgtgaagtctaagtgatgctatgtgacaaggactaaatctaccattgttggtagattttaagatgaatgaaagtaccacaagccaaagaatgcaggtagcctctatgagctggaaaaaggaaaacttattctcagctagagtacaaaggtacacggccagaacaaattcttgattttaacccagtgagacacgtgttggattatatcctatagaactgtatgataacgtatatgtgttgtttaggctcttcattcaggaaatttgtagaaaactaatatgcccacacaaattcagttcctgtggccatgagtctactggaatgactcatcttggccttgatgatgatactgagatgggagagagttccttgaccccttcacgggacttgagacaggtttgtggctcgcctacttggccaccgcagtgatcaaaccccttgtgggaggaggagcactcaggcaagtggatgccagggctagggcaagcacttttgtgctccaggcccacagcagcatctatgggtgtgttacagttaatgctcttttagcagttgccatctgtggatggctaagtattaaccagctcagtggagtcagggtgacagccttttacatactatcctgttggtaccaggttctaacttggcctccaggaataatcaggtcacattcaggtttgaaaggcgatgaatgcagaggattttattaagtgatgggagtggctctcagtggaaggggagctggaaaggggatggtatgggaagaaggggatcttttcctgaagcccagctgtctccagccaggctcctctccaaagtcatgccatctaaagttaagcggtgtctatctgtagtttctgacatgcagttgcttcttctctcctggacgttcagccacttcttctcttctctccttcactgccacaccactctgctcctctgtcaatggagtttggggtttttatgggtagcggatgaggggcatggcgggctggggtggttttggaaaaagcaacatttgggcaggaaaacagggataactattctcattttcgggccacaatttccaggctgcagaatggaacctttgctggggaaccatcctcttttaccccctatttccctgcctcctgtctgtatcaatactaattatggaatgacagtttctatggcagtgatttagagtttgtttgagagaagtaaatgagcttctttgcagcttttcacatgttgtcattggctctgaagtagttgattaaatctcagtccctcaagcatgctcatagacacttgtagtagttttgatatgtatctcttgttgccttgaattgctttttatcttctttaaacataactgactgggctaaagggaaccagagtccaagccattccctctaaagatgttttatacctaggattccagaaaattttcctcttatatctgaagaaaccagatgtttgcactaactggggaattgtagagtgtgtatgcgtgaattatcatacaaaagcacattcaaaattatgtgtcattatgttttaaacatataaaataatagcaagaaagagaacacaagtagctattattgtgttaaaagcattgaatttttcatactctcagtaaattgtatatttaagacagtatacttaaaaagtaataaaacattaaataatgatgcattgacttgtttacattcccagggaataactgcatataaaacagaaatccaggacagttttagactttgttaatctgtttaccaattataaaatatctaagaatcactcctgaatgttccttttgggagttgcaatattgttttgaggagatctgaatcaccttttacttgttgaagaaaaattgttcacaaagattaacatgtggatacccaaaatgtcatattaccattgtgtattttggtaaatcaatgtttatatttcacttttgttgaatttaataaatttgaatttcaaaatctaatttcaaaggaaggcaattaaatattaaaactgttatctcaaataaaaacactaataatgatgttatgataagaagaaattcatcctcattctgatggaaaaattaattgccattacaaaatgaaattaacctgaatcatctggttttgtttgtttgtttgttttccagtcagaagtgaagaaaagaaaagactcttatcttctttctttctttgattcccctggttctttcttcttctctaagcttatctgattgaccaagctgcttaataaaatactattgcaacatttaaaaatataagtacttgtataatattatgctacaagatacaaatgtagcatggaataaatgaaaataaatatttagataatatgaattcaataaataggacgtcagattttggaattctttctttactgtaataattcattacacctactgtggatcaaagactttttctgagatttttgaaattttatttactgtattacatgttaatttactaacaagcacaattgaaagcagagacaaaaataaactcacattaggaattttctagctacatataggtatatcacgaacatgtcaaaatttgaagagaaaagcaaaaatatttgtaaaggatacataattacagatttattagatcactttaaaaatcttgagtaaatattgcctttaatgtagaaaattcatacacataccattatgataaaactcaagggagtcaaagaattacatgacagtaaatgattccatatacataaataaagaaaatttacgtgtttggcctaaacaatgtcgtatatgtaaaacaaggcagctttccgggatgccaaaattgtcactctagaattgcagaggcattggggaaaactgccagtctgtgaggaagatcaagatagtcacatggagaggtcacgtggaaggacagattaccaatggaaagatagattatgattcctctcttttagttcagccatttcagtctaagtgaaagaaagtgaagaagcttcttgatgactccaatatcagctaccatctaactgccactatatgagggactccaaatgacaacaatttagtttggcccatcaatacccaaaatcattagagataataatatattattttaagccattaagttttatgacagttattatgtagaaacacataaccagaatatatatggctctaattacaagaaagacaaaatttttgaagtttctgtgtaggttaataactaaaggctgcttgcaacagattccctctgtctctgcctgtctagcccactctatcttcttcctctgcctatatatatatatatatatatatatgcatatatatatacacgtatatagatatgcatatatatgtatagatatatacgtatatagatatgcatatctctgtatatagatatgcatatatatgcatatatatacgtatatatacgtagatatgcacatctatatacatatatgcgcacatgtatctatttaaatatctatatctacacatatatctacaaacacatatttataaatagcattgttctcagactgtcaaaataaaatttggatctaaagtgaaaagcagtgtaaagtggagggtaaaatatattaacaatgacagtgaatataaatttgtttgactatcaacttgactgtgaagtttctagcaccataagtcaaataaaataaaatactgtatatttctcattattaaaataaaagaaacacactaactacacaagatatgtataatttacctagactcaaagggaaattttgttttaatggtggatattacacaggtcactaaccaacataaaaacagtctctgccactactcatgagtaatttttatatcacacccagaagtcataaaagaagataatatgaaatataaattcagaaataaaattttaaaaaactgaaaactttcttcaagccatgtatcaagtattaatttccttaatatttgaggagttattaaaaattaattttaaaatgtgatactggtctgagaaagcatttcacaaaaaaaaatgaagctactttaaatatatgaaaatatgctcatctcactattgtattggagaatgcaagttaaaataaaaaaggatgcattgtcttcaaatctctagcaaagataacatagatccaatgatataccccaaggtggaggatgtccctttcatttcactgttgatgtgaatctccatggtcatcgaagggcaattctgaaataactatccagcatgtccatctctaggactccatcctacataaatacttgcatacatttgcaagtatttctataaaaaagatggtcattaaccaattattattaatatagtattttagtctaaaaagtgatcttttattaataatactaaaagtaatatttgacaatgcaaacattgaagtggtatgtaatgcgtggcaaaatacaactatatatctaattttggagcgatttctaagatttcttcttaggtgtacaaattaacgtacaaatcagtataatttttatttcctcactggtgtaaaagagaaacatggctggctgtgtgcatgtccacatatatttttggaggaaatcgtgagaaactattaacaataacatatctgtaaaatagaatagataaattataatcggaagctgattcatttttacataaacttttttatttgattttttaaaatatcgtgccattatttttgaactaaagtaagaagaacaaaataatttccaaatggcttccaaatgacttcaacaaactaacaaatatgatccaagacctggatattttcatggctgaatttaatgcattttacaacagtggttttaaatcacattccagagagccctaggatcgctgatagttacctggtcccagtgtggaggctgaaagggaggaaacatggtcagaattatgctaaatatggcccactctcaccagcttcgatcaaaccatgtcactttttatattataattgaagtgacacaaaatattttgtttgaatggaaaattttcactgttagaaaaatttgaaaattcctaacataagcgaacacattaataacatatcccctagctgtcaactgtgctacataacaacagttggatagttctattttaaactacataattccatacagataaagagctctttctgaaatgtgacagctgtatatatgtataagtaaagtctcacacacctatacctctcttgtttgaatatattttgactatggttcagtatctaggaaaacataggcactttaagagccaaatttccaaacaggaaaaatacaaaaccaaaatgtttttcatttaattctgtaaggttgtctgggttttacaaaacggttagcagtcatttcacatcagcctgccacattgattgaagaacaaattactggaacatataacttcatagaacacaccgtggtatttttttttaatacggagagctttctattttcaagttttggcttagtttccaatgtctatgtttggatcattaaatttcctttctaattgcagctaaatatgtcttctacctcacttcacttctggctattatttaaaatgcatttggctcaaatatttgattacaaaatgaacaatctgtttgcctgtatgtgtcagacacattattgtgtcttcttccccgtcaaaatcagaaaaatagtggtctgcggaatagatgacttttactgacaattttctcttcctatgttctgtagcttgggcaggaacgtttttcagatgctcttggaaacaccgcttcacaaatatcagtctctcccgccaagccaaattcctataaattgggacttcttccccatatgtttaacattatttttaaccaggattgcctactggattcttcattggattcattctagatctataactcttaggagctgatccttctctgatggctggttgaccttcatttctgtgcttaattttcattaacattgttcactctctctgaatcctgttgacttgccactgtactttcctatccccaaggcaactgatggtttctttgttctgtgctccactgagatacaagataagacttaaacttctgtctgtctggatggaggtatttttataggatcttcaaacaaattaacagggtttttagattttgctgggttaataatgagaagaaatggtttaagtcctaaatgctattctatatgtacaattacagggattctttattagaaactgattaatattaatgaggaacttattgttaatcaaaaatccatacctccagagactatggttttactaaaaaattaaagaaatggaagataaaaaatccacatatactgtggtgcacttaatttttatggaatatcaaccagttcctagactaaattttaccaatatattggatagagcaataacatttagtttgtgggaatatattaaactttaatgtctcccccatcatttggaactgagccactggaaatttgcaagccatattgggggtttgggagaaaaattcagaaattatcagatatgagttccttctctgaatgataattgtgggaaatcacctcattgaatgaaggatgaagaccatgactaaaaataatgattgcatttctttcttataactgggttcatatatttgcatatgaacattcaaacaataacaagaagaataatgtgtagggtaaatgaactcccaatgatgaatcaacctttttcagagtcagtagctgacatttcagtttccctaagggagagtttaaaaaaagtgaatggggtgaggagagtcgaagaaatgtcagcatgctgtgtgagaagagggaagaagtgaagacctgtcaactgaggtggaaaaatagagaggacatggaatatattcagcaaagcaactctgttagacaagccagtgaacactacagtgatttttttttcattttaagagataattcagcctcaaactcaaatattgttgctaaattctaaagtatgtctctgttatagtcagtttcaccatctaaacttttccatttctaatttgcgactgtattattcctttgagacataaaatgatggttaataaatataaaatgaaaatgaaataaggcagtctcgagttaaaaatagaaatatgtggagttgttaacagaaattctacaaaatattcatatatctcatattaaactagattttccccaatgcctctgcaattctagagtgacaattttggcatcccgggaagctgccttgtttttcttatcttcataagagaaatatcaagttacctacaaaaacctcttgaacaatgaagtctaattttcagcaactctcatacatatcatcaaaccaacagttgaaacaaccctaaagtcctatctttgaagctctaggagaaatattaaataccaaaaaatgccatatcggtgaaacattttaaaaataaatatccaaaaatcacttgataatctcttgcaaaatgttgaataaattataaatcttgtttcaatagtaaaattttaaaatattaaattgttttaataagatttttaagaatatttttagatttacagaaaaattaggagcagattacaaagagtttccttatactgcatgtgagatgttattacaggcacaactcagagatattgcgggtttagttccagaccactgcaacaaagctaatattgcaattaagcaagtcacatgagtttttttttctttttttggtcttccaagacatataaaatttatggttgcattatactgtagtctattaattatataatagcgttatgtctaaaaaacaaggtatacaccttaattaaaaaatacatctttgcaaaaaagtgtgaatgatcatctgagtcctcagtgaatcctaatcttttttgcttgtgaagggttttggcttgatgatgatggctgttgactggtggctgctgaacgctggggtggctatgacaattcattaggtaaatcaataatgaagtttgccacattaattgagtattcctttcacaaaagatttctctgtagcatataatgacgtttgatagcatttttccaacagttgaacttctttcaaaattggagtcaagtcttcttagtgttgatattttgagttccttccatgaatcatgactatacttgatagcatctagagtggcaaataacgttttcaatttactttacccagatctgtcagagggatcagtttctactgcagctacagcattataaaatgcatttctaaaataatgagacttaaagtaaaaattactccttaatttatgggctaaagaatggatgctgtgtgaacacacataaaaacaacattaatctctttgtacatctccatcagagctcttgggtgaccaggtgcattgtcaatgagcagtagtaatatttcaaaagtcggtctcaacccttaagcttaaaacattcagtgaatcattgtgaaaacagatgtacaatctttgctgtttcatttacagagcacaggtgtagcagatctaacattaagacttaaggaccctggattttcagaatggcaagtgtgcattggtttcaacttagttaccagctgcattagcccaataacaagaaagtcagcctatcctttgaagctttccagccaggcattgacttctcctctctagctatgaaagtcctagagggtatcttcctccaatacaagaccgttttgtctacaccgaagatctgtttagtgtagccacacttatcaactatcttagctagatcatctggataactggctgtagcttctacatcaggacttgtgacttcaccttgaatttttatgttacagagacagcttttttttttttttaacctcatgaaccaaccttctccagcttccaacacatcttctgcacatctctctctggcttcatagaattgatgagttagggacttgttctgtattaggctttggtttaagtcaatgttggattggtttgatcttctgttcggatgactaaaattttctccatctcagaaataaagctctgttttgctttcttgtttttcttgcattcactaaagtagcaatttgcttcttttttggggggtggggggatggagtcttgccctgtcgcccaggatggattggaatggagcaatcttggctcactgcaacctccgcctcccagattcaagtgattctcttgcctcagcctcctgagtagtggggattacaggcatgcaccaccacacccgcctaattttttgtatatttagtagagacaaggtttcaacatgttggccaggctggtctcaaactcctgaccttgtgatctaccctcctcagcctcccaaagtgctgggattacaagcatgagtcaccacgccctgccagaagtagcatttttaatattcttcaataatttttcctcaacattcacaacccggctaactgtttggcctaagaggcctagctttcagcctatcttggctttctacatgtcgttctccttaaccatttttagcttttgatttaaagtaacagacatgcaactcttcctttcattgcaactcttagaggccattgtagggttattaactggtttagtttcattatagttgtgaatcagctgatagagggaattaagagacctcgggaaagagtcttggtgcaatcagaacacacatttatttattacgttcagtcttacatggcatgttttgtggtgccccaacacaaatgaaatagtaacattaaagatcactgaacacagatcaccaaaatgaatataataatgcaaaagtttgaaatactgcaagaattactaaaatgtggcagaaacatagagtgagcacattctcttggaaaaatggtggtgatagacttgctaaaagtgaggttggcacagaccttcaatttgtaaaagaaatgcaatagttgcaaagtgcaataaaacaaagtatgcttgtattaacattttatgttattatggtgcatttgtcacaattatttttaactaaagttcatctttcacacaaatttccttagtttatacctaaggaaaactaaggtatagttttttgttccagcatccaatccaggattccacagtatagttggtcctcatgtctccttaggatcctgtttgagcctttgcaatcaaatgtggaggaaatacattttgatttatgtccatcaaaataaaatgatcaaagaaatattgctatttaatttacatatgagcagatagtcaggccaagcattaatatatttcaccataggtaaataaatatttttggttgctgatataaaatatattgtatttaaaagttggttaaataaacaaaatttatttaaaacattttttagactgtttcatagtaaaatttgtagaaggcatttgcaaattaatataaataaataacagaaactgaaacaaaaactatttagccctcttacaagtcagacatactctagtgcttttaatgtattagctcatttagtcctctcaacaattaaaattatttttcttatttttgagaaatccatagcatgcagcaagtatcaatctaagaactaaagtgtatgtgtgtgtgtgtgtgtgtgtgtgtgtgtgtgtgtgtatttttgtttttactgaattttaactttttgttttaatgaaagtccaagggcttatgagttcagagatcatcttgaatactgttcttagcatgatcatcatgttagaataacttggggctttaaatataacaccaatatagagccttagtcagactgatggtcctcaaatttaggtataaatcaaaattatgagaaagattaagatcactgattgctaggtcccaccctcaggggttctgattcggtagatctggaggggatcccaataattcatatttcaaacaaatgccctggtaataacattagtctagacaccacactgtaggaactactgactcagaatactaaagcagaatctctagaactggtggaactaaagcctaagcaaaatttgttgttatttgttatttttgttttatgaaattttgcaaccatacaaaactaaggggagaatgaacccccatgtaacaactgtaaactgagagaccaaaacagatgctctttcatcaactaagacagaccctaaggttaaggaaacaaaagttacctatgggtcaacgtttcagggcccatctggcatggcacaatgaagaattttctgaattccttaaactacaagaaaacccacacttttgctgaactctctaacaataggggctatcagtcaaattatcagattcctcctaaatctgacttacaacccagatcacaactctgattggaccaatgactggccttacatgcattctttttggataagcaactatagaccttaaaccaggttcagcaactcatagaagctgtgcacaaatgtctttttgtcctatagttcacattttaaagtaagagccaaatgccacctcattttaatgtcaaaatcccacccaaaagtgaacatgggatacatgttacatatatgttttcccatttcacatgtgcttgcctccccttacaaatatatataactttttttttctccaaatatgcagaatatttgtgaccccattgtgtcatagggaccctgtgaggcataaaacccaaccagccccttccctctttgaagagagagcatcttcagtccatgccagagactatgtcttccaggtttgttagcgcatatcaccaacaaagccctcttttctactatatagccatgttgacttctttggacaatagaatcaaccagcttctacaactataacactatttttttttatgttactactattctttctttcccactttggtctcactttcttttcttccctcttcttttcccttcatatttgtttcttgatgctcttttttattttatttatttatttttatttctgaagtctatttgaaagcaaatcccagatgtgatttcccttatacaaaatttatatgaatttctaagtgagaaggctttaaagcaataagaacaaaacaaaagcaaaaacaaaaacaaactaccacaccctggttaattacaagatagaattaaagcgcaccctgccccagatctcaatatacagccaggattgaaagcctccaattctagtcctaccttcctattttacatgaaagagacttgcttgaagccattgagaatattggctggaggactaaaattagatgtttatctcctaattcctcaacttgtaaaacatcttccagtagaaaattaaaaaaaaaaaaactttaaagagaaagaaagttaagtgtaatataattaaagaagtaatggtaagcagagtgctaattgtcttgtctttggattgtgtttggatatattataaaaatcaacaaacatcaacaattttgtctctatacatgtgctcatttatcagtatcttctggtgtgctggaaatttgatttagttagaacacctggctttaggttcgcactcaaccatatacttgcttcctgcaccaaattctaaaacaaatcacttccttaagtttcagtttcttaacttgggcaacgtgaattgtaataatatttaactatgaaaataaatgttaaagatctttataaaataacaatcacaattaaaaagcagacaaattgaaaaaaatgattatcaaagggattgcttcagtttccttatttggtcatgactttgttttagggactactgatgactacagacatttctatttaactgcgtgtgtgtgtgtgtgtgtgtgtgtgtgtgagagagagagagagagagagagagagagagagagaaagagactacgtacgttttaatgtgtagttttctatgggttctaactttaatgcgttataaacctgttttcagtcttaattgttttgtctggctttaaaattcccagctactgatagttaaatctgatattcagactattatgcaattttctaatattttgatttcctcctttatagatcattacatgtgaaacagaccattgcttcctagtttactgaaatgtgctgaaatacattgaaaataaattttaaaggtcacaataagtccccttaagaagataaatggaatacattaacattttttatcttaattttcttaaacttgccagacatgggtatttgtaattttttaagcctatagaattttctctagcctatagagttttctctagcctgtacaatttagaataggagcaacttcaagcaggtaagcaagtttggaaattttttagtttaaaattagcctatgaagcccagcttctttgtattattttacattgttaaataaaagcactagtgaatctgcatcaacacataataaaagaaaactaccctctctgggttttatttacatgtataaacaaaatttagtctcactatcctcctatatcacaaaaaaaaccaaacataaaatataaaacaaacttattatacaatgcatcccagcatataaaagataattaaaatttagagaaatgtttatattcaatctaaattctacccaaaaaatgtcatatgctttccacaactaatcacacaaatgctatataagctagcatagtaatacaattttacaaaaaaatatattttagcattttctggattcgttagataaaaaatagaataaaattctaaggaaatatgtatcaatgtctttggtacttagcataattgatttattgctttctgaaaagctgttttctttctcaggtgaaatatatctttgcatcagtggaattaaaggcagtattgaggtttttccctatcatttattccagcactttagaaacatcactctgttgcctgtttaaccctgtagagaaaagattgcaccatatgtcattctaggaaaacaaaacaaagaacagcctttgcatcttaaaagtatattatctatataaactatgtttcatgctagcctgtcaatattcacaccatccagaatatatctggttagatttttatcaaagttcaaaactttatagtgatagtttgtccttaaaatacagcttaagtggtgtcttcaagatttacatcaaggtgacatccgataggctgtcatcctcagagtcgctaaaattgaggtctaatcgagaccggtaggattgccaatagaaaagccaagcaagaaatattagaatgatgcaggcaaacaaagaaaactttgatttcaaatgtgagctgcttttcaaaaccacagggtcatacactctgatttgcaggtgcagattccagaagcagatactttgtacatggtcagctttgcacccaggatgagaattgtcaaagatttatttacccaaaggtggtaagtcaaaatggagtatagcaaaaacgttcctaaaggccacaaaatgccttttatgatcctttctgaacagtgacacatggaatttcgcccaatgcagtattagagaaaggttggggtaagtaatttcctcctaaaggggaaaaaagcctacaatttttgtataagtaactgaatccatatagaggcaggctggcactgaaaaaggtcacacagtgtgagtatccttagaaatagaatgtttcagtattgtggggacaaagttcagctcacttaagaacatttcctattacgaaccagttattttcaaaatgagactgctatgtagttatataaattactcaacaactgcagtagaactagatgtaatagctacaataatatttctagtataaattatctaagaatcatttttaacatatctccttggttagtattcattatactcaaagcttgagggacaattgaataatcagcctctatattttcaaagttgttctacattgagagttgtcatcatttagttaagaaaactcgaaatttttgcacttatgttcaatgaggcaggttgaaaaagagtttccgctcttaacacgtcattattctcttttttcaaatgtaattacttagtcaattaacgtcactcttctgtaaaacatttaggtgtaagtgaaagccatttctttatcatcatactgttttgtctgttacttttgtaatctacctccttttcatagcaaattctttaaggggataaactaaaaggactattttattttactcttcatttgtgtttctgtgtttcattttcctgtctcctgtatattgccttttatttttttgatggagtcttgctctgtcgcccaggctggagtgcagtggcgtgatctcggctcactgcaacctctctcgtctcccgggttcaagcaattctcctgcctcagcctcctgagtagctgggataacaggcgtgtgccaccacgcctggctaatttttgtatttctagtatagatgggggtttcaccatgttgttcaggctggtctcgaacgaactcctgacctcatgatccgcccgcctcggcctctcaaagtgttgggattacaggcatgagccaccacgcctggcctgtatactgccttttacatttgaggaggtctagtgactgacgtgaggatgaatgctaatgaggtaactaatgtctccaaaggatttatgggaaggactaattttattgcactttctaatgctcccatttgtaaaaccaacattatttttgtttgttgacatgtgatgtagtaattctatatgatatagtaaatatactgtgtcatagtcctcttatttatgccctaacacaagttatctccttttcattattttggatgtcaataatttcatctgttttaccaaaaaaaaaaaaatcccttagtgtttcccttctttgttgtaacacttgaaaaatgagtgactagctcagcagggaaaccctttagcctcctgaatgaacatgagaggcaagaaagtgagtagaagtgagaaagacttaaagtattcaatttcatcatttctctagagaaagcccctacagatgtggggttaggccaacaaagaagcactttggtatttttctgatcctgatcagttacccatgataaatggaatatgaaaagtattaagttctatgaggatgaggcattttcatatcctgttgctagttgcaaggtttcttttttgaatagtctttcctcttttctctcttgtcccacaccccaacctatttgaagcaataaaacataatgatgctaaacaaataaattcataattgtgtaaatataatttaccaaatcaaaagatatagacccagtcataacaggacctatttctctttctagttttatttccctttcattgcactactcaccatctggcatattatatgcttggctcacttaattgtttactatttgtctcacacactaaactataccctcgccaagtattggggttttttaatgtctttttattgccatatctcacagctggagacagtagcagagacatagtaggtactcagtaaatatttgctcaaataataaaataatagataaactaatcagaaaaaatatgcactcttatgggataagaaaaagagaaagaacgctcacattctctaaaatgacacatacatatatgaatgaaaaaatgttgtgtagaataactattatattcaagcataatttaatgaacaagttatctatatggcgcaattactcatcttgtgaaaaacaggctactgaaaaaatgattttaattttaatttttaatgtatatgtacaaaattcatttggtattcaaaaaggcttggtttgttcaaaaatatcattctatatgtagtagaaaaagtgtaaaacaaatgttaaatatgctttattaacagatttatgtctttacttaatagtaaattcttgggattttaactgtcagcaaatacaaagaagaagaaacaaatttgaaataatctcacacaacatttaaaatatttattttaattttagcattggaaaatattctgccactggaaacactacaatttatgctatgagaactataaaagctcagaagaccaaatctttaaataaaaaataaaatgtgtgcgaatattttccatccagcaaattgaaacattttattttaaaattaacaaaaacaccaacagttttttgaagaccaggaaataatgacgactaggcactaagcactctccacatgacaaattctgcttcaatccctagaaggtgtgagaatcagagcagcaggagtttttgaacccactgacaataataaatcttagattactcacttcacaatgcatacttgatttagtggaatcaagaaaatggattgaggctgtctgaagaaggtctgatatatgagagggggtctcttgtgctgttcaagggcaaaagcaaaatcataaaattgattcttcatcatatcggtgggagtaaaaggcttaaagtaaaatcctttagttccagtctatttttcttatgagaaaaattcagtttggttttatgtaatataaaaatataattccacaatatagcttaaaataacctatacaaacacattcaaaacaaagccccacatattattattttggcattttgagtttctgatccttccttaatatcattcttccaacttttcaacatgagatcttcaaaattagtgatggaaactcccaggtggttattcaatattgtttgggtataatttattaacaatctatgtgttcaatctttaaaacttcagcaaatatttctgattttcttgttacatgcacacctcatcctgttttcagacacatagtatgaccccaaacctggtcatcttggggttggataagggtatgtgattaattctggccacttgcaggctatagctcttatttgttggaatggagtcctcctacagcttgctttgctctggcatgatgaatgtaaactattgtgatgttggctgagtgactacacagaccaggaatttccccttcaagtctctgccaccaaaatgtgatggacaagttataggagtgaaaaataaaacttactttaagccactaaaggtcatgtgattgtttatcacaccacgtaacctagcatgcattctaacagagtgtttcctaacatattcactacatttagaataaaacgaaaacagagttgatccatgttatttatggcttctgtatttgtgaattcacctactcactaaaatttgtttgtaactccagaaacaatattctccgtgctcccatggttattcctgaacaagtgcaaagcaactaacaaagacacttgatatgcacattcccagctgaagtcaaacaaggccctcatactgtaaacaagtgtccttttacagtctatttagtacccttttttaattctgcattttttagctttttgttagaaactttgcagaagcctgtctttcatttagtctttcatactttgagtttcctaacttgccctcattccaacatctctgcccagatgaatcctaaactaattcagtgggaccacaaccatgtgcactatgatttcttcactctaaaatccagatattgggaaactgggatttgttcatatgtgtacgtagtgggtggcgtgggagataagatggagttctgtctcctccttttggtaaaaatataatcctactgaagcactaaaaatcaagcccattttatacagcttggttaggttctagaattaatgtttattatagattaagtagacattttatgggttgtcctgggaacacaaccatcatttttaatattgtttctatggtaaaatgcattccaagttccaaacaattgattcacaaactagcttcgggaacactaccagcttctaaaatgtggattcctgtatagcaaatgagtaaagcatagaaacaaagagataatacccaggttttctatctttagtgtgccaggatggtagcttagtaatgataagactatctgcctgggcagcctggtaaacctatatttactcagcacttacttatgagattaattttttttgtcaattctgctacataattcgtagtcatatgggaggaatttggccatagaaatgataaagaagaaaatgacagaatatatagtgttgtgatcctgtccacagtacatcactgtatttgtaatgcaaaggtctgtgccctgacaattatcttcagcttattactgtagcagagaatagattgggatcactaacggacatgacttaccacttctttactggaccaatttgccttactgtgtgtgtgtgtgtgtgtgtgtgtgtgtgtgtgtgtgtgtgtagtgagtagccactaggttgaacaaatctgcccaatcaggctgtgttaaatagataatgctgattaggggaagggaagaagaccagaagtgagattagaattattatcagaagtttacatttaatatgcattatacatttagacaaaacatattgatatttggccatcaatcttgcttgtatgagctgtctaggaatgatggaaattaagagctacagttctcattaaaacgtttaattttaaacaaggcaatatccacatatttacagaatggatgctaccctgaaaaataattgaatctattagagattgtaaagaaaagccaggagtccactgtccactgaacatgttaattgaatccaactttgcaaaaagatgaagcaaagaatgttctctctaattgcaaaggtccccagctgggtacatatttctgtttatcacttcacacctgagtgacccatggtgtttcatacagatcctgtttcttaggaaaagattcttaatttgcaaaataagcccattttgttagtcaatgacttacacagtgctttggcatgaaccattgggaagaaacttctgatttattcaatgagatttgtttatttatacctaataattacatatatttatggggtacatatattttgatacatgcatacaatgtgtaatgatcaagtcagagtatttacaatattcatcacttcaaacatttatcatttattcatattaagattatttcaaatcctcttttctagctattttgaaacatacaatatgttgttttcaactgtagtcaccatattgtgcaatggaacactagaacttattctttctgtctaacttgtctgtttgtacccactaaccaacctttcctctctctccagcctctaataaccattatgctactctctactccacaagtgagaatatacaatttttgtctttctgtgcctggcttatttaactaaatataattatctccacttccattgatgttgttacaaatgacaggatttcattaatttttatgtctgaataaaatttcatcatgtatataaaccatatattgtttttccatttatctattcatggacacttaggttgatccctgatactggctactatcaataatgctgtaaaaaatatgggggtgcaggtgtccctttgatataaagatttcctttcttttggataaatacccagtagtgtgattgctgaatcatatggtagttctatttttagatttgggaaaaacaaccatactgttttccattatggtagtactgattcacattcccctcaacagtatatgagagtttttctccacatccttgccagcgtttgttattttttgtctttttgataattgtcactctaactggggtaggagatgatatctcattgtggttttgatttgcatttctcagataattagtgatgttgactgttaacggattgaatgtcttcttttgaagtgatgttgactgttggacatttgaatgccttcttttgaagaatacctattcagattctttgcctagttttttatgggaatatttgtgggcttttttatttttatatttttatttttttgctggtgagttgtttgagtcccttatatattccaggtgtcagtaccttgtcaaatgaagagtttgtaaatattttctcccatgttacatgtggtctcttcactctgctgattgtttctgtgactatgcagaagctttttagtttaatatagtaccatttgccttttttttctttttattacctgtttatttgaagtcttggccataaaatctttgcacacaccaatctcttacatcatcccctcatgattttttctagaattttatagttttgagtatatttaatttttaatctatttgagttgattttttatatggtgagagataggggtctagcttccttctttgtgcccattgagactcagttttcactgcaccatttattaaagagggtgttctttccgcaatatatgttctcagcacctttgtttaggttctctattggtctaggtgtctgtttttatagcaataccttgctgtttttggttacaatagctttgtagtgtatttcaatgtcagatagtatgatgccccatttctgttctttttgctcagtattgctttgtctgtttgacgttcaagatgatttttttaaatttacaggctataaacgacattaacaaaccagttttagaaccagtgaccagtattcaagtactttctgaggttaaaccccagatagaagaagttaatcacttttatgttgacaacaatcacttttttcaggttgtgtctgaaaacagaagtttaaatggatacagtctaactatggaaagttaaagttgctggatggttgtgtcacactgtaatctgtggatgctaataaaaaagagcaattactgagatgtaaatatagacaaaatatgtttaaatgtatagttagattaataagaataccccccacattttcctcttgggatattggaatatctaggaagagctatcctagtcccaattctctgggaagtgcagaatctagacaagaacataccagtaagcctatagcagacgccaacattattaaccaaaccagcatagcaacccatgatggtaaagaacaacgttgcacaccagcaaagtgaccacagatattatgattgatgagacacagatgctctgttaattccatgatggaaaacgctattatcctgtgacagcgcttaggattttgcaatggcactttttctgagcgtcactagcataattttacttattataatctgatgagtataagatatgttattaccaaacgttctttttttcttacagttttatatataaaatgcagtgatcagactataagtggggagtcatggctctcatataatatgaatatatgggttagaactcgagcccaaaaagtataatacacctcaaagaagatagctggggatattgtgtatatcctatttctaatggcaaatatctggcgaatgtcataattatgtctttagtgggaatgagtaaaggactaatatgtttaacatttgaatgtataaaaatatagatgcttaatttgtgtattttaatacaagaagaattttatataaataatatctataataaaaaatactatcagacatacctaaacctaaataaaagcctaaagaagtctacatatttatatttaatcagcatgctgatacaactagttatctaagtgaaccaaatatcatcaaatatatctgaagtcatatgaggtcatttatgaactacaagtcttcttccacctaattagcttacagttgacctttagaaagtggtacttaattgaacagaaatgttcagaaatatgttctgaacttgaacttagcacacatgaataaacaaccaatgaaaaagattatattgccacactattttggaatcagggcataaaatataagtcataaagatagaaaaatgatgttttggaagtacctaccaaatatgtggatgaattatgtattttctatagagcgatatatatctcattaatgaatataaatatatctatgcacacaatacccacatgccaatttatgcatatgtgtatatgtagtgtgaggtaacagatatatatatatatatatatacaatttaatgtcatgtaattaaagataatgtgtagtattctgtcataatataaaggagtaatctttatctatgaaagacttctttggctttaaatacctgtcttttaacatcactcatatgtgtcatcttttcagcctttgccttttctaacttaaatcatttatctatttacttcaaatttaaatggaagttgcctctgtataattttttgtagtgttctaagctcattaacatatagtgagtatctttggaattaacatgcaactaattacaaaaggtgttttaacataatttgtatttctataattagaatgatatgcacttcaaagaaaagatgtaacttcagaatttataaagtataactaaatatataagaaactttatttatataacagatatttattgtacatctaccataaaagtattttccacactactcgaaaacctctgcagacagaacatactgagaattccatgccattatggagctcctaattctagtagtggtacacagacaatacaaacagacataataagcaagaaagttatttttaatgttagaagcttacaaatgttatgcaaaaaaaaaaggatccaggtaagtttaatagggtgttctagtagtagaagtggaaatatttgattttaaatcaagtaatcagagtcagtgtcgatgagaaaattgtatttgagcaaagatttgaaggaagtgatgatagatttttagtcatgtggctatctagttggcagcatgttcccatctaaaaaaaaaaaggcataaagcagcagagtacccaaatatgttcatgtaatggaaaagaggctagagttcctgcaggagaatagcaggggatgaggtcagtaaaataacaggggtaaaaaagcatacgatcctgtatgcatgagaggactgtagcttttaccaagagtgaaaaggggacagataacttatttttgaagagacaactaaagtgaacacccacttgtataaaaggttattctgcctggtgtgttgagtagaggagaaccagggaaaccaattaaaaactcactgaaatatttcaagtgacaaaggagcatcatttgtaccttactggctttgcagtgaaaatgataaatttggccagattttaaaaatattttgagagatttcataatgggctagttacatatgagagacaaaaagaggagttaaagatgatgccagggtactgggactgagcatgtaacagcatgaagtagtcatcagatgaggtggagacaatagcagatgtaccagctttgttggtatcactgagggtgctaccagggcaatgttaaatttgaggcactttttaggtatccacatagagatcaggagtaggcagctggatgttcaagtgtggagttcaggagagaggtctgagctggacataggtattttggagtcactgacctatgaatggtatttaaagccttgaaatgcatgagactgacaggagagtgaggtgtgttcaataactgagaaatacctaggacacgatcctatgatacttcaacattaaaaagtggtataaaacaagagactccagtaaaacagacagagtgacaagttaattaggataaaaacataatgccaagtaaagaaagtaattctttttttaaaaaaggagatagtgatacacgatgccaaatgtttattataggttaacaagctgagagcttaaaatgaccattgaatttgtcaaagtgcagatcatctatggccttgacatgatgaacttcagtgaactggtagcaatgaaagcctgattggagacgtgtaggagagaaagagtgttgaggaactgaagatacatggatggttttgtagaaaatgtgaacagagatatgtgaaggcaaccgacgtgccaagattggtcgagggaatacctccttttttaacttagaaaaaataactgtatattcgtacatcttggatgatctcacatcagaaaaataattgatgatgtacaagaaaaagagtagggaatgtctggagcaatgtccttttggtagtgacagggataaaaactagagttcaaatgggtaaatactgcctgatgtcctttacatagagagatggagaagtattatagactcttctcttttccacatgaaaaacagccttcacaagatgagaattgcttgaaaaactatcgtctaacttctttcatctatcaagcttcctgtctatcattcttaaacctctctaagtctctatcaacaaagattaatgtgaatcttaggggagattttctccagcagggaaaagatctgatgcatcaagcagttatgaggatttacaggcagacttctggccagtgagcctcactagtcaacctccaaagtgcatgcatatatgcacatgcacacaaacacatgcacaaacacacacaagcatgtgtactgattacttataagacgcatttcttagaaaggagaaggcaacaattcctaaatttctggaaaagtataaaatctgaaaatggatgcatgaagaaataaagaatctgaatagtctcttatcttaagctaagacttcaacaaggccttttgaccaaaggctatcatctctaagtctcaaggacaagtaattagcagcaattcatacaggatgtaggtggaggagaacatgtaagctgcaaaaagggatcaaaggagatctcacagaggcaccaaaaatgtgctctccaacactaaccataaagataccaagatggtaaccaataacttgccatcacagaacccaatgattttacagttaagttctaccaaatgttcaacttttgctgcagaaaacagaaagagatagaaaaccactaactcatgttatgactaaaataaaataaccttgattcttttttctttttttttttttgagatggaatctcacttgtcactgaggctggagtgcagtggtgcgatctcggctcactgcaacctctgtctcccgggttcaagcgattcttctgcctcagcttgccgagtagctgagactacaggcacctgccaccacgccctactattttttgtattgttagtagagacggggattcaccatattgtccaggctggtcttgaactcctgaccacgtgatcctcctgccttggcatcccaaagtgttggaattacaggcatgaggcacctggccctgtcataaccttgattctaaatttggtaaagaacaatatgagacaaaggaaaacacaggctcaatttgctcaagaacataaatttgagaagcccaaatcaaatactaactatattcaaaatcacattaaaatattgaagtaagatttatgccagaaatttaaaaatggtatacaatatgtacatatgctctaagaatggacacatatgctactctacccccagctatcacaaatgcagagtgattaacatactggaaatcaccatttttaagtagtttcgtctagtctcattccctcttacaactctatgatcagacttccttgctatcacttcactaaagctcatcttatctaagtcatggatgatctgcactatgacaaacccgatggacaattttaagctctctgcttgttaatctataagaaatatttggcatggtgtatcaccatctccttttaaaagttttttttctttacttggcattatgtttttatcctaattcacttgacactctgtcttttttactggaatctcttgatttgtaccacttgttaatgttgaagtatctcaggattctgtcctaggtgcttctcagtaattgaacacatctcactgtaggtgtgttcaatagatcagtgactccaaaatgcctaagttcagctaagacctctctcctgaatttcacacttgaacatcaactgcccactcacatctctatgtgtatacataaaaagtgcctcagatttcacattgccccggtagcacccctagtgaacccaccaaacctgcttcatctgctactgtctccacctcatctgatgactactccattcttttacatgctcagccccagcaccctggcatcatctttgactcctgtttttgtctctcatgttactgtccaatcatgaaatcactcaaaacatatgcagaatctggcctatttttatgattttcactgaaaagccagtaaggtacaaatgatgtttctttgtaacttgaaatacttcagtgggcttttttgtttgtttgtttccctgattctcctctattcaacacgccagccaaaattacctttcatgcaagtgggtgctcatatggtagatcaccataccgttcagtggttagaaacaacaaaatagatatgcattcagcaccataagtagatggttaaaatatagtgctgaaaaaatagaaaagaaaaatctatagcaaatagcagttacagaaagtaaaaacatacacagctctgtgtatttagcaaagttatgtaaatatgtgcacatccagggacatatattaagacattaaagtactaatttgcccttgagaaagcaaagaatgaacatggggactggaaaggaggaacatattaaatacgcgtacctaataaaaaagagaaatttgtgcttacaggccaatcatgataggaactaagaactgaaggctataattaactcaactctctgaatgtgggttttaaacaaaaactgaaatgatatttcctacctcttagggttatttgaagataattttagaaaatgtgtttaaagggcttagcacagcttggtatatagtgagtattaaataagggataactattatgcttttgttattattattgttattattatagctgatttttttaactctccctattaggtacttacataaatgtttgttttgctccaaaaattacatatcacataaagccattaatataagctgtaactcacttttagaaatataatgtgaattttcttgatcatatttgaacactgtattggctttcctaggactgagaaggaggccagctggaataggttcacttttaagtgaaataacatgagtgaatcttcattaattttttttcctaagtcttcagacaggtttagaagctggaagttaagagataccacataatctgatatcatactggatttcactctggagttcctgagactggggaatgagacgaagaataaatagctttgtaaattctatccgtaatcaaagctgatttgctgcaggataatttttagaaaagcaaaacctggagtcttacccccgtcagtcaaaaataatatgataaagcaattctctctgatgggatccatgctggaagaaatcccagataatacaatgaaacatttcccggagcagagagcttggttcattgtgccaaacaatggctggatcagtggctattattggaaagcaggcctgccagctttgctttctggaggctgtctgctgagaaaacaactgctgctcagtaattaactcctcccaaatgtcagacaaggaagcagcaacagtgacctcttgtgccactcccagtcccatttccccatgttcaagccggtgtttgcgttttctagggctattactagacatgtacgcattattgctgctggtctcacaggcccttcaagtaggcaccctcccagtgttcagttattactttgaatgtgcctttactgaaaaaaaatccaagcactgaatagagtgaatacttactattttataagcaattttaataaaattgggagtaatgaaggtggaattgaagaaaggaagaaaataagattaaagaaatgatgaagaaaaacaggatttcatgtccttagtgtagcaattttaggtggttaatcataccggatttgaatttagaaacactagtggaatctttcctttcctccttccttgtataattaagttaaagtctctacatcttagtttattcagctgtaaaactgtgcccagtgctgctagaataattaaatcaaagaaaatgacattatctttttagactgattatcataatacccagcacaaaacagattcaataaataatttatatttactataattgtgaactaaaattaacaaatattattaccaattatatgtaatataccatgtttcttttagtaataaatagcaaaacaacaagaaaaattattcctactattactactacttgggtaataattagggtatactctctccaaggcatagttaacacttctgcccctaaactactatttgccttatcaagtatttttttcccagtggctatgaaaatgcattaagatgtcattcatatagtattttctttaaattctgcaacctaatttttggtcagtttacactagttttcaatatattctactacatccttagaggtaaattgactacgaaacagattttcttcaattatccactgtgtaagtcagatgtaactgatggcttagtcaaagagaaagcagtaaattgtcattgattaattctgtaaataagtgatgaatctattatgtcttaggcataatttgtgtctccttcacagataatcctgcagttaggtaaactatagaggctgcaaaattaataattacagaaaaacaagataaattaagatagacatataaatgatagatagatgcaaggatattatatatagataggtagataaactgtgaaatcccagtgggaatgattggctatttagaaatatagaaaacattttacaatctgcgatgtttgagactggaggggctggaaatgtttacaaagaagaagaaagagaatgatgatcagaggggcaaatgtgaaaacatcagagcagcataaaagaatcaaacggatgagggctttatgaaattcttggactgagcttcttagtttgcaagttccatcacacatcaagtaactattaagctgtatctgggtctctcactgaatggaggggatttgagatgcagttgactagttggcatacaattaataattttttagaaatttagataaatgttgactttgatttttcctttttaaaaaaacctctgtggccaatattctcttgacatctcccatgtttttgtaggtctaggtaagttaacaggccttagaaactgtacctagaatgcttgatagacaaaagcatgcctgcatatgtgcaatagagtagagtggggagtgtggctaggtagtgaacataaaagaagtaccctgagagaaatcttaaaaggaagactggtttcaaattatgaatggcacaataaagtattttttaaaagaaaagcaaagtattagggagatcaaattatataaagaatggctaaagtataaggtagagggattaataaaatggaaaaaacattggaatacaaaagaacacttgagaggttaacacaaaactctaaaaatattttatgatttttgcactatttcaatagctatgaagacaaaaatattagagaaccagaataatacgagatgttcctgaaattttcagtattgtttgagaaaatttcagccatatttactttgggagtacacgttgctgcatacatctctctaagtttcattcctgacaaaagattaattcaacaataatcacacacacacacacacacacacacacacacacacacacacggcaaattgaactgcaactgtgtctgtataattgaaagaataaacaaaaccactagttaccctgaagctgcaggagattcatacattattataaatgatgaccgtcatctaacatatgcatcattaatgaataaactaaatcttatgaaaaactagtttagtttgtaaaacacatatagggtatatgttaataccactatttatataattcttacccagcagaagattaaaaatatttattaagaatataaatgccttctaccaattattataaatctgataggaattaaaattaatttacatttattcatttattcacatatttgttgagcacttattgtttgttccacattttcaaatcctggcaataaaaaaaaagggataaagattcctcttttcatggactttatgctgtagaaataaaatatttagcatattttaaatattttaaataaaatgtttagcatattttaaaggactatataagtgaattttattaggatgcttctatgttccaagtgtagacttttctaaaaggtctatgatagacaacttttacatttaaagggaatagacgaagtctgctctaaaatagaaggggacttatactagtaaaaattctatatatttggatttatatatctatctatgtatttttttcaactttaaacaaaagagactcagttattcaaataaacgatacattttacagtatttccttttgtttctcacaaaaatgctatagtaaattttggatattaaatgatatacaaagcatttttcaggttaaaatgtgtctttataagcaagtgttggattgcatcttaacacactttttaatctcagaaatctcttcaatttctgaatacaagttagctcggaaatattttttttaggttagagaaaactgaataaaataaaaatcacatattgaatgaagagtggtcaagtttctatcccactttgaagttagctcattagctcatatatatatgcagtcaaaaataaccatgtctttgtgtgtgcatttgttcaagacatgtaataggaaatattgcacagatataagagtaagataatattataacagtttattagaaaaaatgtatttcagcatatttttatccctaataatatattttaaaataggaaaaagttttttaaaatcctaaataatgaacaatggcttcacagtatttaattttaaaatcataaaatttttttcttaacaatgttatcttgcctcattaaaagtgtgcctttgtatttaagtatgctttgtcattaagaggatagaaaataggttaaatttaaaaagccaactcagaatgacgaagaaccaaataccactatagtattaggtgtgtaggttggtatactcatacattactgctaagtagtagtagtacaacccgatgaagagtagttcttaatgttcaaaataaaaaatccacgattcatttcacccatcagttctatttctagtgccactgaaattttgaaaggaattgcattaaatttgaatattattttgaatttggatatcacattgggtaagcatagacattatagtagtattaattcttccatgaacacagaatacgtttttacttatttatgtattcttcaatttaattctcaatgctttacagttttcagtgtacaaatgtttcattccctttgttaaatgtattaataaatattttattctttttgatgctattatgagattgttttactgatttcattttagatagataattattggtgtaaagaaatgcacctgatttttatatgttaattttgtgtcctgtaactttactgaattcatatattatttctaacaaggggtgtgtgtgtgtgtgtgtgtgtgtgtgtgtgtgtctgtgtgtgtgtgttgtgtatagagtctttagggttttctacatataagattatgttatctgcaaataaggatagttttacttcttcctttctgatttagttgccttctatttatttttattgtctaattgttcttgctagtatctagcactatgttcagtagaagtgacaaaaatgggcatgcttgttttttgttttggatcttagaggaaatgctttcccattgattatgttagttgtaagatgtttataaatggcctttattaaggtgagggagtttccttttgtgcctaatttaacaagagactttattatgaaatgatgtgaaactttatcaaatgctctttggcccttattgaaatgattatgtagttttttcattctgttaatgtggtgtattacattaatttatttgtgtatgttacataaaccttgtattccagagatgaatctcttcttgttgcaatatgttctttatatttcagagtagaaatcctacagactgtctactgccttataaactatcagagcactgctaaaataatcctttttaattttttccttggtcatataataaacagaaaattgcccaatatagtctattttaggatccattggaaaaagtatttgacattccaaatactgagatttaaaactagaggagataaaaggacgttttacaattggacacctttctccatttctgattatgataatctcatttctcaaatttccacttttctaagtatgctaaacaagggtcaccaattgtatctattaactagctatagtaaatcactaattttcaagttagatcatattaagggtttggataccaggatgaaataaaatcaatgtcctcatgaagcataatgttggagctggaagttggccatgattatcttgttttcatatgtactctcaaaagtacatatttaccttgactaaaggaaatagaaatgacttgtgtttgggattttggcttaacatctcaatgggaagactgaggtacccattcataaataatctgctaatttaatgagttgactgaaaaatgttattaggacattttgaggttgttccatgaaaagtttgtcttagcaatatctataaagagccatatttttttttctcaaatttgcttttgtcgatagcaaatttcaagtttcaaaaacaggctcaacatttcacagttgggaaaacccacactgttaaaagcttttaaggcaaaaaaacaaacaaacaagcaaacaaacaaacaaacaaacaaacaaaaaacttgacatcttgactcccaaagaaagacatatataatatacaaaaaagtaacactaaaaaagtaatttcactagtttttcattataaatactaaaattaataggttttatgcaatattttctatccttgttctttcccttagtaacatcctccacaaccccaacaaaacagaacaacaagaaaatacctacattctcctggttatcggaacttaagctattatagttagcctcaattcagatgaataagcaatgataaccattgtaagtaagccttgctatccatcatattctcatggaagagaatctaatgtaaatgaaagtgttttcatttttattcaggatgactatgtaattacatatgtcatctatcacttctaggatcctcctaaaataaaattatgatagcacaaaaatgaataaattgacaacagtgaagagaagaaaatggggttcagggctaaggggtgggtatcaggggaatcatcaaacttgaggaaaaagaaaagcatatggagcaatttgaaggataaagttggcaggaaaagctaaattcagagtttaacaggagggcctcgtagaggtgggactcaagatcttttctgagggctttgctgctgggttaaagttaaccctggccacagagaattaaagggacaggtgaggctgaaagcaatcaaaagtttacttgagtttctgatatacaatttcatatatagacatctaagctagtgtctgtcacgtgatgtcactacagaacaaacaaaattcctatattttctgagatcttaatttgtgagtttaataatgccctcttggataaataaaaagaggctcagtggagaaacatgttgacacagcattgtgaaattttctaacagggactataaagacatatgaaaagcaaaagggtgtcagtaaaagactttgtatgtgtcaagcctagcactcatgctgagcttttgtatggccaatgagctaggaatattttttaattgtttaaaaaaatttaaaaaactgtatttgtgacatttggaaattgtatcatattcaaattcattctccataaatagctttattggcacatagccactctttaattttcacatattatccatcgctgtgttagcactgaaactacagcagcagagattgagatcttgtggcccccaaaataaaaattcaccaaatcatagtgcagctataaataaaactaaaatgagaaagacattataagcaaagaataaccaaaaggaagaaagaattctttgggactgaaggtaggaaaattttacctttgaagtgcttaggactcaaaagcatctaaattataaaaaaggaaaagtaatatgtaaaatataaagcacaaataattgctatctccccttttacagaggtatttgctcatgtgtattctataatacaaaatggcaaaacaaaataatgcataataaaagaaaaaatcttttattttagcagccatagtaggggatagaagacgaaatgctcttaaagtttttaggaataaaaattattcataaagctaggattctttagccagagaaatatcaaaatatagggtagaataaatacattttcaaacagacaaggactcagaaaatttatttgctgggatccatttttaaagtcttacttgaggatatattccagcaaaatgaagggaaaaaaaaaacaagtgagattggattttggaaacagaacccacccagaacacaacaagaagagaagatttaggattagagttgtacttcatgtttaaatgcatcttattgtttttaacaagaaataattttatgcttaaccagaaaaaaatgcaattagtatctcaagaaaaaaaataaaaattcacctaatcattgtgcatatataaagaaaactaaaatgagaaacaacttttaagcaaaaaatgtccagtaggaaaagataattctttgggattgaaggtaggaaaattctacctttgaagtgctttggactcaaagcatctaaatcataacaaaaggaaatgtaatcatagaacagtacatggtcaagaaataaataaagggtataacatcataataatagtcataataatgaaagtgacttttttactactcttcaacatttatagccaacctatgaacaaagaatgtcttgtttttatttttagtgcagaatgtaactgttaacaacattagaaatatgaagcttttctgaaaataaaagtgctgctgattgtgggaaattggagttggagaggaaagtcagggcactgatactctcattctctatggcatataattggaatactgccttatgtgcgtagtgggatcaaaataatgtctaaaacgtggaaaatagggacaaaattatactctaaaataggaactgcaaacaccagtgcctaaggcatatcagttagtaaaagaaaacagcgagtgtaagaaaatgtatgctggactggtgctattgcaagcagccgcccaccagatatttaactgttttttagcacatgatggagaccacacagaactcacaggcaagatgggcctctaactctggatgacattttgtaacttcatatttaaggttatgaaataatcaaaagaagaggtaaatatgacaatataagaatttaatattagaagaaaaaagaaatgaaagtcataataaaatcagacttttatctttcatgggagagatttgacaagttctcttattgttgataaattaaataagtatttttgaaatgttggaggcaaaccttaaaataattaaagcagaagttattataaagtttagccctgtagatgaggaagagttggagaatgctgttttcctcatgaattctttttatatattcctacttttgaaaacattataatatctacgtattatatttgttttataaggttgaattaaaagtgtgacaaaatagcaattttttaaacacagaaaagtttatgcagaaacctcatatatctctaagtgggtttgtaaattgaagcccagcataataaacttcctatgataatgagatggcagacaatacagctgtaaggcatgtgaacaaatgtgagatggctaaggtagaaagcgaaatggggagggaggccagtttgacggagctgaagtagaaactgttgaaggaccaataatgaaatttgctcctaggacaacaaataaattttctatgtgggataataccatgcttagttgtagattgcacggattttgatgacagtaagtaagcaggtgtccatagatcttccagcattacaaaactccacacaataaggtatcccatgaaaccatctattaaacagcaatactaggtgatgtgaactgtaacagcagtgaaagagaaacatctgaggagagattgtttgtatttctttccacaagtcaatgttaatagttactgactcaatggagaaagaattgcactaatcagatagtagcagttatccatggctgtaagacaggaaaaaggagtgaagatattctcacaatagtggtttaaagacccaaagtcacgttcatttaaaatgagacttttgaaactctggtgccaacagaaatgattttttctttagatttttttctagaactatctgtacacactactatagcacatacccatttctttcatattatctatagttgctttagggctacaagtgttggagttgactacttggcaacatgatcacattggtctgcaaagattaaaatgtatactatagtgcattttattgggggaaaagtgcaaaaaaatatgaacagatagtaaaagacaaattaggagatgaaacatgcttcaatcttaaaacggaggtcaaaacaaatctggccccctccagtttttgcatggctcattagcgaaaattaatttgcatttaataagttcagcaaacatttagtaatattgttaaacatttatttaactcgaaaatccgctgggtagatgagggttgactgatctaaactgggcttgcatccatcccacatattgcttatactcctcataagacaaaaacgttagcgtatgcattttcatttccttcaaaagaatatttaattacatgtgacaattaaatgaaattaaaatttgtgtgtcaataaagttttactggagagcagacatttccatttgttacatattatctatagttgcttcgatactataagcgttggaattgagtagctggtaaagctcatatggtaaagctcatatggcctgcaaagcttaatgtacttactctctgacattttacagaagagtttgcagaccccttccctaggaggttggcaagaatgagaactctcagtaagctgaatttagggttatgttgacaggatcagtaggtattgcattttttttcccttcatcttcagagtagtacctgacatatagttgccttgtctgcatttaggagggggatgacacgcagagaaatcccaaggaatcactttgctattttgctttgtcttattttgtttttagctgtcttagactggagcatggggaacaggaaatataacccaaaggtccaccgattaacataaaaattaattatattttacctatattttacatgttatcttttgtcttaacttttattcaataaaatgtatcaaatgtaacaatggcttaagagaagaggcccatgtgaaaaatattacaccaaattcgacctaatgatcaactacaaatcagtatttactatatgtcaagcatggggctaattcctaggaataataaccaaggaacttaccacgtagaaaaatgaaagcccagaagaaaaagcatcaagaagataaattaaatgattatctgctttaaaattacttaaaattaacaaacaggacaaaagactgtttgtgtaaaaatataataggctagaaactatttatggtaaatagacaaagtttttgagctaaaaatgaattacagaatgaaggaaattctaagactggcctaagatagttgcaaagaggaagggggtctaaacccaactgatctaaacatatgaagtcaaaatatataagatgctgccaaaaagaagtcagaaagcattcagtaggatgttttaaaggcaagatgattactcacagaaccttttaagataaaactcagataagtcgaggcaagaagataagaccataagatttacattaagaattaaaaaaattaaatcaatttaaaattggatatctaataaattttttaaatgagataacctgaaatatttataaataatattttatttttaacaaaagtagaaaaattgttaaaattatttgcgtaaattttaatatatttattcatatatatttgtatataaatttatatatattacatatgattttcataatatgataaatttacatcatagctaaaagagaaaatcatttcatatagcatactagatttgaatctatcttctactaataacatatctggaattcaaatattaaatatggaattttatcaggagactaaaatgatcttctgtgactcactgctagagaaactgatatgttaatgaacatcattttattaacatattccaaattaattaatactttcatcattctaagaagtttaaaaagaagcatctgtttgatatttactagagatgatttggtagataacctgcttatgtggttcttttgttgtgaatcatattttctgacaaatattctaaacatttcacttcagaatattttattgtttttattatcacacaaaattattacttgggatttatctattttgtagattttcttcctatatgcacagttgacaacaagataaaaatggtatttctattagcccagtcaattagcatatttatagcagattttataatgcctttatcgagatatgattcatttttcataaaatttccttttaaagtatgtaattaagtggctttgagtatatttagcccaaccttcagcattgtcaacttttagacaatatgcattactccaaaaacaactccatacacattaacagtcactctctattcaccgctacccacagcccataacaaccaccaatctaaaaactgtttctacagatttgcctattttctggacgttttcagattatagcctataaagtagatattcatttgataagaaatgccttctaactgaaattattcaaagataccttaaagaatagtcagcagaaaatttaacaaaacagaactatatagaatccttataaaatgaagaggaaaaggcaccatattttgagttgtgcatgagaaaccatcaaatatgattcctatacattccaataatgttaaaccattcattgatcaacaaaagcatggttttacctatatggtatgtcatatggaacattttagccaaggatgacaaagtaggcaagtagtctcctctgggatataaattgtaggttaaatgtaatgaccttcctctaacctgcagaacatgtctcataactaatttagaattaaaaataacactctattttaagttgttattagcagtttagactgtgaaagaaatcgaaagatcttttccaacatagcagcttattgagttcaggttttgttaggaacaagaaggcagagtatattaaaataatccaatggtatgttgtgctcggcatgggaagaagaaggcaataaggaatgaggaagacagagaattgaattcagcatataatgtgttccaatacctataaaaggtagacattaataagtttattttatagataagaaagaatgccaaaggaaataaaactaatgtcacatagttcataattttgcctatcactataaatcaacaaagggaaaataataacatattgctgatacacttgtcaagagaccccttactccacataaagtatgtccagtataatttagagtacaatgtacataaattactaaaaataaggactatagaagttatcatgtatcttatttatacccagcagcaacctggacttactcataaatgtgatccctaaaagaagatacattgtttcctaaagggtcacagtaaaaattatcataaatctgtaaattatttaatgattaaaaaagttttgctttatttgttatgcttctctgggggctaagggtgaacaatagataaaattaacacactttaaatgatttacttgtttaaaatgtaaagggaaggatgaataaagaaaaggcaacagaattcctcgaagtaggatgcactgtagggtatcagatatagttgtatgcatacagagagaactaaaattttgacacattaataaaacgataagctaacatgtcaacatctaagatgcctatatgtactatatacatataaattttgcagggctagaatgaaacaaatggttgaggaaaaccaaaaaaacatacatgtgcacatatatgcctatagtcacactaagaaagcacactatttccagagctaattagctcactataaggtaaaaggggggaaactcctctgtttagagcaaggaatactaactgctttctatataggagcttgttgatggaaggcccattcaaggctggaagccttaccacctactagactacagaggatggaaattttctgatctgtgaaaaatctaaatacgcaacataccttgatgtgcagcaggggcagacatagcaggacagataataagattttaattaagcaagatacttatcaaacctcatgtttttatattccaataacttaaatgcttacatgtcataaggacaaaattatcttcatttttaaaatgtaagtttttaaatataaaaggaaaagctttaagagggtataagcagcatcagtttacactttgttttcagttttaaaagggctttagaatccacagtaataattctgatgtgttgactaccagaaattgaggaagacacacacaagcagaaggtctaatatctcaaactattttgtccagatctatttttgcatgaggctaagtgaaagatgttatgtatgacaagatgtcaaactccacaagaaaatgtatgagaagatgatagttattccttctccaaaaaggaactctaaaagtggcaaatgaatgtcccgtttcaagatacacacaattattttgggatctacatcccataattgctattggtgtggttgggatagaactaattattctttgtgctggatttgaggcattgtagtgtgtgccctggtgatgtcagggggtatcatgagaccctacttggcttatctttcttacacaatcaaaattaaaagttggatgttggcaaatggctagtagtgcccttagacctgagaaaggctgcttctgtcctggtcttacactatgaaaggtctcacatattgcaaatattaattaactaaatagccccagggcatcttttctggctcgcaattaggtaacaatgcctcatctaattgtaggcatctaccctgctaatgaacactttccaggctacagacaaatgctgccttttctcatttgctacatgtcttcaaaacataagacaacctcagcccaattctatgaatgcctgtgggttgtactagtatttatgttgggaactgctttggtgtataggaaagagctggaaaatcttatatgagaaaaaatgcttatataagaaaaaaggcaaattaattaatttgccaaactctcactctgagggaatagttttccagaagtgccaaacatcaatttctaggcctctgcttgtattccaattacgttttcaaagatagccattaattggcatcgtattgcaacagttgatgtggcaattaaaaaaaagtgtgatattaaaaaatataattatttatacgtttacagatatgaaatggtttgcaactagatggaaaatgaattgtataattgcaaatacttttaagaaacagatcaaattatagaaagtattaaggggatattattaaattgaacaaatgatgctttttaaaagctcatatctccatgtagaaaaaattagaaattaagaaattctgaaatgacttaaattttgttttaagacaaagagtaatcactatatatgctcttaaattatataatagaactaaactatttaataatacttaattataatttattatgtgactccattatcattttatacatatttcattttcagtctaagtattgtttgtaaaattttattgacaatctcttttgctaatgctgcagaataggaaaatttctccaaattaaaagtcatggaaaaaactaacaaagaactacaatagctcaaaaattttatgtagcaataatgatgctagaaaaaaatgcaaaagtgttgatgtattatcataattagagactttctaaaattaatagcacatataaatagctatattcagaaaacatactatttatgtaaaaatattgtattcataccttagagaaatcatataacaattttccacaaattctcaagtgtatttctttcattttattgctaatctaatgtaaaatatctttatctcagttttaaaaaaaatcttgtgggtctgagaagagttacccgctactagcttttcacacacacacacacaaaaaaaaacagtgttactcattaaaacttctgatatctgaatcagcagtggcttttattctaaaactttttcaaaggatctgattgaatgtttgtcttataagctattaatatatgctgtgaaatgtcaaatttatgacacaaatgagtgtattttgttatgacaaatgtcaaacttatgacacaaaatgagtgtattttcttaaattaaaatttcaaattgtaaaacgtttctatatttgctcttactaactgaaagattaattatatgtgcatatatgtgaaataaataaaatggtatagtcatagcaaaatacttatttgttttaaaatgacttggaaaaattctaataaacctacacatggtaagaacaattcactttttcaagaagtataacactatggtaaagtttttaaagtaggtaatcgtgacatgaaggggaataagaactacttcaaaagctataattaaatgcattatgtaaaaatttttgaagtacatgtttatacttagtttcaggacttaacgaagcaggatattcccctgacctcttggtgggactcgtgaaggtagtgccgggtttactcagcccacagctctcaactcctcgcaggagggagtgcctgagccagtgaggcgtgaacaggagtacaccagcgtttgagccatctggctgctctggtgccggcaggggtgaactgcactcagttggaccccctgcatccacccctcatggaaggggtcactcaggtgagcaggtacaggagcaggcagaatctttgggtgctggcaggagttaactatgtgccagccctgcagcagcatctgtgggggtgcccgcaaacccggtagccccagagggagtgttacagtgctctttagctcggccgtccatggatggtggaagggttaacaactcagtggaccctctgccttttcatgtgaggtggctgccttccaacagcgagggcaaagggtcagtatgacagtctttcgcttggtggtatccaagctcttgtccaatgtcctaggagaaatgaggtctcatgaatgaattgaaggatggtaaatgcggatgattttcttgccaatggaaagggacctgaaaaggagatagtgtgggaagctaatcttcccctgaagtccggccacctctggccaatttcttctccgaagttatgccatcaagctctccctctgaagtcaagccacttctctccaatgtcatccaaccacagtctcctacacccacctgcttctcttctctatgatggctgagcttggggtttttatgggcacaggatggtgggtacatcaggccatggattttttttttggaaaagggaacattcaaacaggaaaacagggatgtaagttctcactttgggccacagcttcatatttttcggattgagggtgggccctcgccagagacctgccctcatcttcccagaatctccctgcctcctgtccctatcactacaatcaagctcagcttatttaaagttataatccgtagatgtgtaaaatctggaccatgcttttcccctaatattacaatatgcatttttaaatagtttataagactctcaaccaaagtaacctaaggtacctgcaacactaccatactaatgtgaacatgttggatacaaagaacacaatgttataagggtgtcaagtgctaaaatactaaatgtattgagtacttagtttgcatgatatatctattacattaagatatagtattggactctgaaaaacacaaaagaatttcaggcatgaggattccctccattcaagggctaatagcctagttgaagaaacttgaacactgaatgcagacaaaatgacactaacgaagagcagcatataaaatacctacaaagttcaactcaggttaagaaaagggaaatatttttgtgtactagtttgcacatgatcgaatgcatcttggagtggtggaaaatgtgtttacaaatgggttcatatacttgatttaaaaaatccattgctaaatgtttagtttgccattttaatactttagatttatacctctataatcttattctgtccaaattcatgtataatctgtactggctgtctattctaaattaataaaaagtaaattattaaatatcatatttaaatatccatttcacagttttattgatttaactctcaactaggatcttctagtatctccaaatagcattttaaagaatacaattttggggaaaaatgtataaggttatgatctatttaaagaaaaacgagttatttgggccagcatccataatttctatgggaaaaatatctaattttgaacagagagactacatacttcatatgacttcaattattttacgttttttgatacttgatttatgtcttaaaatgtggtctattttagcttatttctacaaacattcagagataatgtgtctttgagtcctgtagaatgaagtgtttgacctaatcaattagtgtttgacctaatcaattaggtcaaatatattaatgtgttgttaaagcattctttatccttaataatttgtcatctacctatcccatcaattactgtgaaattatcattgaaatttaagaatataattgtgtatttatctatttcttctgtaatatctatcagttatcattttgcatctctgtcagtatggataaaaaattcaggacacttattgtactagatgaattgagttctctatcattatgaaatgatcttcatttttgtaacagaattggttctgaaatctactctacctgtatttttgctcttaaattgactacagctttctttttatttgtgttaatgcaatatatactgcattatagatacatacatatgtatatataaattctttctctatatctataattatctatctatctatctatctatctcagagagacagcgctatgtgttcatctttaaagcagttttttgataacatattttagggcttacttttttattcaatctgataaattttgtcttttaattggtataactaggtcatttaaatttagcatgattattaataggtttaagtctgtattgttatttgtttcctattaaaatatttttgttattgttttatacattttgtgcactctcatgaattacattttttgtattatattttatttcctttattggcttattttttcattaatatccgtttttcccattatttttccattttatgataatttattgatctagagtgtacattattacctacctcagtttaaattaatgtgacattctaccactttacaatgaatgtgagaacttaccgtagcattctttattttctcctctccaggctttgtgcaattatcatcacatatttgacttccacacattctacaaaccccatgttatattgttattactgttacaaacaggcaattatcctttaaaggcatttttataatgtgaaaaatctgacatatttacccatgtagtaaccatttctagtggtattttttttcctttgaatagatttatattactatctgctaacttgttttgcacaaaggaaattttaagcacttcttataagatggatttgctggttattaactatttcatatttataggtctaaaacgtcattgttccactttgtttttgaaagatatttttgctaatgataggacactagtaatacaggtttaggctttacctcccttttgatactttaaagccattggtctgcttttttcctctttcactgtttctgatgagaactctgctgtcatgcttatgttatatatctctacaaaatgtgtcttttttgttctgctgatgcttataagatttttatctttacactggttttgaggaattaaattattttcatatcatgaacagaagttatgtttataatttttgatgtactgcaatatggctaaataggacactcacttgctttgaagggaatttgccttttactgatcagaagaaacaaacattctctgcctcctcaaatcttagaagcattttacttatgatatttatgtgttaatcagtaacaatctagtctagctacagtttaatatgaaacattaggaacttggactgttaacacttttaggtgcaggaatatcatgtaattatttttaataagtaatcatttataataaattattttacatttacacaacagtgtaagttttctgtttacatttaatctttagctttgtgctccttaataatatatagttttaattccccaaatcaaccttttctatgatgaataatttgtaatcgtttattttttatttaactataacatttaatttcttggcatacttttaaatgaaatcaagattcaccaagaatttgttataggtatgtaatataggttagtacataaatacataaataagtagatagaaaagcctgggcaacatagtgataccttatctctacaaaaaataaagaaagttagccaggcatggtggcacgtacctatagtcctagctactcaggaggcacatgtgggaggatgacttgagccctggaggttgaggctgcagttagctgagattgtgccactgcactccagcctggctgatggaacaagactctgactcaaaaataaataaatagttgaaagtgagaggaatgggggaagaaaaaggaaataagaaatatctggataggtaaatagccaaatgaatctggcttacattgtctctgaatcaagcaaaggtttaatcatttatgttttgatatattttgacatgtaatattcagtagaattttggcttgaacctcattgttgtttagctaagtgcattcaccatggagattagtaagttcctaatgataatttaattttattcaccctggaagcaagatttttggcccagagaagaagtgattttctgtttttacccacgaaggccagttattttattcctttagttctttttagaaaataaagtgttcccagtgaagaaaagattactaaataaaataaaaaatggcataagaaacacaaagaatattaagatacttagaattaatattctgcatacctaagtcaaaaagttaattaaaactgccattttagtttgaaacagtaagccaatgcctgccaataaatcaaatgcttgctaaactggctttagttaataattatattaggaattcacgactacccagtttatgtatagaaaaaatgaaatgttgagaaaacagagatcaaaatgttattactacaaacttttgaatatgcaagactccacatcaagattaactctaatttctacctcaggattaggcatcactggctggaatttatttccttgacatgatttagaaagatgattcagtaaagtattaaatcattatctcctcttttaaaaaatcatgaataacctgggttaggttcaaagagtcaatttggtgagaattctaggattttgagtaatatttaaatttcaattcaaaatggattcaatacaaaaaagtatatacacaacagctttaagtaaatcaaaaattaaaatgatgaatttttgttgaaatatgtgttgaccagattattcactatcttcttgaatgaaatgaaatcttctcactgttgcctttaatttgtttttgttttaatgtatggaattgcaatcacaatgaaactgcatagcttgtttcctgcctacataaaatcttgtcacgactaaggctccatctctcgcttccagagtgttgctaatttatgctacttgtgtttcttaaaaattacatctgtgagctctgaaggaaaaaatccaggtcataaagctagtaattaggacttacaaaaacttaaaaactttagctaattggatatatgatatcactggaattaaaattaatttgaaattctaaaactgttaaatctaagtattttcaaaatagcaatctatgtggaatgtgcatactccaagcaaatctcttaagacaaattttcttgttattgcattgtcccactaactaaaacacactaaatgagtaagccgttcatgtgttttccaaaattctatgttacttttaatggaatatttcatgtatccaaaaaggaatgacaataatactcataaatttgaaacccaaatgtcatccccattaaaaatagcccatatagattagtaaagcctcttacacaaatctctatgattccatttccctcctctttatcttgtgggtaaccattattctatgtgtgaaggttgttattcttatatatattgctcccaacaaacgcttatctaagctctagggagattgtagtaaataatactgtaaacattttcatgcacatatgttatgtcagattgtgagaagtactataaaaaaataaagaaagcaagagtaattgggataggcagagctatcatttaaacacacacacacacacacacacacacacacaccacaagtctctccaattatatgctccttcaatgacttcattgatcagttaatatttcagcaggaattggaagaaagtaaaggacaaggcatatggatattttgcaaaacagaattacagataaatgttcaaagatctaaatcagaacaatctgtgtttgaaaaatgaggctggtgtggctgagatatgaagtcatagataaattggggtagacaatatagaaatgatgttttaatagattttgattttattctgagtgctatggaaggcattgcagggttctgagtggaggattgatattttccaattcacacttcaagaaaccactttggtagctgttgaaaatgggttattggaaggcaaggatgaaaagttggagacctgtttggagactattacaaatatccaggtaagagaacaatagtgacttgggaccaagtggtagggataaaaattagattgattctgggtataatatgaagagacatttcagagttttttctggtacattagatatctgatataaaacataccattttgcttatacactgctggcagaaatgtaaattagtttcatcattgtgtaaagccatgtggcgattacttgaagaacttaaaacagaagtagctggaaatacaggtgcctgccacaacgcccggctaatatatatatatatatatattttatttttagtagagatggcgtttaaccgtgttagccaggatgctctcgatctcctgacctcgtgatccgcccgcctcggcctcccaaagcgctgggattacaggcgtgagaagtagctgggaggctgaggcgggagaatggcctgaaccctggaggtagagtttgcagtgagccaagatcgcgccactgcactccagcctgagtgacagagcaagactccgtctcaaaaaaacaaaacaaaacaaaacaaaacaaaacaaaaacagaagtagcattcgacccagcaatttcattattctctatatacccaaatgaatataagttggtctaccataaagacacatgcatacatatattcattgcagtactattcacaatagcaaaatcaaggaatcaacctaaatgcccattaatggtagatttgataaagaaaaggtggtatgtataccccattgaatactacacaatcgtaataaagaagaagaacatgtcctttgcaggcaacatggatggagctggaggccataaccaaagactgcatgttttcactcgtaagtggtagctaaacattgaatacacatggacacaaagaaagtaacaacagcgaccatggcccacttaagggcagagcatgagaggagggagagcatcaaaaaactacctattgggtactatgcttattacctgggtgacaaaataatctgaacaccaaatcccgatgacatgcaatttagctatataacaaaccagcccatatatccctgaacctaaaataaaagttaaaaaataaaaataaataactaaaagagacattttctgttttgtgtaatcttttgattaacaaacatttttaattttaatataatccaatgtatcattcatttttatgatttataatttttatatcctcttcttccccaataacataattgcatttccctaaacgttcttgtaaatatttatattattatttctatgatttcaattcacttgggatgtatcttcgtgcctggtgtaaggcagggatacttgtttattttgctcatatgtacaacccctgtcactgcactgtttattgatcaatccttttttctcctgttgagaagtagtgccctatctgttgtatatgaagtcctcatatatgtgtggtttatttctgggctccataatcttttctaatgctctttttctatatttaacatattcaaagcattatttactgaagtttgataaatcataacataaggaaaacaaattctccgctttttcttttcttttctttttttttttttttttttttgagatggtgtctctctctgtcgcccaggctggagtgcagtggcgccctctaggctcactgcaagctccgcctcccgggttcacgccattctcctgcctcagcctccctacaggcgcctgccgccacgcccagctaatttttttttgtatttttagtagagacggggtttcactggtctcgatctcctgacctcgtgatccgccctccttggcctcccaaagtgctgggattacaggcgtgagccaccacgcccggccaattctccgctttttcaaacgctattgcttttgttcttggctaattatatctccatatttatattgaaatgagtttcataatttcccaattattattggtatggttttttattaaaatgtcaaattatgggttaaaatagagatgtttaacatattgatgtcagatttacttatccacagacacaaaatatctagctcttcattaacatgtttcaaaagcatatttaattattcaattacaaagtcatgacattaattttttttttttgagacagagtcttgctctgttgcccaggctggagtgcagtggcatgatcttggctcactgcaacctctgcctcccgagttcaagtgattctcctgcctcagcctcccaagtagctgggattacaggtgcccaccaccacacccggctaatttttgtatttttagtagagacagggtttcaccatattggccaggctggtcttgaactccagaccttgtgatccaccgaccttggcctcccagagagctaggttacaggcgtgagccaccacacccagcctgatgttataatatttaaactcaaaacttctaatagtcaaaaatctaattttaagatttacttattttatgaaaacatgaatagtcatgtacttgaagaatataaatgcttacagttggtaaattataatgagggaaagattggctgaggcaaagttttagtcagggaaagaagatggaaatgtgtgatttaagaaatcaaaaggaatttaagtgaactaaatcagaaaaaaatagtaagtaaagaataatgcttttgtggggtaaagaaaaataaggtgcaaggctttcataaatatagatactacatagatatatacctatttggtataagcttaaaggtacgaaggtattgatacaaacaacccacactggttacctggagggtgtggcattacaagataattggggaagaagagaatattaactattatttttaatataccacagtatttttacctcgcatttttgataatgtattgttacttttaaaattagcaaatagttaattaaataatttaaaaacaaattagtgagaacatttggtagcagctggccatcagctaacaactctgctgttaacatttgtaataataaccaagatttcatctaacttcctcttccttttttccctaatccacaaaacacagatcagggaaactgagattcattgtttaactcccatcctcctgctctgcaaagtattgcctcaattaaatttttaaaaattaagagtggaaaatataaaagatgggaaaaaaagtggaaaaccagggtaacttacaatgagacagggagaaacagagaaaaaatatgagaaatgaaaacaaaatttatagaacttgggatttataactgtcgtaaaaagccatagatagtacattggcagagaagttacatatatttacaataataaagacacattaacagaatttttaattctgtaaaataattttgcttaattacttgtaatagagaaatgattttcccacatgatataagagttgagtgcatggcaaaagtagtttccatgtcaacttttattaatcaagttatatccaatgtgttgatactctaaaataacattccatagtcacaaataaaagttcgtcattttttaattttgtttacttacttatatatgtgtttattttattcacagtagtagtatctgatctctttaaccctatgctgaaaattcttaattatggaaattaattaaagtgattaacatatatccaacctagttaaggagtttgatattactgttgtaaagggaggactgagccttgcaaatcaaacataaatactttatttagaaggccctggatttccaattccttaagattgctttagtgaaatattaaaacataaattagaaaagataaatacaagaataaacatacagaaacatatcagtgcctttaaaattctgagacaaaattgttttgattaaaacatttaaataatttttcagttttaatgaaacaggaatttcaatgctgtattataaacattttaaacattatgacatataagttatttatatcttgtataaatactgtttaataggatgtaggtttatttttggcttttgttttgtttaattttgttttctcttgggctttagtttgtttccagagaattccttactgattatttaggaaaatggaatgaaattatcctaggagatcctaactaccatcgagaagttcaagttcagttcacaaagactccatcctattgagttataagtttatacaagaaaataaatctaccgatattaattgtctctgcaaatttgcgtaaagagaatgtatttattaagcacttaatgaaagtgcaatgtatttaaaaactgaaatttcttttcagttaggtatattttgtaattggtaactatgaagataggtggttataagtgggagcatttactgtgcttgaaaaattccgttgtatcattcagaaaaaaataattttgccaccattacaacaaaacttcataaagggttatcttctgttaaaaatgttctcgttgatttctgtcacatcttaatttctgaattctgtagatattttacacatccaattttacctcagaagagtcattttgttcccatatttgtgggtgatttccacatgtgattttgtcctagtcttggtttcacataatataaaagcgatgactataatgatggtcatacaatttgaatctctccatcttccttttagaagctacacacatcaacaggaaaatcaaataccatcactcttatccagatttacagaggaagcaggagacaaaaggatctcaatttaattggagaaataaataagagctgctgagtcagccccttagcagagaatcaggcagggcatgcacagataaagagtttgggccctttaaagtggataagctctgaaaatatacccacagcttacacccagaaggttattctccacacctaagtgaaacattttaaagtgaatttgagttctggaggttcagaagaatagttacaaggaagctaaaaagaaagggcttggaaagtgtggaggttcaagctcacagttttggaaaagaggcaccttggatggtgatttctggttttgtaaagaaggctaataaagaaaaaatggccctatttatacaagtactaaaggtttagaagacagacagaaagcactattcattgaagatatgactcttctctctagaaacaatagaaatagtaaaagaaccaaaaaaatcaaactaaatatgccatctaacccttctcccatagggtttctaactgtagctgatctagaaaaacaacacaaatgtgtgtaaagtgagggtgtggagaagacatcagaatcaagcatccttaaaaagtaccataaagaacagaagataaatggaccaaattgtctttcttattgcttttcttttttttttttttttttttttcagacggagttttgctcttgtttcccaggcgggagtgcaatggcgtgatctcggctcaccgcaacctctgcctcccgggttcaagcagttctcctgcctcagcctcccgggtacctagattacaggcatgtgccaccacgccggctaattttgtatttttagtagacacggggtttctccatgttggtcaggctggtctcaaactaccgacctcaggtgatcctcctacctcagcctcccaaagtgctgggagtacaggcatgagcccctgcgcctggcctctctttcttatttctaagtgactatatttaagaaaaaaacaaaacaaaacaaaaaagaacatgttatacacacacacacacacacacacaaaatacctacatgctcattaaatactattttcctgtgccatctaagcatatgttacagctgttaacactattctatatatcatataaaatatcttttcccctggattataaaggattgaaaataacatttattaaatatgaaagtttcaatcagtaggaaataagttaaagtagaaacaacagccagctcagtatctacattgttttatagctttattaaataagaatctgcttattagtctgaagtataatggctaaagtaatatatttatactctcatcctattaatcacaactccttaagaaaattgccaccaatagttttttcctctacaaataagccaacaataaaaagaggtaaaatatagatgataaaatacaggaaaaatgtagaagagatgcctgagcacaaatagaaacaattaagaatgaggaatattgagtatagaaagagaaacggaaaagaaatagaaataaaatcacacattaaaaatgatcacaaaacaggaaaatgacatatattgaagactggaaatagaacaaaattaatatttttgttctattaaagaaatccttcctgaaatggggtcagggactttgaatctacgtaattcaaggtttcagaacttgccagggaaaaataataatactaattattattattaattttattatatttatttattttttttgagacagagtctcccactgtcacccaggctggagtgcagtggcacgatctcggctcactacaagctccgcctcccgggttcacatcattctcccacctctgcctcccgagtaactaggactacaggcgcccaccaccacgcttggctaatttttgtttttgtatttttagtagagatagggtttcactgtattagccaagatggtctcgatctcctgacctcgtgatccacctgcctcagcctctcaaattattttttccagtcaaagtataaggacctccaagtaaaacagaccaagtcacatacacaggaaagaaaatgagacatgagtcagaattctggatggcagcacacagggtatgacagcagtgaagtaacaagaagaaatccatgatttctttcactggacaagtatatatccacctaatctgaccttcaagtataaactctacagaaataaagttccaaatatgccacaatagaattaacattgtgcgcaagagccactattaccagagaacctaatagagaatgaccttcattccagaaaatatgagtagaaaaaaaatgagcaaaaaattaatgtagctgaagactttagattaaaataaaagttgggggggagggataagagtaaatatgtatcaggttggtgcaaaagttattgcagtttatggcatttttttttttaaatgatgaaaaccgcaattacttttgcaccaacttaatatggtgacaaaatagaaacatataactaaaatatggacaaagaagggagaggagacaaacagaaatcactcactgattgcttggtaggtaataggtggaagtttaagatataattcaaagctgacaaacaggatagcagaattgaaataagggaaaggtaataaggctactataaaaagttttagtgtggaggcaaacactagaatgaaacagaatttcccaaagaaaaaagtaaaataaaactctaaaatttaagattgccatgaaactgaaaacacaataaataattcagtgtatatataatacaaagtgtatagaagaactgagacaagaggtccgttgtactgatgaatggaaataagcttagctcacttattaaaaacaaaatgtgttgttattggcatatagacgaaaacttgacgctgttatataaaagacacattttacttgtaattggaatggataaaaataaatggtcaatatcatgtaagacaaatgtgaacaaaaaataaactgagggtggtgatagggatatctgacaagttataatttacatcaaataataaaatggaacaaagtacgacaccaaacaacacagctgtgaggaatactcttcataatgtcaaacaattaaaataaataaaaggagaacagaaatgcactagttatatgcaaccttgacacatttctcttagtgcaaaacaaatcatgtggacgagaaatgcataagaatatagaaaagccaactgatcaaattaatgaggtagttattgtggatttttagtggatatataactaacaattcagaaaagtggcaaagtaaacaaaatgagagaaagacataagcaaaatggtatgttttaatagagaaaaacactgaggccaataaatatgctgcttctttgaaaaatatctaaattcagaaaagaagtcagaaatgtacacacacacccaaactaataaggggaaataaataattggtactgtaaaaattgatcatatgattgggtctttctttacataactaactgtaacagagtcaagaggccaggagtaaaaagcactccgggcatgtatcagtccgttttcacactgctgataaagacatacctgagactgggtaatttataaagaaaaagtggtttaatggactcacagtaccaagcagctggggaagcctcacagccatggcggaagacaaaaggcacatctcacaaggttccagacaagagagaatgaggaccaagcaaaaggggtttccccatataaaaccattagatctgatgagacttattggctaccatgagaacagtatagggcaactgccccccatgattcaattatttcccactgggtccctccacacaacatatgggaattacaggatccacaattcaagatgagatttgggtggggacacagccaaaccatatcagggcataaaacattactctaagaatgtaattctctacaagtctaatttctgaaactgcctgttcttacctaaaagcagttttatctaatagctactgaaacaaccagctctgactgtaagattagttttacccacctctgtaaccaatcagaacttgcctattaactttctttcaaaacaataagtagcatttctcctttttataaaatctccaaacttgtctttgttctttggacatactgaagaccacctagcctttgtgtttgttctgaattgcaaattttcatttcccaaataaaatattttaaattgagagattgtctgttacagacactggaaatttaaaacaacaaatttgaaagaccaaaagaaaggaaggaaggaaaccaattagtcactttttctaagaaaatatatttcataaaaactgactgactgcagcagagacaggcttaatttgcaattttctaagaagtagtgggatttatctaagacctctttcctacccacactaagacacagtctcatatattttcaaaggggaatcctaccacatcttcagaaacaagataatcctaacaacattttaagaagcacagaaaaatgaaaataacaatgatacctgtgatagagtgaatggtggctcaaaaaatatatgacaatctcctaactctgatcttattgatcttgtttggaaaaaggacctttgcagatgtaattaagttaaggatcttgagattcagagattactgtagaatatccaggtgtgccttacatggcatcacaagtgttcttataagaagaggctgagagaagttgggcacacacagagagcacaaggctatgtgaagatggaacacaaagagatgcggccacatgtcaaggaatgctgacagcccccagcaggtggaagaggcaaggaatggattatctgtagagcaactaaagggcatgtggctctgctgatggctgagttttggcattctggccccaaaaatctgtgagaactagtaagtaactattaaattaccaagtttgtagtcatttgttagcagcacaggaaactaataggtacctaaccctgcgaaaagtggaaagaaaagagaactgcagagcaatataaatgcaaaaatctgaagcaatatgttaaaaagaacaatatactggcagatttttaagaaatgatgatggatacttattctaggattgcatgcaaacctcaatattagtaaatccattaattcagcgatgagaattagaagaaaagtaatatgcagtcatgtgttccttttttttttaattaccaaaaaggcaatgtttatttctggttttcacaaacttaataaaatagaaatagatgttttcttaatttgattatatatatatatattatatatatattatatatatatatatatatgtaagctggggcttcagtaacttaccatgaagtctggactgaatttatctgtgacaaattaattattatcatctttattatctatgggtggggatagcctttgtagctatgactcagaatcaagtttctgaaacttttaattaattaagccaaaaaaaagagatcctgtaaataaatattaatctatttatttatgtagatgcaaaactgcaaatgttaatgataaactagattgtgaatgcacggatgctcattgttctattctttctacttttacctatgttacccatttttttccagattaaaaaagaggtatacttcaatgagatctcctttggtgcccaccaaaagcaagtttagtgataattgtgtatcacgttttgtcccaattttaaaaaggagaagaatggaacattccagatcaagaggaaaaagatatagatattatagtacaaatctaggataaatagagaatttaacttttagaattcactcgttatcttggtagtcataaatgaaaagtgctagtttaatggggaaaggattccctatttcataaatggtattgggaaaactggctagccatatgcagaaaactgaaactggaccccttccttacaccttatacaaaaattaactcaagatggattaaagatttaaacataagacctaaaaccataaaaccctagaagaaaacctaggcaataccattcaagacataggcatgagcaaagacttcatgactaaagcaagaaaagcatttgcaacaaaagccaaaattgacaaacgggatttaattaaactaagagcttctagagagcaaaagaaactatcatcagtgtgaacaggcaacgtacagaatgggagaaaatttttgaaatctatcaaagggctaatatccagaatctacaaggaacttaaacaaatttacaagaaaaaaaaccaaacagcctcatcaaaaagtgggcaaaggttatgaacagacacttctcaaaagaagacattattgcggccaaaaaccatatgaaataaaagctcatcatcactggtcattagagaaatgcaaatcaaaaccacagcaagataccatcttgctccatttagaatggtgatcattaaaaagtcagggaacaaaagatgctggagagaatgtggagaaataggaaccattttacactgttggtgggagtgtaaataagttcaaccatcgttgaagacagtgtggtgattcctcaaggatctagaactagaaataccatttgacccagcaattccattactggttatatacccaaaggattataaatcattctactataaagacacatgcacatgtatgtttattgcagtgctattcacaacagcaaagacttgggaccaaccaaaatgcccatcaatgtcaggctggataaagaaaatgtggcacacataaaccatggaatactatgcagccataaaaaagaatgagttcatgtccttcgaagggaaatgcatgaagctggaaaccatcattctctgcaaactaacacaggaacaaaatatcaaacaccatatgtcctcactcataagtgggagttgaacaatgagaacatatgggcacagggagaggaacatcacacaccggggcctatcggggggtggggggtaaggggagggttagcattaggagaaatacctaatgtagatgatgggtggatgggtgcagcaaaccaccatggcacgtgtatacctatgtaacaaacctgcacattctgcacatgtaccccagaaagtaaagtgtaattaaaaaaaaaaaagaaaacaagagtgctagttttatttttttattttaaagtttctatttttataagcagacacacaaatacacatgtacatctttatgtctcactattaataaaagctgctcatctcctaaaaattactaataattgggatggcctgttaatttaaagttgctatatttaggaaattggaaaataaatcaggaagtgaacattcctgatatgatacaaatatcatagtaaaagaaaaataaaaacatttattgttaattgattattaattcaaatgaaataatagagatataaaacattgtctttaggttaggtaataaagtaaaacaaagaaattgccaaagtttattagaaattagaatctcttgccaaaacagcaaggaagaagaaatctaaatccagctctgctgtagtaacgaaagtgaaagtattgtcaagtattctcatataatttccatttcccatttgaagccaccttaaacattaaaagcactattctatcaatttgattaaaattgacaaattgttgaatcataaattagccacaaatatatttgctagcactgaaaaacattcagaactacgctaaatgacatttaaacacatattcatctcgtgacagatgaaaagggaaaataggaactaagctgaagatgatgaatatatttaatatttcatactgattctatagattcaaatgcatagaattaaacggagaaagaagggaggtgaaggaaaaaggattgactggaaaattaaatatgaatgaaactcccaaaaaaagaaagggaacattaaagtcccaatcatgcctattgggatgtctaaatttgaaattatacaaaaattgtgaatatagacatgtcagtgtcaatgtcctgctttctctctgctttttctttcttcagtgttcacctaatgaggcagaaacgtctgtttaagttcctagactggtgtttgaacaccttggttttcctgctttttttttctgcatccatggtaaataatctaaattacagtgaataaaagggatgaaaactcccaaccagggaaaaataccattcaactcctctgttaccagaaaatgaagtgtgaaccaggtctcagttcaaccttgtttgtattctgacttctgagacacgggacaagctactcaacctttctgagcctcagtttcatctttaaaagaaatattaatagtagtaattatatctgaaagcccatactacataaaacaatgagacactgaaaaatacatatgctacaaaccatctgaaatcaattgtattctttttgtggtttgctttatatactagtaagagttgtttgggattccagttaatgtggtaagaaatgaaaatacacaatttatctcacttcctgtcaagctctattaaaaagaataaatgttaaaaacaccaaaaaaaatccaagagcttcacaaatgtaagcatcagatgtaggtaggtgatgaaaacaggaggatcacgtgcaactttgcatttcaaacttcttggtcctttgattcatttcatacagttgtatcccactacccctcctgtaccttaagaaaagactcaaataaagttactctttggaaaaactgaatcagagaagcctttcacttgagaaacaccagacacagatgagagtggtaagtggggacatactagaaacaagaggtttaccagaaatatttgtattaaacagcagaaaggcacacattgcttctgttcagtacctagaatgctggtagtcaggcctatgcctgaggccatccagtttgcaaccattcctatatggggagtttctaaataactttttcacttttcagtcttaaaaatgaatgaactaataaataacaccatgtagttgagaagcacattgacatacacacactcacacgaacacacacacagaaacacaccagtaggaacaaacaaaataaagaaacctagaaaaaaaatcatgtttatgagcaaagcagtttctcaaatatatagagagatagatatgtgtatatatatatatataaaacattctcagagaaacaaaaagtttatttaataagataaaaataagttctaaaaagaaaacattcagagaatgagggttctagagaaatgtttttaaaatgatagaagaaaatctatgtgaaaggttagaagagaaagtcaaagtgaatctcccaaactgtggtatcataaaaacgggaagataaatatgatcaaagagggaatgtgagatccaatgaaaaagagttctagcatgtggtggattgcattattggtctcaattgttgagcctcatcaacatgcgcatacttgcgatggtctcatcatgggtggaatatgtttcttttctaatgttacataaatgaaagcaaaagtgtgctaatattaagcctgtgtcttaagaggctttattgtttccagttgccctattgtacatctgccattgccatgtgaagaacatacctagctaatttactactctgagagacatatatggtgctgagtctctcgaactgactcacacagacctgtagtgtgaagcagcaccactcagctaagacttgtgaagcaatcaaaccacagtaagaagcagaaaagtgagaaaataaatgagcattgtaaaggtctacattctggggtagtttgtatcacagcgactgctaacagaaatacagagagacagataaaacagaagtcataaaatggtcaaagaaataatttcaaaaactgaagagaatgtaatgttgcaagttcaaaggcataaagaagtgtcaaacacaatgaataataataatgattataataacaatacaaatcaagtaacaattatgatattaaacaacaaaatggatatgaaataactccatactttctggaggcattggtaagtgtagtaaacgttttcatataaaccataaagtgagaaatcattaagtattgttaatagcaacaagtatctatgagacaactgtagagaaatgatttaaaaactctatggggaaattattttcaactgagaattctatatccaggcaatttatactcaagggtaagagttgaataaaggcatgatagaaatgtaatatcatagaacgtttaagtcccagggatgcttccttaataagccctttgaggaaatcattcaacaaaaaagagaaataaaaaagtattgtttagactatgctgacatgagatcctacgtctccagaaatgcttcaggcttaatgagcaatagaatcaaataggcggaaacaagaaaatggtatcagcaaaacaaaatataaatgattgtaaagtgtgggaacaaaatagattccctgcaaactaaaccgaagaaaaaataatgcaatatttttctaacttcaggacttaaaaaatagttgtgaaataattttttaaaatagtcattaaaaccatagaattaagattagaattatgttcacataattaaaatattataaatttacaacttgttacattagagcatcagaggattggagtaagggaaagtgtgttgggagggtttttatagtggagtataaagtgtggagtataagtgtaaggagtctaaatccttgtttttcacagctgaaagtctgcaaataatatcaaccattgaaaaatcaagagtcacacacacagtagcttccaaggaagagctaggataaaactggttaacactgggttgtgtgaataatttgggggagaaagagacagagggttgttaatctgtttcattatgaattttatggtactattcaacatctaaatctggatacatattacttgataaaattgatcttaaagaaaaaacaacagtttaaaataattaagaaactaaaatacaaagtgaaaaaggagacagggggatcgtaattccataggcatctaatgacctggctaagctagttctaaccttctcagttgtcagaaatcaaacatggaactgcatttttcacaagactaagcgcaaaaacttacagagtaggttagattttttttacactaacatcactctgtaataaatatctcatctgtgaaaaataaatcaagattcacctatattttcaaagtacaattctttaaaaatatttgttcttccatatcctgggaaaatgtgtgttacaggatgagtttatacctgcaaaatcatttccaatttataaaaatatggggcccgtgaataattactgcagcagacaaaaacacaatttttttcagtaggaaacttgagaatttttgattaagtaaacatttcaaagtgtagaacttcttactagttattgcagacatctgaatggtgaaagggcaatgattaactacggaaatgtatttatatcctcagtttctgtctgatgcaaatctctcaaaatatattaataatcatgattactaatgtctaaaatattttcctgaaggtcccacaatagttggaaaagtaatttataagaaagccaatatactcagacctctttgttgtgtacttaggagaacaaacttcaaaattgaaaacaataaattcagttgctgatacatttcttaatttttcattctactgagattaagaagccaccctattcaggaataagtaagaaagaattaattgttaattaaacagaattttcaattcttttatcaggtttgattctatcatcttaagtagacaatcataagctaaatctcatactttatatttaatcccaatgtgtgctaatgaatatgcttaatataatatttgtaatcaaatttatagatagatctaggcattgattgaggtaattattctcattaaaggttgcctttaaattgagtaaaaataattctaaatatttttaagtatagagacaatctcaaaaatgtcaccaatcacctcattctcattgtaaaacctcattttacatccaaagcttggcttgctgcctattctgtcaatgttccagtacagaatggtaccactacctgctattacaggactttaggattctttttactattttgtacaatgttggttccatcagaaacaaatgcggatttgcaagtaccccagaaacctaagctggacagaatttaacataacaaatcataggagactcatgacaacaggcaataaaatacaaagagtacacctacaatgcagtgtctatccatatgtattggagttattagaaagattgccctgtctaaaatgagaggtcaaaatatggtggtgaggaagatatatgcaaaataacaggtgaatacaatttttaaagaactaaaactaaaaagggacatgaagaaaagatagaatactttagttaaaacgtcctatacaaaacgaaatatatgataggaataataaaattgtatagatttttatattaatcttaaagacctgagatacctattaggactatcactacaaattttaattatcttctttgatggcaacatttcatttgtctttcaggcttctcattttaagaaaaggtgaatacgagaacccttgggtcatagattctgtttttttcactaattttttttctgaggacagtaagtgttcagttgtgccagaagaacattacagtgttcgttttcacttccaacaccctcaaaatacattaatgaggacttcataacatcaccaggtaagccaatcattttgagtgtaggtatttctgaggactctgggaacatataaacaaataaaataaaaaagacacgcattaaaacatggcttaaagcattttttttattttaacctttacttatttagaaaatccttctgaggaactaaggggatatgcaatagtgttctataatatcaagctacatgcataatgtaggtaatgacttctaatgtaatctggaaaatccagttaggctgccagaagaggaatgaaacctgagacaagctaagagtgaatggacagctcagctcagtgcaatcataacatataattatttcccaggctcgtttatacatgagaaaagtttatcaaggtctcaaagagtctgaaggaataaaaaaaatggtcagtgatgagaggcactgtcactttggataacagattacactcactcttaggagatggcttaagacaacaagtagagcaaagttagaaataggctacaggcatctgctgagtttgacagccctgaaatcttcaggaacgcacctaatagcctaataccagtgtagttgagccctctccggcatttacctacagagttaaatgatcagaactcttttggtactaaaggcaaattatcaaagacatcaaatgttgtacaatttttttttactggtacattgttcaaattcattgcaattttcagtagttctattgtatagtcttgatatggtcacttaaaagaagtacacactttctgctaccaggttttcttttcaagcactggcactttcctagttgtttgataaggtatatgtgttactgtagaatctatttttgtcttgtgtgagctcacatcaatgctattgacactaaaaaagagactggttccgattatccagctaagcaatctcccatatcacctatcacctctaatcctctgacacacaaatgttcttccaggtctctcaaatatgaataaaacatgtgaaaattatattttaagaattagatacatggaagaaggggtaagaactatatatatatatatatatatatatatatagtatgatcctgacataccatataagctaactctaacatttacatagagaattgcaaaggagatttcagagagctacaatggcatgataggccaggaagttctcaggaatgagcacaactcgggtctaaatatgggttttctgaacctagagcccatgctcttttcattatgccacactgccctggcctatgtgtgtcgcattccctcttcctctaaaataaaacagtttggggccaagcgtggtggctcacacctgtaatcccagcactttgggaggccaaggtgggtggatcacgaggtcaggagatcgaggccatcctggctaacacagtgaaaccccatctctactaagaatacaaaaaattagccaggtgtggtggcatgagcctgtagtccaagctactcgggaacctgaggcaggagaatcccttgaacctgggaggtggaggttgcagtgagccgagatcgcaccactgcactccagcctgggagacagagtaagactccgtctcaaaaaaaaataaaaaaataaaaaacaaaacagtttgagttcatactgtggcacattaaaatttaaacaaatattgtaaaaaagaattcattcagaattcattttaagtagtaaatattgtaaaaatgaattcattcagaagctcatgaaacatgtgtgatactaccaaagatccaaaattaaatatacacagcttggttcaggatgattttcacggagaaaacctatattatttttagctccgattctgagttgacatctatattaagtgaaaagccaaatacaaagtgtgtgcatgtacacatctatctattacctatttatctaactatgtttaatgattatctgattgtttctaaacacttgaaattacacagctttagctatatctctcaagataggtctctgttctctattttgaaagaaggcaagatatcacaacatattccaggatatcgaaaaatgcagttatatctgaatagttataccaattgtgaataaatgtattttaagtattgatatgactaaatagtttattagtgtcttaaaaatgttgtatattagaaataaagagatatttttgtctttccatttttgcatacccttttattagacagaataatactctgattaagacagttatattcaaggatatccttgaatgagggtaagtttgaaaaatgattacatacctattttaagtacctttgaaactgcattttatgagtgcctcttaaaaccaaagacgagtgtaaatgccattgtgttaagttgtctctgaagtaaacttaattatccacatgtttggcctgcacgttaccttgacccatagccagaaactaactcagggaaacttcagagataataggaccctagagggcagatacaggccaaggttagagtacagtatttgtcccatcctgaattcacctaggaaggtttgctgtataatgcttatgttccaattttgttacaggaatctagattctggtttcctttcttatcctaacactaagcccacaatagaaatagtgaataattcattctagcattcagaaaataatcaaaatgcatttttcttatcaatatattttgttcttttatggtgtatactccagaatctgaaatgctgcatttaatgttttcttagtaaacctctttgattttgagacaaaaatactgaactaaacaaccaacaaaccaacaaaccccccagaaacaaatttccactggcaacatttcaacagtattaatcatattaataggcacaaaaaaactagtgttgttgggtgatgactaacctagctactgaaatataagtcaaaaacattcagaataaaggatgtcagacaataaatcttgatatcctagtaataccttcaaagagtatatactatttcttaaatattaaatgcagagtaggatttacctagaagaggccttggaatacagaacagtaaaggtagagaataagcaagggctttaagaatataaagcactatctctgcatttgttgaatttatattttaattttaaaaacatataaatacaaataaactaaatacctctacatgtattcattgtcatatctaaaagtaagaactagtctaaatctcagagtcatttgagggttaagcaagctgagacattattccctatgaagcatttagccctgtgctttcagtctgcttttccagtctctgcatgtgtcaagctgaatgttgggacatcacatgtgaaaatacaagatcatcagcaagaggataggtggattagatgccctcccacatgataacattttctgatttgaaatacagacaataaaatattgttttcttactgcagcggatctgacatagcacctgtacatgcatgtttaggttttgtaatagaaatatgacagaaaagatgctgagtaggaagctatgaaaaatactcaaaagccaacctctttatggtaacctcctagcttgtttaaattaccatgcctacctcttctccagccttgttcattttctcagccacttccttttcctgaactttgattctgatttgatgcatgcatatactgaaaaaagtttgccaccagtttgggggtttcggggggtcaactagattctatgtttacttctcagtcccatttccctggcttcaactacaattcctctagatgataatgctggatactgaccctgactatagggccctttccacaagtgactgcaaacactctcccaattccaattccaagccaaccttcatgctctcctacctctataccttaggtagtgcatccaccaggcttcttcttgcattaaaataccattctttatatcttgaaataaaagactatccctcgaggatatctcatttagcttctgctatatctggagaatctaagagtaccaaattatgaatatttgtcattttcaccccttcacatcagaataaaatcccatatacaataaaaaggaaaaaaatgttttttacttttatgtaattataaaacaccagagaagagaaatttttgtcttattctataaaataattcaaagaattttaaagaaatgattccgttgaccagaccataacatagaaagatattatggatagttatatttataagaatgtgtctcattcaatatttaaaacaaatctgcacattattattctgataatctaatactaaaagcttcatttatgatactatgtgccatttaaaggaacttttcagaatacatgcaaagtaatttagcttataaattaagaattgcttagcaaagttgtttttttctttttttattaacagtttaaactgctggatcagcccttaaatacaaagtaagttcaataatatataatttccccccaatttaaaggggattacagtattgaaactgagaaaaacaaaactataaaaaaaatcgaattgtaatatcctatgtaattgcctttttgagttgttagtaatatttctatcttagaagtttagctagataggccgggtgctgtggctcacgcctgtaatttcagcactttgggaggctgaggtgggcggatcatgagatcaggagatcgagatcatcctggctaacacagtgaaaccccgtctctactaaaaatgcaaaaaaaaaaaaaattagccggatgtggtggcgggtgcctgtagtcccagctacccaggaggctgaggcaggagaacggtatgaacccaggaggcggagcttgcagtgagccgagattgcaccactgcactccagcctgggcaacagagactctgtctcaaaaaaaaaaaaaaaaaaaaatttagctagataatcttttatattctattggcaaataaaatataaatgatactgaaacacttgtcaagcctcttaaagttttgcttttcctgagttttattacgaaattaatagagtatatataaataaatatacatatatacacacaaacacacatatttatacacatgtatacaatgtatatatgcatacatatcttcatcttatgctttatgtaagtgcttacaaatagtacctagatattgctctgtgccctcagttaatgttgtgtgttgcgtggtatattatagtaaaagtacaaatggtctttgaataagaaaatctgggttcaaacccagtaggccgttttctgcctttacctaagcacaaactaatatgctttcaatactcatctgtaaaatgaggatagtaactccaacccagcaaatagactacacccaaatataactgcgtcttgtggaagcatgcagtcatcatgaattgtatattattatttatagttcactaactacaatgtaaaacatctctggaagataaaatattcttctgtgtgttcacactatatttatccttaagtttttttcaagattacaattcagatcatgttataccaagcaaattctagcattcagatccttaatatgacactaaaaaacagctggaagttaccatatagtatcaacaattaccatttgtgaaaaccatagcacaattctaatatttaaaaatcattatcagaactatcatacaactttagacatttcaatactgtactgtttcttcgttgctgtgatagattattaattgaaaaaaaaggtgaataagtatttttgcttaccttctattcaacataagaataacatactctaattcactgagcatacaaattagtatagctctttttgaggacaatttgcctgtataaaaaatgtaattatttattaatgacctcctcaatttcaaattaatctattgatatgtttatagacaaggcaccccacaagaaatgataacatataatttaccatcagtagaggacttgttttaagaagtcttaagatatttgtgatttgagtgttaaattaagtaagcaggaagccatcaacctgaggctgtcttcttacaccgagttcctacgtaatgaactacaaccttacttagtatatacataaacgaactaaatcttgatttagtattataacagtttcaaccaatcacagatagccaactcatcatggctgttaaggtgggcgtgatagggcatatgccagttgtagtcaatcagataatttttctatatggcttcaactctgcttaatttatctaaagtttttcttctaacatgagaaaagcaaaatacataatagcatctatggatgtgatgctttttggcaaacaaaaaaaaatcatgacgtgtgtgcttataagttcatacttttatttgcatgtgtattttgaaatataacaggaaaatattcatagtagttacctatggagagagggactggagaggcgagcaagaaaagttatctctttgctttttgtctgtacatgtggtttgaaatcttaaaactgtaaattttatattttaatggtgaagaaaatatatgaacattatgatcatttatttccttcatgcattctgtgttaaacgtctcataaataatgcaactgttgaattcaccaactcttgtttatcctgtgtttgtggtataaaatgtcatttcatgggagcagaaaccagtccatttacctttgggtgcttctgtttaaataggtgggaagaaaaccttattgaatattttcaatctataacactaattatgcaatattttcaaaatatattttggataaaaataaaattacctaaaacttttattggataaggactgaattatgtaagaatcataaatttaggtatgccaatgagagtctaaattgacagccttgtctggttctgaaaaaaaaattgctctaaatcatttttggaaaccatagatgatagatgataatgctgttgagtctggttctgtgaacacttcatcttgtgaaagttctgagcagtaactggtaattagtattagaggctttatcattcttcctgagcaaattatcagaaagaatgctatattttctgaatgaaatcaccaattaatcatgccactgagcttaactgtaccactagtgaagacatacaaatatggtgggaatgtttctttttaaaagactgttgaataccaaaatctagaattacatgagctgagcatacaatgtgaaagtacgaagtcctaaaacggcatatcacaaatttctgtttcaaaaggaaaggtgggaagggtatctatacttgaatatcctaaaaaactcaaacattatcaaagtaattacagaaaactgagtcatttatttagggcaattcaacatttttaaataaattaggaattattaactaccacatgcttgttgccacacagaataatcaactaaaattcaataatctttgttgaagtagcttgtactcattttgcattaatatgcaattaaacataaacattgatgttacatgatcttatatgattttttgtgtaccagatcatgtactcttacttagtgtgtccatgtgtgatatgtgtaaagcagtttttcttgatgcaaacatgcatcgctttttactagatgacagtttttagagaaaaggcatggagttttagaattaaaacctactcagtgttctttgcaatctgctgtgggtatccaagaagggccagacccttcttatgttttcaggagagaaaacaattaattagcaagttccaatatgtttccaaaactaaagctaggatagggtggatgacctggtaccaagatacccctgagggcccgacggcttccttttatatgctgatgggtttcattatgattcttacagaaagaagccagacatttttaggctagactgcatatggcaggttaaaccaataatcctcttttgtatttcccataaatcattttcaaagttaaaattgtatttgcagtctatatactgaatgtcactgtatgtgtcactatattaataagtcggctaactattctcttggattagtatttataaagtagcaatatgtcttttagttttcttagatatttagaaagcacaggcttattagatttctagtgatctaatcctgagtacaacataaggaatcattgcacatgcatatatagaggattaaaccactttggaaatattagataatatatatttggttcattataaatcttgtaggattctgtattacctaataaataatggaatcttccacatgtgttttcagtattagtttattccaaagggatcctttaacttttaaacatataagataaacttttaaatggtttgattacaaactctaaatatattgacattgatttgtgaatatcttctcccttttaaatgcaatataccaagaactcaataaagccatagagggtcttcacttgcaggttctgctgatgactcgaatataataaagaacatgtaataatgatacagtgaaagagttaacccagatttgtttcttctgtacatttgattttgaaaaggcaattaacttctcttatctataaaatatccttaaagaatcttatgattcctcttaatcataccatttaaatttgtctgttttaaagaaaaatacaaatttagggcatgacattgcaaacagcctaagcaaccttgtctccatttaatctgttctcattagtggcaaataaataagaaacaccagtgtctatcagatgtcagcattatagctctaaaatataaacttggtatttttaggtaaagcatgatgaatagcagaactaaaatatctaaaggggtgaaaccagtaaggcaagaatcatcaagaagtaaccaataggtaacagagaaaacataaagcagagttcctttgcagataaaattcttcattcattaatcaaagtttatcaaatgctgttaaatgacagacaatgtgctatgttttgtagacaatacgtacagactagtgagacaaaaacactaaaacggtaaatgactaaaaatagttttaggtgtctactcaaaaagtttataactataagaacatgcaatagagaactacaggcaatttggactataacattgaacgcagaaacttgtttgagaacaagtacaaagtgattctgctttctcctgcagaatgaggatgcacaattgctggtgctaggtttgacttaagaaccagataaagggaagtacagagattattatgttaagttcttatggaatgatgatacaagcaaaagtacaagacaacagtgttcaggaaagaattgattatcattcttaagtctgaaggaccctaaataaatagagagggcaattagcagccgagtgtccttggaggcaaaaaaaaaaaagaaggaaagaaaaaaataaatcttgccaaatattcacggtaaattaccctaatttgtgtagctacttcattcctaggaatttttgaatccttagctaaatgaaccagaaaaatgcagttttctcccgcttatctgaaatccaatggagtaaatgattgaaaagagattaggctgtagtgctaagcagaggtcaataatgattaccctatacttttttatgtaatttgaattttatctggagagaaatgaagaacatttgaatggctttaatgagaaagtatcatgatatcatctaaaatttatgtgagcaaggctgaagtgggaagaagtgattggaacacaatattagaaatgattaagcaatgaaaaatggtggccatgagcctcataattggtagtggttacagggtaagagaaaaggtggagaatcaaaaagatatttaagtggttgactagaaggacttaatgactggctaagagagaggaaaacacttaaggtttagtctgggcaaatggttaatgttggtgagtttaagaaatctggaagaccttagcaggtagaaggccatgagacatatttattttggtgcactgaagtggctatgtgagtggttatgttcaaacttcaattaaaaatataactaaaaaaagaaaattattaaagaataattgaatgattacactggagaaaataactgggagatcatgggcactgaatggtaactgcaatcataaaaatggatgaagtagtccagatggagcatggaccgttgacaagaaaaaccagaacagaaccccacagaacaaaagtgattgtggaatgtgaagaaaacaggaactgacaaagaaaacaggaatgccacagagttgggggtacgaatcaggagaatgatgccacctgttaacaaaagatattgtttctaaaaataatgatgtaaaagaatattattaatattattttaatatcttattagtgggtattatatttcattattcttatattattattgtattctatattactcttatattattatcatgtgtattgggatggctaaaataaaagtattggtgagactatggaagcacatttaatgtagtaggcactatactagaatcagttaaaacgcaatagaaggaagtggagaaagccattgtaggaacctccttcgagaattatttgtttcattttgggtgggttctactgataagtctacaattaattaatcttttctttgtctacatctaatctgctgtttatcccagtctgtatatttttcaccggacgcgttttggtttttatatctgggacttcaacttgggcctttttaaaacatattttgtgcctctgcttaacactttgaacatatatagttgttgcaataattattttaatatatttatcttccaattctgtttcagcactgggtattaattatgtaattgccacactaccctgaatgcacccaatgtattatctcattatgggtcatatgttcctgcctctttgcatgcctatcttgaattgtatgccagacattgtatattttatctcattcagtgctggatatttttctctcataataaatccacttgggctttgttctgggacatagtttagttacttggaaatggtttgatactttcaggtcctgatattaaaatttgctaggtaggatccatgcagtgctcatcaataagtccccactgctgaagcaagagtgttctgtgtattctaccccaaaccacctgaatctgaaggtttccagtgtggttgatgtgaacaggcactattctcagccctgtgttagctccagacactactatctctaatcctttgggtggcttgtttcaagctttaggtagttttctcaggtattcacactgatcggtactcaactggatccttgacatctctagagctttctctccgtatggccttcttctgcagcactctgtcctaggacatctatgcatcatggtctcttcaggacgtcaattcagggagccagttcagctttgcctgggatactcctccctgcaccactgtctacaaactctttaggcagtaacctatttcaggcaggaaggtaaatacagtgcctattacactattttagccaggatggctttcacatcagcatgtatttaaatattcctctacccccctgtaattctttaaattataagatttggggacttgcttaaatctaaattcaattatttttggggggaaaacattttataggacatagcgtgttttgacaatgcatatgagcttagtagacacagaatttgatcttatttctagctgtcttctggggctcattttataataaaaccattcatagttaacattgatgcacaggtatctttgattcaaaaaatatcccagatataaggtcaagttttcagtttcttaccaaaacggaaactatctttactttattggacaccatgggaggtaatgataaccgaggttgttaaatttttaacagaacagaaaaatactaattttcaatggcttctaggacttatttttcagcatattttatttctcacttacacaaataacagaaaacccaccagacaatgtcaaaaatataatcaaaattatattgtgattatcattcatctggttgaaattactgtttgtctctaatgaagcattcactattttaccatagaaacatccttactatgccactaccaactttagagaattcggtcacacccattaatggtcaagaccaccttcattatggctgtgaaagagtcgtggttttgtggggtttttttacaatatgagacaagggtaaatagatattagtttacctagcttgactcccacaggtctaaccacttactaattgataagtataatgcatttttatggacataaaatatatagtacagagtttcatatatatttccaaattcagtgaatttttgtaataatctatgacatatatgttcatgtcgttacgatgtattcatttatatgaccaaacttgggttacaaatcacattcagttttccttaattcagggaacttaatatccttttggtcaaataaaccacaggtccttctggatttttctcatagtacattatacacatacaatgcacaaataaaactttcaaattcctttcactcattttagaaagtaacaacttaaagagaattggagcataagacatttttctggccaggaaattttataacttcttctgagtatggcaaggagtatcaatgtttccattgttgctttaaagcattcatagttatgttcattagtaaaattgtcctcacaggttgctaaacagtatgaatccaaaggaaatgtatgtaacactgaaaattaaactgttcgagaaagccatgttcctatatatattgtgcctatttagtcttaactccagcattactttttttcaattgggtcaaacttaattacatcagcagccttgtgtgatcaatacaacaatatttttgtccttttccttaggtttcaacaaatttaataagccttgaaggttgctgagtttgccaactgcagtaaatgcaaagggtatatgttatactaaatccaaaatattttgagaatcacaagtaatataaagtgtgcatcattttcccccagtagaagcttgtttttaataaagaagaattttgaagtggctctgcctttattctgattgtgtataaatgttttatgtattatgtgttgatctgaagcaaagtgcacactgtacatcagccacattaatctctttgtatgtgaacaaagatgagcaaacaagtgggtgattgcaattgaaaataaaatataggaaaggtcaggatccaagagaaaaaaaaaaaaacaaaaacaaccaaccaacaaacaaaaagctgaaacctggcaatgatctgaagtatgatttaataatttcagactgaatgggattattgcaattttctagaacaatatgaataaagcaatcatattttaactccatatgctagaatgactagagttatactgataagaaatctaccataatgtatatcatcctgtagatattttattccatgatgatatgtattctagcctatgaggcataacaaaaaatggaaggccgagcacagtggcttatgtttgtaatcctggcattttgaaggctgaggaaggaggctcacttgagcccagcagttcaagaccaatctgggcagcaaagcaaaaccttgtctctataaaaaaaaataataaaaataaattagccaggtgcagtggtatgtacctgtaatctaagagattacagagaaaggctgagagtggtaggatcacttgagtccagtaggtgcaggctgcagtgagccatgatcacgccactgcccaatgtatgtgacactgaaggataaactgttggagaaagccatgctactaaatgtattgtacttacttagtcttaacttcagcattacatttttcaactgcgtcaaactcaatcacatcagcagcctcgtatgatcagtataacaatatatttgtccttttccctgggcttcaacaagtgtaataatttaaattaattaattattaaatgagatagggtgacagagtaacagaatgagacgaaagaaagagagagagaaagagagggagagagagagaaagaaagaaagaaagaaagaaagaaagaaagaaagaaagaaagaaagaaagaaagaaagaaagaaagaaagagaaagaaagaaagaaagagaaagaaagaaagaaagaaagaaagaaagaaagaaagaaagaaagaaagaaagaaagaaagaaagaaagaaaaggaaagaaagggaaagaagaaaagaaaaggagtactgacacataaacagaagactctccctaccgggagtcggatcaaccaatgttgttttgtttaatcatcattgttgcaatatagtatacacatcactaagtgtactagggacataactcaaaacgtcagaacaatgatcagaacatcagaacaatgatgctgagaaacatcataaagatgaattgagattgtgcaatactgttacgactaaccattttttttcctccaagaagttgtttacatttatattgtcattttgtagtttaataaaaatgtaaatgccactgtgagtgagaacaataaggaaaacaatgaaagaaaaaaaagaagataggttccccagagcacctgagcaacagatggcaaggaagatggcctgggtccaccgaggaggttttagcactcacattgctttgcatgggtgtttgaaagtggaaatcaccacctctattccagaggcaactgaataaagatgtattcttagttcaaacactgtaaaaatggcctaaaacagtaaatgggagtaaatatatatatatatatatatatatatatatgtgtgtgtgtgtgtatatatatacatatgtatatatatgtatgtgtatatatatatacttatgtgtgtgtatatatatatgcaacagtatattgggagaagtaacaatgataaaaatttcctttagctccaaggtagtcatattgtacttaagcactttatttcattttaaccctacttgtgcccatccttgatattttcacaatttacaaattggtaataagggtaatgtggtgatgcttaaattgaaaaaaaaaaaaaagaaacaaaacaaacaaacaacaacaaaaaaacagtgcttgtaagaagagggagaccttgaaaggtctgttcctttaaactagtgccgggtaaatgcaaaccctgttgtggatctgactactagatggcaaactgacttttaaactcatcttggaaacacagatgtaaagctggtgtatgagtattcttccgaaccaacagggtgtgtatgcacacacacagagactgattttaggaaattgactcacaggatcatgagggctggcagtctgaaatctgcagggtaggctaacaggctggagacccacagaagtgttgagtggcattcttgagtccaaaacagtatggaggcagtatttctttaggttggaactggttttgaataggttcctttattgtggaacctgtttaataatttagaggagttcccaggactattgcgtaaattgcactgggtggtacatgcacaggtgtattgtactggagattagccagagagagtactggtgtgtactgcagtggttctcagacctggctgcaactaggaccaatggcagagcttttaaaatgtaccaatgccagccccttttcatcagtcttatttaatttgaaagcttcccttgtgattctgatgtgcacccagagataaaaaccacttttatgggaagtagaggtgtctagaaataattaggagaagtatatcatctctcatatgtcaagatataaacttgagcattgctcaagttcacagatttactatatagtatcacattgtcttgagtatttgcccggagctaccagaaacattcctagatgtaggtggtacatcaacaaaacataattctttctctgacattgattttttacctaatatagagaacagtttgtcaaaggatcttttaagtgaaagtaaaattaatacgatgtaaaatccatgctattcaatggtatttcatatttaaaataatgtaatacaagaaaattctaacatctacaaatcagttaccttacattttctgaggggaaaaaacttgtcactgcttttacgatatcagcgtcactgaatgaacttcattgtatacatttattacatgcctactgtgagctctgcctttccttagacagtgggggtataatgattacctctagaatacctgccctctggagctcatcattaatggggagccagccaatacgaaaatatgcacagagattactatttatatcatttatttcctaattcggtgaactacaaacatggatgaagtgatgaaaatcaacctgaaaaataagtcacatatcaaaactgaaaatcaaagtatactagagacagcttaattaacataaataaaacctatcaataatctatcagatatctactttggcctaacttttatgttaaaattcatagatcatatagagataattcattttatttaaggagtttaatatctaattggaggtagcagaaatattatgtgatgatccacaataaataaataataataatggttacatttgttaatcaattactacatattaaacactttcagcgcctacatccgctgactcacttaatttttataaaaacatatgaagtggtaactaccattttgccgatgaggaaatgtgtaaaatttgtaagggaattgctcaagttatacagctaatccctggtcaaattagaataaaaatagaagataagaaaaattggaatggagaagaaggactcaagagaaacgtctggcatcgaaacgctgacttgaaaatcactcacatagagatgaccatggaagatacaggaaggaactgaaatcacctaggaaagaatataacggggaaaaaagaaaacagttcccattctccccagaccctttttccactcttattctccctacttctttctagcgtctcccactatgggcaatctttgtcaagtgtattacccaaaacacagcacacctatttatatctgccaagagagaaaatagtcttttttcagagatgtgctctttttccctttcttgcccatactgaatgctccctgatctatccactgggagcctttcaggctgctctatctactggctctcaggacatatttcacatcacccttgttttgctcaagtttagttatttataggcgtatctgtcattcccagggattgagtacaccctcaaggagagttcctcaattataggtattaatttatgagttattcaataaaagaatgaatctctagctagggcaatgccccagtttgaaacaaacaaaaatccaagcaaataaaatgaaatcaaaaaccaaaacaggaaaagaaaaaaggcaggctgaggctagttcagtaagactgtgttcctggcagcaagattggagcagagacagagttgctgtacactcactcccatgagaggaaaaggaaacaggaggaaaagaaaagcctgatcttggcctgacttttttttttttttttttttaactagggcattgccctggttggagatttattcttttaatgattaatttgagaccaaaatatctacaaaatgaatattttataaaccttcactctctacaggtttaattatatattttaatgtcatgggatggatgttagccatattttatcactgttagttaaaccatatttaagttccagtaagagaatggcagaaataagcaggatattttaaactccaattgtctctcagacatgaacaaagctatcagaaaaagagcaacaagtttgactaagaattaaaagtgaggctgggcgtggtggttcacgcctgtaatcccagcacattgggaggtcaaggcaggcggatcatgaggtcaggagatcgagatcatcctcgctgacagggtgaaaccccgtctctactaaaaatacaaaaaaaatagccggaagtggaggcgggcacctgtagtcccagctactcccggaggctgaggcaggagaactgcttgaacctgggaggtggagcttacagtaagccgagatcgcgccactgcactccagcctgggcgatagagccagactccgtctcaaaaaaaaaaaaaaaaaaaaaaaaagaattaaaactggtctgccaggacttccttccatccacccgatggtcgtttcttaactgagagaatcatatcctcaaagaataaatgtggatatttgtgaattgtcagaaatgtgttagtaaacaagcagtttctcaagagcaggggggaaaagttagtgacagaaatatgttcaaacagctttattcctaggaatgtgcttcctcagagaacactaaaatcattcctagaaagttgcccaacttttacaactcagataagtctgcctagtgacttttcgttgtcgttgttgttagggcattagatcacaagaaggaaagtagaaaatggaatttagaacactttgatttcttttcaatcatagtttaagctaggattggaattttgagctgaaagctaattcctgagtagcattaaatttcctacctccttgcagggaaaggccacaatattcttaaattttaacttgtgggcgaaaaattgcaaagctaaaatgggttttgaggtctgtttcctgctgtgaaacatagattatagaacttactttgattctaaaatagaaatacatttttttatctaccataatgtaattaaagcaaatgtttatctgaacagtctaaataaagcattttgggttattgttaattgttatcctctgctacagattttgtctaaggtttagtctttagtgataacataataaaacacctgctttaaaaaatatttgaatttcatttgagatttataggtggtattcaagccaattaatgtactaacaaattaacagggttttttacttgctcaaatttaagaaaaacattctaccctgaactatatctccagctttaaagcaagagaagaatcataatacttatctcttattttcacacactgtcacctaattaattcttgaaaagcttggggaattgtgctttgatcctgtttttaagttatcaaaattagctttatgttcatcaactatgggctgttaaaacatcaactgtcatagtgaaaaaaaagtgttttttttaaaagaagcatctgataaattggaatcaaattaacgttttaagctgtcattttaggaaacaaaaaatcaagaaacaatgaaacagaaaaaatattaggtggagctacagatctacaagtattgaaatccaaggacagaagaagagtggcttatggatgatacaatagagaaaaggaaacaaaatacagaggcaacaggtagcttgaaagaaactaacacctgtattgaaaatttacatttccctggttttgccatatttaggtattaaaatatatttatagctttttgtgcgttaacttgcaacaatctgctttatgattattttccatatttttaagcaaattgttgaaaaatatttatgtatgtatatatgtatgcatatatctgatctgagcaataactaataatttttatagaaatacatttctaattttttctaaacattgctgtttcccttgccagtatgttagaattgttttcattacaatctgtaaggatatgcttcattgtttatattgctattgaatattattgaatattgctcagttttatataattattttccattaaggaaatttaacttgtgttctatttttccccttaaaattaatgctgtgaatgttatcatccctataaagttaaatattttcaagatttccacttctacttaaggggttttcatttaactatttaattttcaagaatagtatgcatatattttacatctcagctgtttattatattgccacaaccattatctcccaaattgttaattttcattttctcaaaattttaataatgttacttacggtttttagtatttgtgccatacttagaaaagccaatatataaaattaaatattaaatttaatattctaattattacactaaagcagtatgtattcatctttcctcctggtgtttcatggatttgttttttccactttttaaaaatattgtaattgcttttttacctagaaaatattatggcttaaaacatcagatatgaatctaattttttctcttttctctaaatagttaagtatttggtagatgcagtgtctcatgcctgtaatcccagaactttgggaggctgaggcaagcagatctcttgaggtcaggagttcgagaccagcctggccaacatggtgaaacactgtccctactaaaaatacaaaaattagccaggtgaggtggtttggcctatagtctcagctactcggaggctgaggcagaatctcgtgaacccaggaggcagagattgctgtgagtcgagatggtgccactgcactccagcctgggtgacagagtgagaatccctctcaaaaaagaaaaaaaaaaaggtcaagtatttgtccctacccatttattaaatagttcattattagcttgataaatgaacagaaatccatatattcttaaattcttccttctatttattttaagtaatttattatcatgatagtttgattagtatactttgataacagtttttttaaaattgcctttagtttttagggaggtgttaagttcatagcaattccatgcagaaggcttttatgcatagcctcttttactgtcaacatctctttgttgagtggtgcatttgttatcattgataaacctacagtgacacgtcaaatgcacccaacgtgcacggtttacattagagttgactcttgctgttgtacattttatgggtttgggcaaatgtataacaacatgcattcacaatcagactatcatacaaagttgttttcactgtcctaaaaaccctctgtgctgcaccagctcatccctcactgttccctaaactctgattttttttttttttactatttccatagatttgccttttccagaatgtcatatggaagtttggaatcttagaatatgtagctttccaaataggcttctttcactttgtaatatgtatttaagtttcctccatgtccttttatgtcttgatggctaatttgtttttaatgctgaataatattctgttatatggatataccacagtgtgtttgtccattcacctactaaacgatatattggttgtttccaagttttggtagttatgaataatgctgcttaaacatctgtactgattttagtgtgaatatatgttttcaactcaacaatatgttttaatagctcatactgttactctttttcccctaaagtttcttgactaaatttatagattcacatatacaaagtttaattttactttaatgagtataaaagttgtgctcttttagtttattagggcttattaaatagcctttagtttgtagaaagatttttattaagaaccaacattttcaagaatagaataatgtagaatgtgacaaaaatcatataatttatgaataagtcatatactgtataatcactacattaaccatgactggctaagtttacgcagggacagttcatgttcacattaattgttaaagagttttcattatattattaactgattaaaatttgtaatgtttttgatgtttttatctggaatatcattgccctccattactgccatggcctgatgaaaccacattctggttaaatccctgttggctagtctggtctcgaactcccaacctaaagtgatccacctgcctcggttgggtagttagtttgtgaacacaggaaaacagattattttttccaaattgaataactgaatattatagcggaagctattgatgttctaaacaaggtctctttgcccacgcccaccttgccatttacttgcaactgtgagatacagtttccccaagttcacaacttctacttaaatctttgcctctccccttatatgcaggactatttttgctgtaacctggggatcttgcccatttcaaatgagccaaactaaagttagatgtgtttatgccctgggaaaagtgaaaggtgactcacggccaatatggaaggaggatggtggttttatgcccagtttccccatcgtctggtgagatattctgaagcaggctacaatagggtttctcagagtgttctcagttcatttgaattccagattttcatagtggtaacttgctcgttagtacaacctactgtttgtctccattctcttactttccctctctctttgtgctttctgagatcatctctgaaataaattaactatagccaagtaattttttaatctctgcttttaaaggaacctcatctaaggcatgtatctattaaatttgcttatatcccatttaaattaaatatttttttcagatttctctacagtgccaattatgctttcaacttaatcaggaacatgttgagaataataagtttttccattatgattatgtttcttcacatttctcctagtttttaatttcaattttcattttatgtatgttaatgctatgctatttggaagagagttcttcagaatcatagttttgaattagcttttttttttttttttttttttgaatggctaccagaatcctgactctaataataggtagaatccaacatatacatttgaaaaggagaaaaaacacatgaacttttttttgttgtttgttttgagacggagtctcgctctgtcgcccaggctggagtgcagtggcgcggtctgcgctaactgcaagctccacctaccgggttcacgccattctcctgcctcatcctccctagtagctgtgactacaggcgcccgccaccacgcccggctaattttttgtgtttttagtagagacggggtttcaccgtgttagccaggatggcctccatctcctgacctcgtgatccacccgactcggcctcccaaagtgctgggattacaggcgtgagccacgaaaaccttccttgaaaatcaccaagttttctttattaaaaggtaattttattgttctgtgatggataaaattatcttgaaaaatactcaatgtcagatgtacttttatgggattttgtttttatacatgtaccctgctaataattttgcaaaaacatgatcttacaacattagagtggaatgtcctaattcagatgaatagaatataaatagtgaaacacaaatttggaaagtcctgagttatacaaatggaaaacaaacttaacagttgaggactgtttactttctctaatattaacgttgtggcagaataaactctgtgttaattcaggtttgtggaattgttgcaatgcattgttttctgaccatctaagaaagtgtaattttgacctactacagctatagctttcttttttatgcactctcttgaagaataaatgcaaaagctcaaaagataacaacataaatagggtatataaaaaaaaaaagaaaaccacctaaatcattctttttcttctttaacaaaaagaccacaagccagtgcaatctcagcaataagaattttaccttgaaggaaaagttggagtcatggaacactgctgctactttaaagtatctaatgtaaccattaaaacaactacatggaagaagtactttacagattagaacaccttgaaacagacagttgtgatatatttcataaattatcacaactgaaacaagttgcgacagtattcacatagaacagcttttttctctcctgagtaaactgtaatcctgtagtgaaaataacccctattggtgatggatctaaaaataggtctcccattatgcagcaaaatttttgattaataattccatgtccactaatctgcctccaatagcattaaggaaaatttggtatgctttttctctaatagattacaaaattttcacttgttgaacacttttaaaagtcaaacaataaagctaatatttattaagaagtcactgcatactagacaatttttatttatgcattacctttcttatttttgacaactatcttgcatgttagatataattgttaaacctatttaagtaataaccaaaatcaaggcttgggaaaggtgtttgtaaactaaatcactctaatggtcagcaagtggaaaactaagatatgtaacccagcctacttggcatgcaagaccatgccacttcccaccatataatagtatattcatgttgcgttgaaggttaaaaaagtgaatattaccaattttctacattaacaaaattcaagatcagatgtgtgtgcattaactatgaaattgggtaaaaataagtaaaaactataagaaatatataggaagtataaggagcatccagacagaagagaaatagctggtatttcaggaggtcagagatcttactacagtacattacactgaatggaaggagtactgacacactgagcagaaagtagcatcattttaataacaaaaaaacttcataaatacaaatttatatttttgaatcattaaactctaaaattagcttcagggagaaaaaataaaatcttagtaattttctgaagtatgtatatttggcaggatgccaacttctaaagtttttagatgagttttcctgagttagctaatagggagtttcacaggtgagaatctgtctccatctctgactttgcatactccagcatggcctcagatattatgtaattctcaaaatataagttattgtattccacttaatttaaataatatttacttataccatttaaaggaatgttaagtatcaaaaggaaaacaatgagaagatgtctccctttcaaatcggctgggaagagttatgcctgacaatttgctgcctctcaattgcagctgttaggctcaagtcaggatcagaagacttaagtccaaataagattgttggaacacatatgtttttctttttttgtataataatcacatatgttagtattagcaaattctgtaaattctgccttcaaaatatactctctaccatgaataagccctgtcgattctatcttcaaaatactctctccaaatttccaaagagcttgcttacttgagtttttgggtgtctgctcaaaatatcacctttacaaaggggtaattactggccatctaactaaaattagtaccttcacaacactcgtcttcgcccattttgtgttgctataaaggaaggtgcagggagggatgtgtacagagatcacatggcaagacagaaagcaagagaaagaggggagggaggtaccaggctctttttaacaatcaaatctgggggaactaattgagtgaaagctcacccgaaggaagggcattaatttactcatgagggatccactctgacccaaacacctccctttatgccccatcttcaacataggggaccaagtttccacactaggttgggaaaagacaaacatccaaaccatagcaacactacattctaatctcttacctgctttttatttctaactgttattatttatcaaaacttgcaacaatattataacagataagatgcccaattattaaggtatcacattatttgaggaaaacatttttagatgtacctgtattgttaaaaatgtatacaggttaagcatacctaaactaaaaatccaaaatgtgaaactttttgagtcctggtatgatgccataagtggaaaatcctacacctgaccttgtaaaataggttgcagttaaaactttgttccataagcaaattctttacaatattgtacacaattactttcaggctgtgtataaaaggtgtaagtgaaggataaatgaatttcgtgtttaaacttgggtctcatcaccaagatatctcattatgtatatgcaaatatgccaaattaaaaaagaaaatcaaaattcaaaacactttggtcccaagccttttggataagtgatacacaacctgttctgaaataatatggtcccaaacaatcacaaagcagtagcttcctaacttatctctatccacttcccttctctttgaaaatcataattttagccagcccttattggagaacagaattaggcaaactggcaatcaactgccagttgcactatatctgaataacagtcatctcaggtgaatatttctgggttttacttcattcgacagttatgtattcaattatttgttggctttaatcccacactacaatgtaggctccatgaggacaagaactttgcttggttcactgcttaatatccagtgcaataacagtagaggctcaataagtacatgctaaaacaattactggattgatttgattgctatggaatatgctagggtgtgacttatgtttctaagaggacttcagagggccccgggcactttccctacccacaaaatgcttgtagattttagaaaagttgcctttgagaatagaaaaagaggcctcttagtcatggacagagtttaaaaaagcatctgaagtatgagacaaagcagcagtcaaatgagtcatttctagaatagcatctctcattccatcatcatgcagtgagcttccaacactagattcatgttcttctgataatgtcatttttaaattgacaatgattggaaatattccaagaatattctcttttacttaggaagttaaaatggaatggaaaaaaatgtcccaaatgttgccatgcatataaaatataatctacccaaagaaagagcaaaggactgatatttgaccactgcgtacttggaaagtacagttccaaaagaaacaatgaaaaaacatatagaaaaaaatcaggtggattgatatattgtttggctttggaaaattttaaacatgaaaaaataataatcccaccatacttgatatgcttaatgcttacttatcaaaccaatgttaaaatctgtaggattttccttccaagcactcttgcattcaaaatataactaaagagcattgcaattacatttactcaaagaaatagattctgtagattgtccctgattatcttctttcctcacttattgtgctgcctctcccctcgtgcctttacagactaagaaaaaaatccagttttatttcatatttctgaccttcatgatggtgttggccccataatatgatacttcttcgacaaataaaacatgtgaagtgccaaggttatgttatattttaatacagtaaaatgtaagcaataataccttaattatttgtgtgtactagtatattacccactgttggaataggaaatcagacttagctagtacagatacccctacctcctccccaacagatactaaacataagaatataatcatcattcatttttgggcatgaatatctttttttcctcctagataggagaaaagcatttggttgtaaaagagacatgaaggacagaagttgagtatggtatggcttgaatgtatggtatggcttcctttcagtgtgactcctcaggctgggtttgagcaactgtggttaaataatgaaggacagaactcaagcatactatttgcatatgagacagcataagggtaaggacaaggatttgtgaatcagaagtcaaaagactgttcaaaagtgaattattagattctggtcataagcaggaccgcttcagtgacttaaggatatagcctggcaaggatggaaaatggtcattctttctatgcctgtccagaattcattggtagcttctatctctgtggattataaattttgggtgcatggtagaaacaaagtgcttggcacaaacacttgtgatttcgcaagagatgccatcatttagtgttcttaatgtggcttttttgatctcatatgttaattagaatgtaatagctatgagggtaagtgatgtgcctattgtgtttaccactctagtcaggtgcctagcaccatgctcaggccagaatatctccttgataaatatcagtaaacaaatgaatgaagtgcaagtagaaaatactacttaagtgctcttcctggcctgactggtactatgtactaaggcactaattaagaaacataaagtggctgaatagataaaacacacaagaccaaactatatgctatctacaagaaatttacttcacctgtaaggacacaaatagactgaaattgacagatggaaaaaatattccatacaaatggaaaccaaaaagtagcaggagtaactatacttatatcaaataaaatggactttaagtaaaaaaactataaaaagatggaaaagaccacaggtcaatagagaaagaggaaataataaatgtaaaaatacatgtatccaatattgatgcacctaaatacatgaagcaaatgttaatagaccaaatggagagctagaatgcaatgcagtgatagtatgagacttcagcatcccactgttctgcaatggattgatcattcacacagaaactcaacaaagaaatatagaatttaaaatggactctagactaaatggacccaacagatatttaaaaaacattccatccaacatctgcaggatacgtgaaaattaaccagcataacttgaaatactgatgggtcaatcaataaattttaaaataaatttaaaaattcctgagatgaatgaaaatggaaacacaatataccaaaacctataatgaaacagagtataagcagttctaaaaaaagaagtttacagtaataaacatctacatgaaagaagtagaaagatttcaactaaaggagctaatgttgtacctcaagaacctagaaaaacaacaacaaaccaaacacaaaattaggagaaggaaataaataataaagattagagaagaaaaaaactaaatagataagaaaaatataaaaaacagtgagataaagagttgggcttttaagagctaaaaagttgacaaatctttaacaacattaagaaaaaagagacaagactcaaataaattcaggcgcgaaaaaggagatgttacaactgatatcacagaattaaaaagatcattaaataatattattaacaaccatacaccaacaaattggaaaacctaggggatatggacaaattcttagacacatgtaatctaccaaaattgaatcacaaagataaaaaaaaaaaaaaactttaacaaactaataatgattaatgagattaaatcagtaacaaagagtctcccataagagaaaagtccaggatctgatgaagatcctggactcagttctactaaacattcaaggaagaaaaaataccaattattctaaaactattcaaaaatattagagtggaaagaattcttccaaacccattatatgaggtcagcattactctgctaccaaaatcagatagggatgcaacataaaaagataacttcagacaaataaacctgatgaacatgcatgtaaaattcctcaacaaaatccaagccaactaaatccaagagaacatcaaaaaggtcattcagtaatatcaggtggggtttatcccagcaatgcaaagatgattcaacatatgcaaatcaataaacatgatatattatatcaacagagtgaaggacaaaaaccatatgattatctcaatagaagaagaaaaagcatttgataaaaatcaacatcccttatgataacatctataacatccctttataataaatattcccaactaattatttataggaggaacatatctcagcacaataaaggctgcacatgacaaacccacaactaacattataccgaatgaggaaatgttaaaagttttacttctgaaatctagactaagccaatgatgactattttcaccacttttcttcaacatagtactagatgtcatagcctgagcaattaggcaaaagaaataagtaaattggaaagaagaaagtcaaattatccctctttgcagacagcatgatctttatatgtatagaataccctacagattccaccaaaaaaagggtcaagactaataaatgaattcagtaaagttacaggatacaaactcaccatacaataattagtagcatttatatatgccagtaacaaactacatgacaaagaaatcaagagattaatctcatttacaatagctgcaaaagacctgtaagaataaatttaacagctttgttctttttgcttaggattgccttggttattcaggctcttttttggttccatatgaattttttaatagtttcttccagtctgtgaagaatgtcaatggtagtttaatgagaaaaacattgaatctataaattgctttgggtagtatgtcattgtaatgttatcgattttcctgcctatgatcatggaatgttttttgcttctgtttgtgtcatgtatgatttattttaccagagatttgcagttctacttgtagaacttatcagtgtaagaagctctgaggctgagatgatgaggttttctagatataggatcatgtcatctgcaaacaggaatagcttgacttcctcccttaatatttgaatgccttttatttctttctcttgcctgattgtgctggccagaactttcaacactttgtttaataggagtgatgacagagggcatctttttgttgagccagttttcaaggggaatgctcccagctcttccccatttagtaagatgttggtggtgagtctatcatatatatttttgttattttaaggtttgttctttcaatacctagttcatttagagttttttttatcatgaagtgatgctgaattttatcaaaagcctttcctgcatctatgagataaccatgtgtttgttttctatagctcagtttatatgatcaatcacatttattgatttgtgtatgttgaaccaaccttgcattcttgggatgaagcctatttaatcatggtggataagctttttgatgtgctgctggagtcagtttgctagtgttttgtcaaggatttttgcatcaatgttcatcaaagatattggcctgaagttttcttttttgttatctttgtatttctgtcaggatttggtataaggaggatgctggcctaatgtaatgagttagggaggaatctctccttttcaattttttggaatagcatcagtaggtatggtacaggatcttcttagtacacctggtagaattcagctgtgaatccatctggtcctgggcttttttaggttgataggctatttattactccctcaatttcagaactcattattggtctgatcagggatttgacttcttcctggttgagtcttaggtgtgtgtatgtgtacagaaatttatctattacttctagattttctattttatgtgcatagaagtgttcataatattctctgatggttgtttgtatttctgtggggtcattggtaatatcccccttatcatttctgattgtatttatttgaatcttttctgttttttactttattattctagctaatagtctattttactaatttttttcagaaaaacagcttctggattcattgatcttttcaatggtttttagtgtccctgtctccttcagttcagatctgattttggttatttcttgtcttttgctagctttgggatttgtttagtattggttctctagttcttttagttgcaatgttgggttgctgacttgatatctttctaactttttgatgtggttttttagtgctataaatttccctcttaacaatatcttaactgtgtcccagagattttggtatattgtgcctttcttctcattagtttcaaagaaattcttgatttctgcctgcatttcattatttactcaaaagtcattctagagcaggttattcaacttccatgtaattgtatagttttgagtaaatttcttagacttgagttttaatatgattcttttgtggtctgagagactgtttgttattattttagttcttttgcatttgctgaggagtgttttacttccgattatgttatcaattttagagtaagttccatatgccaatgagaagattgtatattctgttctttggggtggagagttctctatgtgtctatcaggtgcatttgatccagcactgagttcaggtcctgaatatctttgttaattttctgtctcagtgatctaatactgtcagtggggtgttaaatttccccactataattgtgtggtagtctatgtatctttgaaggtctttaagaacttgctttatgaatctgggtgctcttgtattaggtgcaaatatatttaggatagtaaatcttcttggtgaatctaaacctttaccattatgtaggcctttttggcttttttgatctttgatggtttaaagtctgttttgtcagacactaggattgcaacctctgcttttttctgttttctatttgcttggtagattttcctccatctctttattttgagactttttgtgtcattgcatgagagatgggtctcttgaagacagcatactaatgggtcttggttctttatccagattgccactctgtgtcttttaactgtggcatttagcccatccaggttagtattgttatgtgtggatttgatccattcatcatgatgttaggttgttatcttgcagacttgttttcatgattgctttatagtgtcactgatctctaaacttcagtgtttttgtagtggctgccaatgggctttcctttctgtatttagtgcttcctttaggagctcttacaaggcaggtctggtggtaacaaattccctcagcatttgcttgtttgaaaaggatcttatttttcctttgcatatgaagtttagtttggctgaatatgaagttctggattggaatttttttcctttaaaaacattgaatattggcccccaatctcttctagcttgtaggatttccactgagatgtccgctgttagtctgatgggcttccctttggaggtaacctggtctttctctctagctgaccttaacatttttttctttcatttcaatcttggagaatctgatgattatgtgtctttgaaatgatcttctcctggagtatcttactggggttctctgcgttttctgaatttgaatgttggcctttctagctaggttgggaaagttctcatggatgatagccttaaatatgttttccaacttggttccattcttcccatctctttcaggtgctgggatgattggctagccatatgcagagcaatgaaaatggacccctttcttacactgtatataaacattaactcaaggtggataaaagacttaaatgtaaaacccattcaggacataagcatgggcaaagatttcattataaagttgccaaaagcaattgttaacaaaagaaaaattgacaaatgatatctaattaaagagtttctgcacagcaaaagaaactgtcaacagaataaacagacaacctgaagaacagaagaaaatttttgcaaattatgcatcaaaggtctaatgtccataatctataagtaacttaaataaatttttacaaaaaaaaatccataaaaaagtgggcaaagtacataaacagactcttcaaaaggagatttacaagcagctaataattatatttagaaaagctcaacattactgtttattagagaaacacaaatgaaagccacaatgtgatgccatctaacgccagtcagaatggtcattaaaaataaaaaaataacagatgctagtgagattgtggagaaaaaggaatacacaaggaatacacttatacattgttggtgggagtgtaaattagttcagccattgtagaagacagtgtggcaattcctcaaagatctaaagactgaaatatcattcaacacagcaatcccattaccacatatatacccaaaggaatataaattatcctattataaagacacatactgtggtggtgtgtgtctgcaatcccagctactttggaggctaaggcaggagaatcacttgaacctgggaggcagagtttgcagtgagttgagatcatgccactgtagtacagcctgggtgaaagagtgagactccatctcaaaaaaaaaaaaaaaaagacacatggatacatgcatgcatatgatcactgcagaactattcacaatagcaaagacatgaaagcaacctaaatgtccatcaatgattgactggataaagatgtggtacaaatacaccatggaataatacgcatacataaaaatgaatgacatcgtgtcctttgcaggaacatggatggatctggaggccattatccttagcaaactaacacaggaacagaaaaccaaataccatatacaagtgggagctacatgatgagacacatggacactgagaggggaacaacacacgctggggccttctgaagagtggagggtaggagtagggagaggttcaggaaaaacaactaatgggtacaaagttaatacctggttagtaagataatctgtacaacaagcccccatgacacaattttacctatgttgcaaacctgcacttgtacccctgaacttaaagttaaaaaataaaaaaggataaaatttataaaagttgtctataaaaattataaaagatctctactattacaaaatccaaaacatatatgaaaatatggaagagaatacaaacaaatggaaagtcatcctatcttcatcctatgaagtggaagaattaatattgttaaaatgttcatactaccaaaagaaatatacaaattcaatgctatccctaacaaaataccaagacattattcataaaaatggaaaaataatcctaaaatatgtatggaaccatggaagaccccagatagccaaagcagccttgagcaaaaagaacaaagagacagcaaactacctgacttcaagaaacactatatagtcataataaacaagacagcaagttactggcataaaaacagacaccagagaaacagaatagggaacccagatataaattcttgcatttacagccaactgatttttgccaaaggcaccaagaacacacactggggtaagggcagtctctttaataaattgtgcttggaaaatgtgatggccacaggcaaaagaataaaactagacccctgtctcttaccatatacaaaaatcaattcgaaatgaataagagttaaatctaacacccaaaactctgaaactactagaaaaaaataacataggaaaacacttcatgatattgttctggggaaggatttttttgtcaagacctcaaaagaataggcaacaaaagcaaaaataggcaaatgggattttgtcaatccacaaagcctctgcccagcaaaggaaacaatcatcagaatgaaaagataatttaaagaatgggagaaaatgtttgcaaactatgtatctgacaaatgattcatgtttagaatgtataaggaccataactcaatagcaaaaaaatcctaataatcctgttgaaaactgggtgaaagatctgaatagatatttttcaacagaagatatgcaattagccaataagtgtcacatttatgactagtgtgccattattggaatgctaagtgtgtgggagttatttatatcccactgcttaaggtcatcaccaaggtctgattgcaaaaattcaaacaattgcaacctcaggcataaatgggttaaaaacatgctcatcatcacaaacatcaggaaagcacacatcaaatgagacattatttcaccttagttagaataactattaccaaaaagacaaaaaaataacaaatattggcaagaatgtggagaaaggaaagctcttgggaatgtaaactagtagagccattatggaaaacagtatggaggttcctcaaaaaattaagtatgtaactatcatatgatccacaaatcccactgctgtatatatatgccaaggatttaacacaggtatgtcaaggaggcgcctgcaatccacgtttagtatagccattatggaaaaaccatatggaggttcctcaaaaaattaaatatagaactaccatacaatccagtaattccactactaggcatttatccaaggaaactatatcagtatattgaagagatacttgcattccaatgtgatttatgataaacacttgctttccttttggggtctggaacttcgataaccatagtcagtcacatagactttacatccctacagaaccaatccgtaataaaaatcctgtatttctaggctaggtgagtttccctgtcaaaaaacactttgcacatgttgtcaaaacttactgatggatgaattaagtgtgtgctttgcaattctactgggagggcactcctggaaacttgtgcctaatgtgctctagttatgccccatttattcctttgctgcttctgttttgtattctttcactgtaataaattgtaactgtgaatacaatgacgaccatttcttgtgggttatattatcaaatcaccaaacgtgagggtgatcctggggataccttccataatagtttttaacctaaaaaataaatgaaggaaacaagaaataaaaagcaaatacagttactcaatagtgaaaagagtaatcaaccaaatatatctatttatatcattttgcaaattttttctatatgtatgagttgaagaattttttacatacaacatatgtattcttcaaatcagaaatgcttcaaaccatagccatagagaaaatataataatttatatgttgtacattttatattaataactaaaatatgtaggttagttttataaaaacacacaataaaattatgctttttttctggagacatgaattagtcttgtccatatagggtccttggaaagaggtaatgaacattgattcctttcattccagaatgctattaagatgaaactccctaggcttgtataggctcatagttttgctgaatcttttttattttattatgttttttagagattggagtctttctatgttgatcaggctcatctcaaactcctggcctcaagtcatcctcctgcctctgccttcagagtcactgagattacaagtgtgattcactgcacctggcttgttggagcttacagtcttattaatcaatgcttctaaacagaggcctcttctcactgctcatttccctttaagcagttttactatgtatcaagaaccaatattttatggggcagaaaatctccctacctactaaaacttcaacatttccacaaaatgcctgtacttcatgcttgacttaaatggaagatattttttcttttcctcataaaatagaagtttatttttaaatctatacaaattataatgacatttgggtacagtcatttacagtataaagacatcctgcttactgtcatttgaactatttatatgatatttataagccaaatgccttctacatttatgattacattgtttgaccaattattctgatatttatgggtcctcattattgcttcagtggaatacttattcacccacattcagagcattgaaacttagctgacagcttttatttacatcagctttgatatcttccactttcacccacttctggggcacaatctcataagcacaactgaggtttgtcatcatcagattctttcaacttcatttacagtcaccatttttctttcttaccatctccctgaattctaaaactctcgcacatccatttatcaagtatataacaacactcaaagaatccacccatttcctttgtgtgtttatttcctttccttccttcattctctacctctcatagcatctatctgaggcacatctatttaagcattttatagccagcagtcacaactttcttatttgtctcactgctgaatatactctgacaatagcctgcttaaatccagctgtcattccacttttgattactgctagagtgctactatgaaatttgatggcacaataacatgcaatatttaatttcagttggctacttattagattttcctataaatcaccaatagcatatatttgagtattgaaaacacacatgtatagcatctattgccagagcctacatgtcttttagagtctgttctgtgataatgactatacctatcacattgtaattttaattatgacacttgtcttcatgactgtatataattaagcctatactcaagttaaaaagaggtgaacataagattttaataaattcaaagtcataatcaataagatatttaattttagagagagaatggttagccttcagatttatttaaaatatagttaggttcagtcctgcaggaatgatcaaatctaatgtgcaatttattttatggtggctaatatcaaggtaaaggtaacatttccaaataaaacactgccaatttatgcttagattttaaatacattgtaattttctccaactcacaaacatcccacccaccattttaaaattggtattaagtgtatattttctttaaagtccacaatttaaaatgtggctttacacttttttaatcaaaacattttaattattttggctaaagtttattttaagatgttcttagacgtgaggctcattttctcaataaacaacaattgattactacttatgagagtgtctacagtgtagtgccttaaggaattatctaaacagaacagccgttagtacattagcagaacatagcctattatcaatcaatgcatagcaagttaggtagtcatgtcaaatttctttggcagaggaactgaactggagattttcattacaggcagaggaaaggtaattgattttgactttggacatttcaaataaatatcagatagttcatttctgttgatgtagctatttttcagaccattattattaattaagtattaaattacatatataccccaatttgaatttttttcctagaattatcagagccaattaggataaaagctgaaaaagaaacttagtttcatctgcttttggaataattttacataaagaagaacaacagttattgaatcatcatcaccaatttaaaattatcatgagaagtataaaacagttacctagaaattcaaagttgccaatggagaaatatttgcctcatactggtgagcatttacagcctaaaaagtttgtttttaagctaaaatgttatccagcaatgcattaagaaacacactagaataatattcagaaagtaaatgcaataaaaagtgttgtaatctttcttttaaagtgatatttcaagaagtttagtaccaccaaaaaaaaggtagtgttgtataagacattagcactaatatattcaaatcaaactgaatattatgatttaattataaaaaattattttccatatactcaactcaatataaatcaattatttaagagacatatacaacttgaaatacttaaaccaccatcacttttattttcttttaaaagaaaaataattacctacagaggcaagtttataaatttagttataagattaaaagtcaatgcattacctatctttcaacattctctaaaaattgtcatttaaatagtgattacagagttttatttctgccaatagtaaatgtgtcagaaatataacaggttagtcttaccataccagcagttagaaaattacctctgtcttaatataccataaaattttatttaaaagccattgagaaggaataaatatggaatcctattatttaatttttatattcactttttcagagaatatcttcactttaaaatatgtgtttttaaattttctaggcagtacttagcttcctaatgtaaaattcacttcccactgttaccccatgaataattctggtatggaaagctacctcagtaaatctctcatacatctcaagtaagaagtacttccatttgtatctgcttatccaagagagatgagtagttaacatcgagtattgctgtaagaattcctaaagctcatatttaaacacagacagcaaacacatggtcttctatttttctgccacctctaaagcatcaaaatattatactggcttgggtagtaaatattatgcaatgcattaggttattctggtatcaatttcaatatacacaaataatggctcaaacaagtaaacaattttaaaaaaccaacactttatgtgaaatgtggaaaattaatgactccccaatgtaaaagaaattaaagcaaaggaacttagaaagaagtgtccaagtttaaaaataaactaaaagtttaccgaaaactcaaaaattgtttttctacctaaagacctgcttttacccatgaagttttaactgttataaaacttgtccacccaaaacaaacagaaaaaaaaatttgaaaaataaacaaagcaacaatttacagacattggacaacaagcagcagaggactgtcatgcatgtaaaaagggaaataaacagaaagtgttctatataatcctagttttctgtcaggaggcaatttagcaactacaattcagaaagaaaacactaactgaatcaaaggttttgccacacttaggaggcagagatcagagttgagggacactaaggttcctagaatttgcaagacggagaaatgaagaagaggaagctataaagagacagagttccacaaagagcttcagacacacagccatgagtctatggttgagtaacaatctgcacacaaaactccatgagtctgggcaaggaacaattgataaagaaaattcaccatgaatgtataagctaaataattttattttctcacaaagtgctgcaaatcttttgagtatccactagccagtaaagtgacatcattgaatatatgcggattgtcctagggacctcagaagagccacatatttgtagtggagctacttagccctagagtaaaggctactctagactttactttagaaagctaaaaaacgtacattgaaaacaattaagttgatgtggataatatcagtctaacctatgtctaattctattgtctaggcaggcatgtgtggaagacagaaaaaaatatttaaataaatgacagctgagaaattaccacatttaatagaaagcataacacaatggttccaagaaggtcaataaagcttaaggaagataaacacaaataaaatcacgttaaagcatgtcataatgaagttgttataagccagataaaaagccaatttaaagccttcaaaatacatattacattcagaggaagaaagataagaacaattacaagaacaattattgatcctattctcaataatactacaatgtaagtattagtgaaactattttctaaaattatgtaaaatgtctggaaaattttctaagaccatatagcatatggaaaaatgtttgctcaaaagcctgctgaatttcattgagaatccttggcatttcagtcacaatctgcttcctttatccctctcttttagatctgttttggaagttctaccctgtgtattctattacaggaacgtgtggtcaagaagacagaggctcccttgacccccatctctcaatctatatctgatttcaccctgggtaggatagagtgccagtatttttcattccacctctagactcagttgcaaaagcttaattctcagcaatcctggtagaaaggactgggtctcacttctcccacccagcttgtccacgtaaggtgagattctacatcagtcacagcatgctgagaatattgtggctcctatttcccctgccccaccttgctcttcagatggaggtttcacgatggttggggaaagtcagaactgcagggactgccacctttacctagttagtggggagtaattccagaaaaatgagtctggcctctagcttttgtgcaatggcacaggagtttagacagggagagaggcagaccagaaaaatggacaaaactgcagcttagcctgagagggctgcttctatttagaacagaatttgaagagctccatgtgcaagattgttattttcaatcttacacatggagctcttcaaattctgttctaaatagaagaatttgtaaaagtcttggtggggaacaattaagaagaaatgtcagctccagaataaaagcaaatatggcagaacagcctgtttaatagaaaaaatgagggagacagctaagaataggtctcctgcaatcccattcaacttcagtgtttgagaaggctgtgcacaggcactaagctgcacctactcaagggcaatcagaacagaatgcatggagtgtacttgagaggattatgcaagccatacaaaaaaatcatcaatagagagcaaaagcctcactggtccgtgaagttttaaccctacttctgaccacaaactgattgaacaataagccattctgatggaggagtgactaccaggaatataggcttaaaaataaaataaaagcagtaattattggctgccttgaaaaatttgtgcatgagcaaaacttcaatgtctcagaaattttcacaagggaatctataagcttttagttctgggttgaccatacagcaaaaaaaaagaaaaaagaaaaaaaaattatctctcagagctgtaaaaacagccttttctcctcaaatcactctcacattcaaggcttaaaggcagaaatccaactggcaaaggggatttgggcacaatatttgacccataaatgtttatatcaatccagggactacttctagacaatagcccttggaatgatgcaagcatttattagtcaaagattggctaaaagaccgtaaaaagggtaacaaatacaaggaaggatgtcaggagctacacaacacagggtaaacagactttatggaattagtaccaccaggtcactaagaaagtaaacaaatagtcaagcaggtaacagtaaccctctggatcagtgagtagaggtgggatcagtctcaataatgactcaatgtaagacctaatattttctattttcaatgataataacagcaacaaaagtgtgacgagtgcacggggaaaaaatgcaggcaataggtatggcctttgaagaaattcaaacattaggttcagcagaaaaaacttcaaagcagatattatagatatgttcaaataattaaagtcaatgatgcttagagaagtaaaggaagacttgatagtaatgtcttacaaaatatatgctatcaataaagagaggaaaattataaaaaagagccaaatgaaaattttggagttaaaaatatacagcaactaaatgaaaaattcactagatgttgttatcagtaggtttgaggtggctgaagaaataatcagtaaagttgaggctaagagactatacaatctcttagattagagaataaatagaaataaacagagcttcagagaaatgcggtataccagtaagtgttgcaacatgatatgagtataactagaggagtacagggagggacagaaaaatattcgaagaaataaagactgaaaacttgccaaatttgggaaaaaatcttaacacatccaagaagcacaatgaacactaggtagaataaatgcacagacccacactcagatacactaaagtcatattgttaaaaaaaaaaaaagctaggtggggcatggtcgctcatgcctgtaaccccaatgctttgggaggacaaggtgggtggattgcttgagctcaagagttaaagaccagccagggtaacatggtgaaaacttgtcactacaaaatattagctgggtgtggtgtcatacacctgtagctactcaggaggctggagtgggacaattgattgagcccaggaggtcaaggctgcagtaagccatgatcataccactgaactccagcctgggtgaaagagaaaaaccttgtctcaaaaaaaaaaagggaaagaataaatagctaaattctaattgcatacatttgagccagaaggatgacatattcaaagtgctgaaaaaagaaatatgtgatcaaaaacttagtatctagcaaagctctttcaaaagatgaaggcaaaataaagacatccttatgtaaacaaaaatgaaataactggctggcagctgacctgccttataaaatatgttggaggaaattcttcagactgaaattaagtgattaagtgattctgagcagtcactcaaatccaaataagaagcaaagagtcatggaaaagttaattatttatagaattacaaaatagagtgtagtggcacatatatttttccctccttttctcagctaatttaggtaattgcataaatctatattttctagtttcttcatgattttcatatttgacaagaatgtatgttacatcattagaatccattttaatttttaaggcttgttttatggtctaacacatagtctgttctggagaatagtctacatacattacatgttgagatgaaagtataatctgctgttggataaaatgttctacaaatgtctgtttggtctagtttgtttataatgttgctccagtcttcattttcttgtcaatcttcagcataattctacccattaataaaagtagggtatgaagattttcaactactattattgaataattgtttctttattttatagtctactttgatattcatatagccactttagctcctttataattttttgttttggtttatatttttcattcctttaactttaaacttgtgcatctctgagtctagaatgtgtcccctgtaaaccacaagtaattgaatcaactcacttttgattggattgtttaatatattcatttgtaatattattatttttgtggttgaatttacatctgccattttgcttcttttattctttttgaatttttcctttttctgtcttttgtttatttcctattttattgttaagaggatattttctaaagttaaattttattccatttaataacttttatttatatactggttattttcctagtggttgctctagattttgcaacatgcatcccatcaggatctacctcagatttacagtgattgaagtccactgaaattaaaatctttactcctggataactctactccattcctctctcttttgatgctagtgagatatatatgtagcataaacttttataagtttgttatgattatttcttcatataatcttatgtgcatacatttttgaaaaacaaaaccaaagttggagaactcatacttcctaactgtaagacttactacaatgttacagtactaaacaaagtgatgtactgtcatgagtatagacacacagattaatggaatggaattataaatttataaataagccttagtatttatggtaaattaattgttgacaagggtgtcaaaaatagcttttcaacaaatagtgctagtacaaccggatatgcacatgcaataaaatgacattggacccctatcaaaccatacataaaagttagctcaaatggattatatacctaaatatgtatgagttaaaaccacaaaactcttacaggaaaaaataggtgtatgtcttcatggccttggattagccaatgatttcttaaatataaaaccaaaattacaatcaatggaataaaatatacataaacatatataaactctatttcatgaaaattaaaaacccttatgctacaaatattaacattaactaagtcaaaaggaaaaatacagaatggaaaaaaatttgaatgccttaaatctgataagggacttctacccagaatttacaaagaattatcagaactcaataataaaaagacatataatccaattaaaaatgggaaagaggtttgaatagacatttcaacaaagaccatatacaatggccaaaagcagagcaaagattaatgaatagggaaatgaaactcaagacaatgctgaaaaatagcttcatatccactagcatggttgtattcaaaagcacataataacttgtgtgctccatgtagagaaattagaatattcatgccttattggtgggaatgtaaaagattacaggttctttaagaaacaaatttttcactttctcaaaattttcaacatatgacccatgaatttcacttctacttatatattaaagagaagtgaaaacacactcccacacaaaagctgtatacaaatgttcaaagcagcattattcatgataaccaaagaatggaaacaatccatgtgcctttcaactgatgaatggataaataaagtgttgactaaccatataatggaatcttatttgttaataaaaaatgaataattacaaatgactatatcataggattctatttttataaaatgtttacaataggcaaatctataagacagaaagtagactggtggtttcttacaggtaggggtagggtgaggttcaaagggatgtgaagtggctgcaaatgggctgaatattttggggaggaggaaaaataattttagatttgctttcagtgatgattgcacacacgtgaacttactaaaaactttggcttgtacattttaaatgggtgaattgtatatgagttatatctcaataaaacttaaagacataaatcacagatttctcagcagaaatcccatcaaccagaagatcatgaaaaaaaaattcaaagaaatgtgatccaaaaaataaataagcacaaatgcgtgtgcgtgcgcgtgcacacacacagacatagacacaggcctggcttacttttttataaataataacacagctttgatgaatttatcattagtaatgataatatgatttcataaaatttcagccattaaaatgtttatttccttgtaaaacatttttatattgaaaataaaatatttttaaaactaaatttaacacacacacagaattagacaattaagtaactacactgtagaaaataggaaccacgtttttaatggccagagaaagactttacaaataatcaagtgaggagggaaatacaaaccttgtgctgatgaatttaattagagatattagtttgaattcattttaattttagcatataagaatagctaggaaaatatagacagaagtatatacatgggtatacacatatatgtctatacatactatatatgggcttatatatggtaatcatacaatggaaaactgatatgaaaaagccaaatgtgaaagacgaataatcttaatatattgttttaaactaatgtttcaattattattgactgctttcataattggctaggttttgaaaaggtcaggtaaataaaattaaacaatatctgcataactttccattgattttagtaagctaatttgttttatgagtctccacaaaataggcaaaatatgtagtttagctggatttatttaaccacagaatacttttggggacaatttttaatgggaaagtgttctgtagaaaatgacaggctagaacaaatgaatttaaataaaatattaaatggaaaaaattaaaggaggtaataaaatatcagaatacatcattttacatgtaattttttctttgagacagcatcttgctttgtcacccaggctgaagtacagtgctgcaatcatcactggctgtagcccagacctccaggtctcaagagattctcccacctcagcctcctgagtagctaggactacaggtgcacaccatgacgcctggctgatttttttttttaattttttgtagagacaaggtctcactatgttgtccatgcttgaactcttgagcataagcaatcctcttgccttggcctcacaaagtgttaggattacaagcatcagccaccgcgtctggctgaaaagaggtactttttaaaaacctttgatttcgagttggcttggcttacttttctgtaagtaataacacagctttgatgacttgatcattaataatgataatacaatttcataaaatttcagccattaaaatgtttatttccttgggaaaacatttttatattgaaaataaaatatttttaaaactaaaattaacagcatttaaatcaaaagagcaaaccaatagaagatataaaacagtgtttctgaatgctcaaccaaagttatttctgggaaaagacttagtttgagtgttctgaaacccattttgtaagaatctttctctctgaatgttgcctcgtctttcacactacttgaattcatttatttcacataaactcacatcacatatctggcaagatgattctatctacacatagataaatgtaagtggaaagatgtgaaatggaaaagtgaactctcttcaaattctatcacgttcaaaatgtataagattagctggcaatttctagaatcttgtgatttaaattcttttacctacggatatgtataaatctgttgggtttagcctatatctactcttaagtgcagcttcattaatgtttatgcttttgaagaataaaatggattccaaagattccatgttccttattcaaatgtaaaatgactgggcaattgaagaatgcaattatctccaccaaaatgtttctaaacatctttaagaaggttgagttattatattttaaagtcgaaattacatttaagtttcgttctgtgtctcaatgactcattgcagatttataattgatgaaaatgtctacaaaggcatggggtatttgattctgcatgatacttgaacctagatagcttctgataaagtgaaaagacttctgcagaatataaaattagtgtgcttgtaaaatgacttgaaattccacagtatagctgcacccaacaaaagcaaatcaagcatccacattttataaagtgtgttcacttatttcaaataaaaaactgttcaagtgacctacttttcatcaagacactttaaaatgagaaatgaagcacataaacatggcaccatgtgtctgatatctcctgaagtgacaaatgaattctgattacacataacctcattgttcaatactcaattgtatctttgaacaatgaaaactgagtcatactatgccaagtatgaaatatgctcagtactatataagtagcagctatagtagatgattgctatcttcataatgaacctgcacctgaaccttaaagcagaaactgacagtgacctttgtgatagacaggattttaaaatagcctcccaaactcctatcccttgctatgcatgctacataatggcctcatgagtttggataggctatcttgaagaccccatacagaacgggatgcagatgttacagatagaaatcagagcaattcaaagctgcaacaaataccatcctgttgactttaaaggagtaaactgccatgtttgctcagggccagatggcagggaatggtaggtatcctctaggagttgaaaaattatgtctagttgacagctagcaagacattgagggctttggtcactgttttgatgcctgtcaactggagaaaatgtttgacttttccaaacaattggtgagattggcagagtactgaattttcacataattttcatatgcatccatagcaatcttgatttcttcttggtgagacactgagcaggggaaatagcttatccaaacccagactcctgacctacacaaatgaagcaataataactacatgttttaagttgctaaatttgtggtaatttgacagtaacagaaaactaatacaattttcatatgatctttcataggatttgagaaaaatacatttgaatacaaaaacaaaatgctatcaaccatcctaaaataattgtaaaggagcaatttaaactatcttctttttatagactctccctacacacacacacacacacacacacacacacacacacacacacacacacaaataatgttgcatctctcaccatgtctcattattctaggtttcttattcttcattctaaaaatgaaatcttaatcagttttcttagatgtctttgtacattcttttaaaattcttatacaatttttttaattgtcaagatcaaaccctgactcagctaaaatagatgaaaggttatccaattaaacatacatcccctagtatttgtaggaaagtagcctaaaaaaaattccatgttgacatgtaatttgtatgtctgttcaatttgcaatgttttaaatagcaagttaaaataaaactcttctaagtttaacttgaagtacaatattaaaatgtatgatttaaattaataaaattatatttatttggtaacagttccttttagaataaaagatttcaaatatcatataaaataggctaagtaaatgtgaaagatgtttttgaaatctacttaatgcatcgaaataattaggtaatttttattgtgtgaatataaaaatgcacaccttttgtaaattatgagatacttgctttccatcaggtgcaaaaagagtttacaaaatgtaatatctaagataaatatgttagctaaaaagagtcatatgaaattatgaattttataatagtcagaaaagaaattgttaatggtgattatgggaacagtatcttaaagttgaatatagtttaatacatcagataagaacagcagaattctggtaaatgactaaggaaacaggtatcttaaagaatgtattaggatgtatgatattttaaaatttcctatagttgcaccaattactttaggataaatttgaccaaagtattgaaattcaaaagaagatttaaatatgaaggactaagtcagttgaagcaattacatgaaacagtatattatcttattttttagatttaaattgattagcatatttaacttttacatgaggcagtcagagggctaaagagattgtcagaatacaagaaagttttacaaatttcctattgagtgttgaagtaattataaaattctctggagcaacatttctctacctgtaatatgaatatgtgtctcccaggaatcttattaaaatgaaaatactaattcagtgggactagaacagagacccaaattcttcagttctaactagctcccaagtgatgacaatgctgctggtctattgatctcacatagaatagtgagaccctgatcatccatatggaattatggacagaaatctgtgtctacactacctaatatttctgacatctttgggcaacccatgtgaacttaggtaaaaggtgaaatatttgagtgcatataaagttagaatgctgtctgtagtaaattttgcttctatgacttttaacccaaatacatataatacatatttgttaatatttcacaaatatatattgattagttgactctttatatgacacagtgcctcaatgcatttcaaagtgacattgatcttgtgatcaaaattaacaacagttggacattttaatgggttgaagtccctaaggagatatgttaaagtcctaatctttaatacctgcagatgtgaccttatttgaaaacaggatctttgcagatgtggtcaagttaagatgaggtcattagagtgggccctgatcaaatataacttctgtccttttaagaagagaagacagagacacacaaggaaaagactgccacataatggcagaggcagggattgcaatgatacatctgcaagccagggaacactcctggggtacctgaagctgagagaggaaaggagggatccacctcaaaggctttaaagggagtgtagccttgagaacaacttgattttggacttttagcctccagaactgtgagagattaaattgctcttgttttaagccaccgaatttatattaatttgttatggaagtcctaggaaactaataaaattattaatcatatctggggactatttaaaaatcattcaaataatagcattggatagtgattatgtatttgctaatttcctctattatgatgtatttattaattttatctgtaataagaaaaacaattgttgaggtagtgaagtaaatgcaagccaagaaatgagataataccccttgatggttatatagtgttttagaaaataaaagttattttaataaattaattatttcctctgaaatcttaaagctgccaagttagattaggtgaatcagaaagtgcaattatgccaactataagttacaagtttggagtagttatgtcatttgtgcaaataataaatggtagcaataaactaacagaatctcagtgaagaggcattgtttaaagcacctgtgaattgcatggtgaaatggacagtaccatggtcaagattaaaatcaatctcttgtttatcaattaatcagtaattccatcatccacactaactttgtacttgacatattaaaggaacattaatgaaaaaacaatcttttaacaaggcaacttactatatagccaaatttttaaaaatatttaaaaatgttttttttcttatgtaatttctttacatccttcccacttgcaggtctttgtaactatgtgtgatacctagaccaaaacttttgcaataaaaattcattcacatgtaagaaaaccctctcctaagtaaaaattaattttaagcagtgactaccttactatttttcctacctgccttgaaacatcagggctttattacttctccttatggaactgccattccagcctcatattgcacgtcatttccaatctctttctgtcccacttgtattgctctttatgccgtgcctactaaatacaatgcttcctttagttacagtgtcattgacacatgctgttccattggcagtaacagcccttctcatcctctttgcccagagagcaccctttcaagcttagaaccccaccaatcatattttcttgaaaaaagcttccatcaattttctgaattaatgaaatacttctagtatacactatcatgatcacacgcatatctccatcataacctggatgtcacgttggagtgtcatatttattatcagataaaaatatgtcttattgcgcagtgataaagtttgttttcacacttcctttttaaccttaagacttaaaagagtgcttgaaactttagtaaacagtcagtcggtattttctgagtcaagggatagaggattgctggtgaaataatgcctggactctattctaggctctaacagtaattgggctgattgttagattggtcaaactatctttcctttttgagtctcaattttcttatccttaatgtggttataaataaaggatgtgatatgaaagcgtagtgcattggctaaaatgtagtacacaccaaaaatttatttatacttgttattcttttttttcgtgttttgaagaacaaatagttccaatattaagaaacagattctcagtaggttaatttttaataaattaactgcttatcaaaatgtaacctaactgtgcaaaataaatttctgaaggagcacttttatgtgtgacaaattaaacattaatagcaaaacaacatatattttcctaaattatacagattaactcattcattagtttttataggaaaccatgcctcaaatatgaaagacatcttataaaaatacagtaactagttttgaattattaattcattaaacacatatatttaatgcttattatgagttaagttctaggtttcagagtgggactatctgaattctacactgtttcctcaatacaattacaaagttttacaattaacaaagataaacaacggttttcataaattgtaataatcttatatatgcataatttgaattaaattttaaataaactaagtttctaattttaaaattaagttttattaattaaaataaatttaaatataaaataaatattctaaatagctaaataatttaaaattatattgtattaattaaaatatatttaaatatatggaatgtttattttgatgtgatggaatctttatttattttatgttgataataaaatttaattaattacattgaagtcttagattttcatacaatctgaaatgtagcataggaagccagaggacaacattgaagataattttaaactattggtaatattgtgagaataaaacatcatttatatgagtattagaaatagtataatgacctcccaaaaagataatcagataataagcatatgaaaaggtgctccatatcatatgtcatcagggaaatgcaaattgaaacaagaaaccaccacacacttatgaaaattaccacaatccagaacactgaaaacaccaaatcttgtcaaggagtaaaaggaattatcattcatagcaaaatggtacagccatgttggagattctctggcaactgtttacataactaaatatatttttactgtatgattccgcgaccaaggaccttggtatttatccaaagaagccaatctgagaaggctacatactctatgattccaactgtgtgacttctagaatagacaaaactatacagaatgtaaaaggatcaggggacttaggcaaaagcaaggaatgagtaggtggaggacagagtatttttagggcagggaaacaactctgtatgactataatgatgaatacatgttatacctttgtttgaacctatagaatttagaacaccaaatgtcaaccctaacgtaaactatgcattccggatgctaatgacatataattgtagattcatcaattgtaaaattaaaaaaaaattaaaagcaccactcaggtgaggaatgttgataataggaaaagctatgcaaatgtggggcaggtgttacatgagaaatctcaattttgctataaatctaaaactgctctaaaaataaagttaattatttgaaaatatgttggatatatttcattatttttaaaaataactaaaaagtgctcacatattgtaaatgaggtctcaaagacaaaaactgtaaatatgtcatttaaaatttggtaaagtgtttaaaataaaaaattctaaagttaagacatttaggtttaattaccagtacatccataactgactatgtgactttaggaagtaatttagcttttctaagcttcatttctcatcatataaaaaaacgaagaagtagaatttttctcaacaactagaatgaaaagaaaaaaattcacccaaatacatatcaaatggtaacagcatacaataatgaataatagaggctattactaatgaaaaacattacatcaggtaatattttcatattatactgttatttttatatctgtattgtatcttacatacaacataattcaacaaatattttctgttttatcattcagaaaataaatacatagatataatgcatacatttaaatgagttccttttggaaacaaaattatttactgagaaatactaggaaaattcaaatcaaaatatgcactttagtgctttagttcttaaattagacaaaatatttttaatttcaagcatgtcaaactatgttttgtagcgtattaacaaataggagtttgtcataagagctaatttcagggctttacaatgttctgacttgcattggaaacttttctgaaggcaagttttttgtttttgtttttgtttttgtttttctagagaacactttgatatgaactaatgagaagacacaggaaatgtttgaatacttatacaaaaatctatactgcagtagaaggtttatacaagagttagggcttaaaattaatctggaaatacatcttgacaattaattttagtaatattaattagtggtgtaagcaattaagagctattaaagataagtgaaagtaactatgatcttagatatttattattgacatttaactgaaattagagttcatagtaatttggaaaataaagatattgggagaataccataaggtatgataacctggattctttaagaaaataataagactaatataaaataattttaagggaattagtagacaaggacatggtgattttgtgacaacagccaaagaataaaaatacacagatgactcaaaaatcttgagctggacagattcacaatgatagacaatatatggaaggtaggagtccatgtcttaggtaaagtctgtcatctaagttagacctgaggagtctgcaatggcaggagaatttaaattcagtttatttttacatttcattcattcaacaaacatgtatcaggcaatgttgtaagagatgctagttatagtcatcagcaagactagcacaatctattccttcaaaagttttatatcctacctaaaatgacagttataaaattaacaattatgcaattagttattgaatcccatatgataaacatgtcttaagagaattctgtcctgtaggaagacttccttgaggaagtgacattttagctgaacctccaggtggcttttaactaagtaaagagattgaaaaataagtacaaaaacaagaagaaaagaggcattaaattaggattagaatgtaaatgatgtcagattattcagacaccttagactatgcttagattttggtcattaacatgaaaatgttgtaaaaatagcatgaaagactttaaacacatgaatgatacaagaatgatgacactgacatcagattgattctagtgcaaagacagattagaggtagaaaatgagtgtggggataccatttaataatctaatgtgtccctccaggagaaagatgaaggtgtcttggcctagataactaagtagatggtggtacattctttgattggatggacactggagaagacatagtttagaaggaaatctgcttgttgtaagtatgtaatgtgttgagtattagatttctgggaagtaccaaggaagctattgaatagatagctatagctcagaatgtaataacataatgcaagacataacacaaggcttctcacgtgtctaaagttggataatactatttgtgtgtgtgggaactctgtcatctacctagaagagacaaatgaagctatgtgagtagagagctacataagaaagtgtatttgattggaataccaaagggttcacaactgaaccatttcaaggctcaaaaagaaaagtcagatgacgaaggtgataaggtaactagaagaggtatcgaggaggaacaaacagggtaatattttgaaaactcgacactttattcaaggctataatttttattcccgggagagtgtataatttatagaagtgtatatggcaagtttctgaatccttcagcatgtgcatatacagaatataatatctcacatacactttgatattgttttagagctatttcttagtggtgtctagttctcaatttcataatacattttttaaccccaaatcaaatagatttattttattttgcatagtaacaagcaaaattttgcaaactataataatggctacaattttctgaaagctgattgaatattcagtgactttaaagattaacacatgaaatagtaacatagctcataaaaaacgtggaatatttgttaaattaagattatatataggtatatacatataattactttttaaaatagaatttaaaaaatcaaccacagcatctataaattttaaaatgtaacaataattttatcttgaaattgcataagatcaaagccacataatttttataaaaaaaatctcactcaacaggttatagtggagattaaatgaaaaaagcgcatgcaaagcatttgccatgtatcaggcaaataaacattcaacaagtattaatttctatcacaatcataaaatatgtggctacttttagataatataatgcacagtaattcttgggaggtaagtggctgtcatctacatctgcatgaacatgcacatacacacacatatgcacacacacatacacatacacaaacacacacacgcacacatacacacacataaactagctgagtgcagatatgtttggaaaccactggattctatatcctttcttaaagtattataatctaagctataaaatcaatgttacaaaaataaaaataaagaaacccaagtaacttgagttttcttttcttttctttttaattttttaatttttttaaaatttgagatggagtttcactcttgtcgcccaagctggagtgcaatggcgtgatctcccatttgaatataaacactttcatatagcataattgggaaaaactggtccagaaagtgaccaatttgggtctttatgaatttgaatgattcgtataatttgacatcttaataactcagggtccacaaatatctaaatactaaagcttagtcacagaaaagataatggttcgttgtgtggaatccttcagatttagacatgagcaatagctgaggtgtttttcttaaccatgatcaatttaagagatccaaattaaaattattctggctaattaaaaaaacatgtaatcattgtgccacttttcagagataaaaataacctaaggtatatctacatgtataaactgaggtataatatcagaacttgtaacttgagtgattttgataatcaaactggacaaatgttaccctacttattttagaaaaaacatcccggacacttatttaggattttattttttgaaaattttttaaaattagattttattatgacttggtggggtagaccacaattaaagtgggatacattttacatgttttggctctaccataaattttagcatgacttaagaaaataacagaaatgcatacatgcctgcattctgtaaggactgtgctatcctttggttcaatgaaattagcatgggaagagagcagttccatttttttaccctttcatatattctattagaaatcattttttccaaactaagaaactaacacaagaatcctatgtggctatcaattgaaatcagtacagatttcacttcggttagtttaaaaagcattgctacatttttagataagcagtgaaactgaaataaaaagtttctcagagaagatatttctaaatgaagttagatcacgtcagtgtgtttaactcacagttttatgtgggcttcaattagacatagaatgtataaacctgcagatgagattaaccatacacataactttgagttacttttctatgtaacttctttgaacataacttcagattttaaaagttgacatagaatttccaaagttgtgagctttctaaactggttggggaaaattgtattgaacttttattcaaaagttatttatattgaatattttactttatttcaaaagaatattaggtactgcactatactgtatacagggtagtataataaaattaataactataataaagaaatcaggtaaagtgagaagttgtattgtattgtattatgtgatcaggataaaagctaggaagcaaaactgctgtcaaattttcctacataaaggtagctgaatattacaagttcaaatgtcaggtccaaataaccaaagcaaagcaaagcaaaacaaaacaaaacaaaaaaaaatatttttatttcataacacaaaagctgaaaatacataaaatacacttaatatactattgtgttagtaaccttgatgcaaatacatgacagacagtcagagaaagcaattacttaagaaattggagtaaggcaaagagagataagtccaaccaatctgtcgaggtatgcacacatccaaacgtctgggctgattcggaaataaaatcaaggatcaagaacaatgatctgaaatgccctcagaagattttaggatatagtaaatagtaaatgtataaaattccctgctgcaatacagtgttgaaaggtgaagactgtaacaaatattacagcacatagttcgctgttaaaaacaataaacactgggtgtccaaaaccaaaacctaaaaacgaaatcgaaaccaagcagatgtggaaggaaaatgatgctctcagacttacagcattctcctgtatccagatattcagaggaatatctggggtataactcaaaaaagaattcaaggttatagttactaatcaaattccttagtctacatatattctgtttttcaattaggggagaatcctccacttagcaatgtacatgtgatttatacggctgtcccattaaattaattgtaccaattgagaacaatttacacaaatgttttacggaaccatcatcgaaattaatatgtcatgatatatattaccttttgtttttccctacataccttctcaaatttccccacattcagtttgataaggactttggcagcaatctacatttaattttaaacttgcagaaaattgggttctaaacgtgtaagttatacgtcagcaacaaagcattatttatgattcttaagaaacaactgtgactttgagtcacaaatcatagagctattgaaactcccagctggaaggaaccttggagacaatctaaccgttttattcatgaagaaatagctaactagagatcaagaaattgacaaatggctttgcagtttaatagtgaaggcaggattagaactcgagtctcctgactccaaaatgaaaacttcaccactatcttccactatgacttttgcttctcataatatataacagattaacaacagagacttttttttgtattgtggtctgctagatatgtgttaaaaggttctactgaactgaatatattaactctaaaaaatgttggttttctcttatagtaagttatcacaatgttgatagtgttttaataactgcaatatgttttttgaatatttggatgggaaaaagacaaattttttcttcatacggtagaatcacatattgatttggaataacatactcctaaagtcaaaaccaaattattagtacttttttcccccgaatttagttatttaatatttcaggtaaatttataaagggattgtgaaagtatggaatgtgggagtgtggaatttacaaagaataatttcagaaaagcaatagtgtaaagtcactagctaacgtgtttttctccctttattgtttaaaaaaaagtttctaaacctcaaatatttcaataacttgtgtcctaatcttaaaagtccatcttcttactggaagatttgatgaactaacttctgctaagtatagattcaggtgtttccttgtttgttctggtaatttagcttttaaaatttatgtattcttgtaaaaaactgtttaaaattcaaaagtaaaaataacagagaatagtggaaaataatttttccttctgctgagacctcaaactaattatcctccttgtatcaaacactgatttaggtttttgattatacttttagaaatattttatgcacttataagcatatgtattcatttattttatatatatacatacacatatatactatatatataatatatatacatacacacacacacttgagataggatcttactctttctacaggctggagtgcagtggagtgatcgtggcttactaaagcctcaatctcctgggttcaagtgatcctccatgtcaacctcccaagtagctgggaccacagacatgcaccaacatgagtggctaatttgttttttttgtttgtttgtttgtttttttttttagagatacaggtctttcccagggtggtctcaaactcctgagctcaaccagtcctcccaactcagccttccaaagtggtgggattacaggcatgagtcaccacacgtcttattttatatgttaaagaaagcattcactaatattctgtccttaatatttattgtaccaaaagccactttggaaagaaaaaagtctgatctatcctttttggtaacagatactaagtttctttgtcatattttaacaagtctatatgtgctcctgattaccttgtatgtgcaaggtaatgtaagacatacagaaaaaaatcaggcacagtgaccaccatagagaagaacactgacaaaacctgatatcgttcttaattctatttccaaaagtattaccaaaacactggtttgatactaggagaccctctgttctcacacattttcttctgacattaaaataaaaatgccatttggacaaaatttactaaatgttttgggatttagctacatgtttctaaaattgttgttgcttattttttttactaggtttgttgaagacttaaaaactaattttgataatattcatatggcaaataagcagtctgatgtatttctctcctccttaatgcaaagctcctctaataaagcaatctcttttattaagcccaaattcaaaatcttagttgattcagttatgtattcgctatttgtatgttcatgagaatcatacagaagcttagaaatgatattattattatctagagtagactgactataaaatattaattcccttactcaagtaaagaatgtagccaaataaatgccactcatacattttcattggcgattgaaatccctatttcagtgactatttcagtggctattcttaaggagatttggagagagggcttacactacactaacttgtggttagtgttcttattaatgcctaatatcagaactctttctgaaggggaaaaacattttgataagtgttgaaaagtgttccattaaagtaaacaaactttaataagatgcaattaaagaggtgctggaaacgagaggtattaactttacctaaaactagtccattttcttaaatcaaaatggtgtttatgagaatactgactcgtggaaatttaaataatgtcttgctataaaaagtttgagaatagttaaaccctgttagactggctactttatttccatatttgcaatttaatttaataaagctattttgcactgtatcctctataatcaggattagtattttccaaactaatttaagaattattttgttattctagggtgtcttgtgggattaacgctcctagaatgcacttccacacagtgtttttagctactaaaaacctggattttagctacagtatcatgccgtgggcaaataatgcatggtaccctgagggcttcaactgtgatttttatggaccatctctctttgcctaggtcaatgactaacaggtatttgagaattcttccagtgaacctaggggagaaaattgttggtttacccttgctcagataccacagagagccttttattttaagaaccttggcaccttttgtaaatacaattggcagttggaagaatgaagtgtattaaatgtaaagattgttttctagccacaggggtctaggccaagccactggaaggattagtatatcatatttcttcagacatttgcttcagtgttttatcattctcagtcacttgctttcccaaagcagaaagaacagaaggagaagtaattaaatacaatttcttcctcctctacaggaaaccaagatgacaatggcaatttgttaccttctggaaataaaggagcaattaagggagaaataaatcttcaaggattttcctaaatctttaactcgttttacagcagcctattaccaagtgctactgtgtatattggcttcatttggaacattgtcttacctatatttgacacttaataactttggtgattaattgattgactgaacaaccactggcaaaaagagtaataagacgtaaaaagtaatcgttgagcacattttaagacaacgtgattaatgttctttgtagaaacttaagaggatccaacagtccacattcatagaaatattgtaagaaacagatgaaataaagatttatgaaaaggctagtgttttctgtattcaggctcttacttagttacctaggtgtatgtagtgtgtccctgcctcattgatgacatcaaaactgcattcttgtactcagttctgctaataaaacctaaacttgttttgctctgtctgaaacttgatcttggtcatctatgtagtattctctagtattgattatgccttttttgcttatctacctttctttcaattagagttcatggttagaatattacatcatattaaagatattttttaaaattaaatgaaatacatgtcagaaatgcttggttataaacacacaattacatcacaggtgataaaacggataatgttggaacaatgtacataagttatttaatatttggggtttatatgttgtgaaatttaatcacaaataagcatttaattataataacctatatactttttattaaaactttatttttatattgatataaagatgtagaaataatagtagctataactcttgctgtttcttggtattttctgagtatccttttcatatttgtacaagcaaaggacatttagactgcaattattgctaactatatattagcaccaaacactactatttttgagaatactttatgagaagctatcttttgtagccaccttcctaatcttctacttcaattacacttttaaaaaggtgtaccaaacatcaaaatatttacatttcacatctcagatgcaaaattttatcttattttctttaaaccaagatactcaacgagtagactagagatccatggggctggttggcatctttttgaggagtcttcaaaggcaaaacaatttctaaatattaataagatttttttttacccactaccattctctcatgagtatatagtcacaattttctaaggatttagaatgtgtgaagatttcatataataaaacattttaatatatgaatacctacataacacagtgactaatattttccaaatgacagatgcatgatgttacaaagtcattcaaggtaagagatgccatcaaattacaagattgaagcgtgcatttttggaaacaatacaaaaagtttttgttaagtggtttcagatttctcattgaagctacctttaagaaactaccacttgatgagatttggtatagtattgtagaggtcaagaaaaaacttcccttttgttctccgaaagtttgctgaaaatcactggcaaaaggcagattaacaggagaaaaggcctacaaatttattaacatgtacctgggagcctttagaatgaaaatctaaagatacatgggaaattgtgcattttaatgattgggttcggcaaagcgtagacagccgtgtaaaaatatgattagacataaaaagcgtaatcaaatgttaacagactgagtggggaaacccagcaatacttgcctatctagattcttcttgtcctctctgagcacgtattgtgtccctctgggtatgggacaggaccttttgataagggttttatgaactacagtcaaacaaagaaggtcaaataatttctttatgaccagtttttacacagaaaggcagagggaaagttagaataatatttttaagttttatggctggctatggggaaatggagttgccatttctattacctgcttagagaaagagagattgtactttctactctagcttaggtggacaataggactgacaggcaggagagcaggagaaggtcagagaaaagttttggcttctgaggcaaaatatatatagatagatagatagatagattttttttttttttttttttgagatggagtcccactctgtcacccgggctggagtgcagtggtgcgatctcggctcactgcaacttccgccttcatgttcaagtgattctcctgcctaagcctcctgagtagctgggattacagaagctcgccaccacaccaggctaatttttgtgtttttaatagagacggggtttcatcatgttggccaggctggtctcaaactcctgacctcaagtgatctgccttccaaagtgctaggattacaggcatgagccactgcgcgtggccggggcattgtttttgagtcccaacagcacctgagaataatattttctgtttgaaaaggctactaaatacccctttgtatttcaactataaatcttggaaggctacatttatttcccataatccaagaaaaagacttgttgtaaaagattgaatgcagaagcagatgtgagaatctaggtgtctttcattaaggtagattttttcccactattgtttggaaaatattatttttttcattaaactatgctatttatactaataaatagcagatctagtattatctttaaattaattaataagtagttatgaaattcacaatttaagttttcatctagttaatattgatatgtatagcccacataaagaaaagttctttgtggtcctaaataactcttaagaatgaagaaaatatactgtaaccaaaaaggtcgagaaatgccaccttaaaaaaaagtcatcatgcaaatcaagaaattggacacgtgcatatccttattctaatgtggctacttctcttatatttaatccacatgattgtttacattcaagcctttgtggattattactctctgtaaggcttctgtgcatcttcctttcaaaaagaattttcaaaaatatacctttatcctttgttagtttgtgttgtaggaattcagatttccaaagtactgagaaatcttctaattttaagctccacacatatttatgtccctggaaagtatgctttttaatctcattcttcgagaaaattatctctgctttccttattacttggcttctgcatgccttgttttatgcatactttttgatatggtttggctgtgtccccacccaactctcatcttgaattgtagctgccataatccctatgtcttatgggagggacccggtgggagataattgaattgtggacggttcccccccataccgttctcatgacactgaaaaaaatctcacaagatctgatgaacttataaagggaaacccttttgacttggttctcattctctcttgtctgcttccatgtaagatgtgccttttgccttctgccatgatggtgaggcctcccaagccacgtgtaactgtgagctcattaaacctctttttctttgtaaattacccagtctcgagcatgtcttcatcagcagtgtaaaaatggaccaatacacttctttaaccactcatcaatcaaaaactaaagaaaataatttcaaggaggaacacaactcagactgtgtctttctgaatagcaatgtctgcctgattctcccttggagatggcagaagacacttaaaagcatttttttttcctgctagcttcacagcatctgcaaatcacacagttgttactttttaccacccaagtcttctccataaattttagaatcaattggcgagaagaaggatcataggtaataagttcttttatatgaatatttgaccagatgccttgggattcataatacttgatatttagtgctttgtgactgcaagttaagccaaaatttaatacaatcaaatagatcattcaatttaggcaaaaaaatttcagattttttttgtgaatttgatcacatgggctgtgtatttcaaaactgctcctctgtaattttatatcagctaatggagactttatataaactgctaccaactataaaggctcaaatttaaaatgacactaaaaagttaatgattttctccaaaatgagtacagaacagaaaaacaaatcctgtgaatagaaatgacacttataaagaaatataggaataaagctaaattaactcactaaagaactactaagggtatttgaaaaagataaagaatataaataaagaggttgaaaaaaagtaatttaacatgattttagaggtaagagaggttaaaaaaactggtaagtcaaatttaatagtaaaatgttagcaagtccttcaactaacagtttacttgtgaattggtcaacattgatgtttgttgttgtttgcttcttttacttccagaaaaaccaggatgtaaattaacaaatattaaatattttgagcactgaagtcctattagttttcagtattttaggatcaaaaggcacttctaatatatttaacttggaaactctatagttatcttttaatacctgagaaacccgtgacccatgagctccaaagtcaaaatgtggatgcctggcttttactcttactcatagttcattgttctacattttactaaaattatacattggcataaagttttagtaaataaaaaataagctggtagaagaaataaatggacaaaaagtggccaaataaagagaatagtggtttttttacaaaactaaacatgcaactatcatgcgttccagcaattgcacttttgagaatttacctcatagaataataaaacttaagttcatgctaaaacctgtatatagatgtttatcgcagcttatttctagtagcccaaattggtaacaatccatacaagttaatggttacacaagctgtgctacatccctaccatggagtactattcaacaatacaaaggaacatactattaatactgacaaacattatctttttgaccaactctagccaggctcctttgagttctctttcaactagacctaaaccttggcctatgaagatttgagcaaaacagtaacatagtttagtttctaacagctaaagttacatccctaaaatgaccctaactctccttaaatatcacctgagaaaactgaaggctgagagacaggggctaatattaaagacaagttccctgtctcccagtctctgttggaggacaggaacataacttccattagcagcagttaacagactaagatgggtttcacatagaataactctcttctcccactgttgtaatgtttcacttccctaaccctactgagtccctcttccttattctgtcattccctctttaaagtcccaatcacctgtctatacaaattgcatgtcagttcatgctgaactctttttgatattgcaatagtagcttactgattaaaatctatccttgctactttaactcatgtcaggctttgtttatctttgacaatatatctaacagtctggatcatgaacaaagcaggagcactgtcatctcagacaaacaccgccacttttaagttccagctccctttctagcctcatgcatttcaaggaaatcacttctcttctgactacaagcagacagaaagagcagagagtaaaacacagataagacagctggggcacagagggaggttgggggagagtctcttgggtaacttccaaacttcaccctcatacaatgggccccagtaaaacagcgggccttaataaacacatgcctttcccttcagatgcactaagatagggaagctaaaagcagactcaggggatatgcctgcagctgcaggaagatgtatgcagacagacacataactctccctcccagataagcacaacaaagagacacagaagcagtccaagcctctgataaactctcccaccctgaatccttaaaaactcttaatctgggccggggcgtggtggctcatgcctataatttagcacttagggaggccaaggcaggcagaatacgaggtcaggagtttgagaccagcctggccaacatggtgaaaccccgtctctactaaaaatacaaaaaattagcctggcatggtgtcgtgcgcctgtagtcccagctactcaggagcctgaggcagaagaatcacttgaaccagggaagccgagattgcatttaatggagattgcaccactgcactccagcctgggcaacagagtgagatttcgtctcaaaaaaaaaaaaaaaaaaaaaaaacaaactcttagtctgtaagagagtgtggctctgacctaactcagccagctgccccctcaggtttatttaaaataagcctgtccctgttgactgaaaacccacccttcatgtttctctcctctttctttaatttttacagatcaccctccagcgaattatgctgagtgtaaaaaaaaaaaaaaacccaatagattatatactgtaaaattctatttgtataacattcttgaaaagacaagattacagaaatggagaacaaattcgaggtttctgggggttaaagtcaaggtgtgtggggacgggtggaacggaagtaagtgtggttataaaaaggcaagatacacgacccctgtggtgatggaattgtcatgcatcttgactgtatcaaagtcaaagccctagctttgatattctactacagttctgtaagatgttactatggcgaaaactgagtaaagtgtatactatatttttccgtataatttctgtaactttttacaaacatataattaactcaaagaaaaaataaaagtacatttatgtcattagaaaatttatagagctatatatttaaaatgtatgatagattttctccaaaatttattccattatgtgtatctttttttttacaatttcccagttgtgaaattacattaaaagcattgtttctctcaaaagcttttactataaatgtcaagcaacttctttgttgttacttaaaacctaagcatatgatgtatattacctcttgaagaggtaatgcaacatgaaaatgtttaatagatatgtgatattgaatgttacttaacttctctaaacctcttgaatcaagtcagtaacgcgggataaatgtacctaataccataacatacatctttgaggaaagaatgacatgtttataaggcatatatatatgccatatatatacatatatatatatacatatatatggcatatatatataaggcatatatatgtatatatatacacgcaatgtgtatatatatatacacgcaatgtgtatatatatatacacgcaatgtgtatatatatatacacgcaatgtgtatatatatatacacgcaatgtgtatatatatatacacgcaatgtgtatatatatatacacgcaatgtgtatatatatatacacgcaatgtgtatatatatatacacgcaatatgtatatatatatatatacatgcaatgtgtatatatatatatatatatatatacacattgtcacatggcaaaactcaaaactcagtagttacaagtactgtaactactatttataaatgagcttcatttatttgaaaatgaaaatcagactaggaagcaattaatttaccgaattatttcaaaaaattattagctgtgtgtgtgtgtgtatatgtgtgtgtgtgtgtatatatatatgtatatatatttatttatatgtttttattctaggaagaacataaatcattcttattctaggaacagaacataatatttccaatccactaaaagaattctccatagtataatgttaacttgcctaccagtgagcattcaaatgattgagaatgatactttataatctactaacaatctattgcaaatagagtattctgttgtgaaagtattctataaatgaataagagatatatctctctgattactcttctgtattcttttcaagaaaattccagtttgactgagatataattaacaaaatgtgtatatatttaaggtgtatgatgtgatgatttaatacatatatacatcaagctaattaacatattatcaccttacataattattattgtgtgtgtttgtctctgtgtgtgtttgtggtaagaatgcttaagatctactctcagcaaatttcaagtatgcaatacaatattactagctacagtcaccatgctgtatattagactccccagaatttatttgattacaactgtaagtttggaacctctgactaacccccagcccttagcaacaaccattccactctctgtttatttgatgttgtttttagatttcacatagaagtgagatcatatggtatttgtctttctttacctggcttcgttcacttagcataatgtcttttagatttatccatgctgatgcaaatggcaagattttcttctgtttttgactaaataatatgcactgaatatacagatgctcctcaatttatgatagggttatgccccattaaactcatcataaatcaaaagtattttaaagtcagaaatgcatttaatactggcagcacagcaaacggtcttcaacttagaatagttcacattacgatttttttttgttttatgatgatgcaaaagcaatattcagtagaaactatcaattctttgtaagtcataggaggcctggaacttataatagggtcatatccagataaactcatcctaaagtgaaaaattcataagtaaaaccattgtatctaccaaatattctctatttatctgtccacagatactttgattgttttcatatcttggctacagtgaataacactgcagtgaacatgggcgtgcagatatcttgtagagatgcagattttatttacattgggtatagagatgctcctcaatctacaatggtgatacatcacaataaacctatggtaagctgaaaatattgtaagtcaaaactgcatttaatacacctatcccaccgaacatcatagtgtaggatagcctatcttaaatgcagttggaacacttacattagcatggaaggctgggagctggagttcattgctactacccagcatcatgagagagtatcatgtggcatgttgctagctgggaaaatgtcaaaattcaaaatttcaagtatagtctctactgaatgcatattgaattcatatcatggtaaagttacaaaattataagttgaaccatcataagtctgaccagtctgtatatctagaaatagaattgctggatcatgtggtacttctatttttaatttttttaggaacttccatactgttttccacagcagctatgccaatttacattttatccaataatacttaagaattctcttctctgcaaacctttgcaaacatttgttataaattgtctttttgataacagtcattctaacagatgggatatctcactatggttttaattcgcatttccttgatgaatagagatggcgaacacatttttatttgttctatagatccatttttttctatagtgttattcaaatatgctatttccctattgattttctgtctggatgatctatccattgatgaaagtggggcattcaaattccatactgttactgtattgctgtctatttctcctttcagttatgttaatatttgctttatatatgttattgctccaatgttgagggcgtatatacttaaaattattatattctcttaatgattggcctctttatcattatataatgatcttctttgtctcttgtgacagatttgactaaaaatctctttagttttatataagtatagccatgactgctctatttagtttacccatttgcataaaataacattgctaatcccttcactttcagcctatgtgtgtccttaaaccaaagtgagtcttccataggcagaatactattggatgtttttaaattacttatccaccatttcttttgattggagaatttaattcatttgcattaaattactgttaggtaaagatttatgattactattttgttcattgttttttgactgatttgtagtttctttgttcttttctttctcccctgttgtcttaattgtgatttgttgattttttgtagtggtatattttgattccattctaattatcttttgtgtatctacttgagaatttttatttgtgattatcatgagatttacataaaacatagttattacagtctattttaaactgataacaacttcaactttgtctttcacagttttaatgttatgtctcagagtaatcttttttgggttgatccttttttgggatccattagcttcatgaatctgaacattcatattcctcctaagatttggaaattttttttaaataaactttctcccactttttctccctctcctccatcaagaacttccacaaggagtttattcactagtttgttggtgtttcacaggtgtcatatattttcttcatttttttctttcatttttctatttgttcatctaagtagcaattttcttttttaaagtctttaaattaaaaaattaataatatctttatgtataaaccataattgtagaagttctggaatacaatgtgatgttttgataagtgtatataatactgcattcttaaatcaagtaaattaacacgtccatcaccttgcttacctatcgttttttatgaaaatacatctgaaatttactatctttgttattttggaatatataatgcattatagacatttcacagggcgatagacatcaacaccaattatttctgtctatctgaaactttgtactctttgatgaacaacttgtttcctttttttgcaaccccctacccccagcttctggtaaccatgatttaatctctatttccatgagttcaaccttatcagattccatatagaaggcgaatcatgacaatgctaatcaaggtagaaaagttgattaacattgcttaaggccaacatctatacactagtctctattgtagtaacacatgctcaattgcattttttccctacaataatgttttgaggatagtaatgtcatctcctgttataaacaaataaaatttaaacctggatgtagaatcaaagcccacattcttttcactataccctgaacctactaaactgttccagttctacagtctcaggccaacatactctcaattattcttctatgctgccacctaccccaaaacactgctgaaaactggcgtacatgtaaaaaccttttttttttttagcagcatttctaaaaatagctaccttgtaattcaaagctactttcttattctttattaccatgaaattgaaatcagttaaagaacctcctcaccaaatatttagtactgaagaaaaagtatatagagtaaataattcggaaatatcggtttactttgtgggcactattcttctggcccaaggtttttgagttcagaagagatttggtacaaaatgaaaggagagacaagggatggttatatttaagtaaatagctccttcctctgtaattccatagtgccacacttccaatacagtggccaccagtctcttgtagctactaagcccttgaaatgtgggtataagaattggaaagtcttagtatgtaaaagaatgtaaaatatctcattaatggtgttaattataattatacattgaaatgatattttggatatttgacttatgttcttaaatgtattgcacctatttcattttacctttaagaaaccactaacaattttaaaattgcatacatatcttgcaatagatttctcttggtgggtaatttcatactgctttatccatatcacttgtaaatatccatcttattgtaggatgaaatattgcatgtatttgtttctgatacctcagaaagcactgaggtattggagtcattgtccatagcttatttattattcccaaagcacagctgtatgactggcacacagtggacattcaataaatgctcttgaagtggtttttgattagcttcacttttaaaataacaaaataaatttaaacatcaattaaggcaattagttaacttgcatgaaaacattttctaatacaactttacattgttgtttttaaacagatgaaactaaaattttaagtttaattactgacttccattaagtagtaattttatgtgaaatgtctcaacctttgctggattatgcatatgtcctcccattgccactctactacactccattgctttaaaattacttttataaaatgacctagatttagagaaatcattcacccagaaaagaatgcatcacggaactctgaaatgtagagtaggttgatcttagcgcactgtttagaataaaacagaaaggtataggcaagagtaacagatttggatttcagtattgtgaatttttgttacaaaaataaaattacaattcatattgaatattgtaaatatctcagaatttagaaaaacaaatggctttttacagaacattttttattaaaaactgctacaaccatccaagctatgaacaatatgtgaagacacgtttcattccctaggtaagttattctcatcataatttttataatagtgaaagtcactagatagataaataatctgagaatgagcatttattcaaggttgaggcttgtatatattaaacactttaaattgttcacttctcatataaatcatatgttatcaaaatattcattgcaatattcctaaatttttaaagtatttctgcttataaggaagtctacttttggcttacatgtatttcttcttgtaagttgaaagactcttttatttatgacatattaaacaatttcaaactctatctaaacttccaaaacccaaagatatataaactttgcaatttgacagacaatgtaatttttcttgaactgaaatacattcaggaatatagcacgttcttttaaagtattttcattttatggaatcaaagtaactcctaaatctgtcttcataattttactattcatcactgcagaattaaggtgaaatcaataatgtggtggcagcaagtagcacagaagatcagagagaagcaaactgaaactgacacctttagcatttgtgtgactgacagcattctgcaaaatagctaatcatcctgagaagactctatttcatgaaaatgagtcattagattgagagttgtcaggatcaataaatgtgcattttaaatgtatagttaacctaatttcatatgcaatttgtttaaaattatttccttctcagatattcagtatccctcacttaatggtgttactaaattataatgaatgactgtggactggaataggtttttgctactaatagacaagacagtggttgtatttgactaataaattagctattaaactttctaagcattgacttataatagataatcaacacaattctatttttttcatttcatatagtaaaaagtatcattattctgaagtttaagacaaattcatctgtgtatatccaatacgtagaaaacaggatatgcttgataaatctttgtggatttagtggatgggaaaattcaaaatattcttaacatttttagccaaatacttacacagtaatttattttttatttgtcatttaaggttcaactagccccagaatgtaattaatatttccctctgcttccttaatatctggcaaggcttccttttaatacttttttctttagcacaacaccttattgtgagactctttctaccatacaaaatcactgttatacatgagtgctttccatcaagcaatgttttctcattctctactcgagtgcatctttgcaccactctgctattgatttggggtctttgacagactatcacactcaaacaacacaatcaggtttataatttatgcttgtgactgtgtcattaaaacttgtcagtaaatattttcaaacttgccatttcctaattagagattcacaggggaacacttgtagaattcaaaggaatggactttcaacttctcagagtaggtattaggtcacaaaagccatatcattcaaatgaattagacattgctaaaattcttctattattactgctaggttatatttataggcaacgtcatgaagtggcagtacaaatctgtatcagttgtctatacactgcctagctgtttttattatgtataaagaagagctactgtccctggcaagcattgcttaaattagtataaatgtgattggtctatttgcacttcagttgaattaaaggagctagatggaaattttttcctaccttgttaaaatttgcagcagcaagaaaataaagaaagaatgggttaattttataggtgacattgcctctggtgcatgtgtatattcgtttcttatgactgccataacaaagtacaacagattgagtggcttacaaaaagagaaacatattgtctcacagttctggtggctagaaatccaaggttaaggtgtcagccagaatggttccttctgaaggctgtaaggaagaatttgctccatgcctcttgcctaccttctggtgggtcactggtgatcttgtagattgagcttcatcttcatatagcattcttcctatggagtgtctatgtccaaagtactccttttttaaaaaataaaaactccatttatgtagattagggtcgatttactccaggatgacttcatcttaaggaattacatcagtaactacttccaaataaggttatattctgagtttctaggtgtaaggacttcaatatataatattgtaagggactcagttcaaccaataataatatgaaagtatgaatatacatgaattttgttttctttcttattaagtcaaacttaatatcaaatttaatattaaatcaaaaaagagaaagaataaaaacaaaacaaaaatttgacttttatgtatgacttaaatttaatgctttggcaccctaaaagtcctgtcttcagctgttgtgaatgtacatttttaaagtgcatccattattaaaaaataaataaaatatttgatatttcaataataggtattgttttttcttctgacaacaatgaggtagctaatttgcttctttataaaaccaagatacacttctgagtgcttaacaagtgccaagagaagttaataacattttttgtggacagaagagaaagcaagctacactgatattggtctcaactagctgctacctgagtactttagcttttacaaaaatttttttttaattttctcagacaagttctcactctgttgcccaagcagcagggcagtggcacaattgtggctcactctagacttgacctcctgggctcaagtgatcctcccatcttagcctctggagtggctgggactacaggcatgtgccatcacactcagctaattttttattttattatttatttatttatttatttttattatactttaagttttagggtacatgtatacaacgtgcaggtttgttacatatgtatacatgtgccatgttggtgtgctgcacccattaactgctcatttacattaggcatatctcctaatgctatccctcacccctctccacaccccaaaacaggccccagtgtgtgatgttccccttcctgtgtccaagtgttctcattgttcaattcccacctataagtgagaacatgcggtgtttggttttttgcccttgtgatagtttgctgagaatgatggtttctagcttcatccatgtccctacaaaggacatgaactcatcattttttatggctgcatagtattccatggtgtatatgtgccacattttcttaatccagtctttcattgttggacatttgggttggttccaagcctttgctattgtgaatagtgcctcaataagcatacgtgtgcatgtgtctttatagcagcatgatttataatcccttgggtatatacccagtattgagacggctgggtcaaatagtatttctagttctagatccttgaggaatcgccacactgacttccacaatggttgaactagtttacagtcccaccaacagtgtaaaactgttcctatttctccacatcctctccagcatctgttgtttcctgactttttaatgattgccattctaactggtgtgagatggtatctcattgtggtttttatttgcatttctctgatggctagtgatgatgagcattttttcatgtgttttttggctgcataaatgtcttcttttgagaagtgtctgttcatatcctttgcccactttttgatggggttgtttgtttttttcttgtaaatttgtttgagttctttgtagattctggatattagccctttgtcagatgagtagattgcaaaaattttctcccattctgtaggtttcctgctcactctgatggtagtttcttttgctatgcagaagctctttagtttaattagatcccacttgtcaattttggcttttgttgtcattgcttctggtgttttagacatgaagtctttgcccatgcctatgtcctgaatggtattgcctaggctttcttctagggtttttatgggtttaggtctaatatttaagtctttaatccatcttgaattaatttttgatgaagtcctgctatgttgctcaggctagacttgaattccagttctcaataaatcctcctgccttggcctcccaaagtgctgggattataggcatgagtcactgcacctgggcagcaattttaaaaatctattaaattacagtttatttacaaatccatgtgagagatacaagatgcatttgcttttttatcactttacttttaggatcacatatacaggtattagggtgatctgataacttctcctgttctttactaatattggcataaattctgcctttagggattataaataaatatatatatgtgtgtatatatatatatgtgtttgtctgtgagtatatatatatatatatatatatatatatatatatatttgattaccacaaatacatatatgtttttgacagtccctaaaagtgtgccagaattagactttcatgcataaaaataaagagatttgagctttcaatcatggatatgctacgttaatgctcctcaaagtatttacttacaaattagtaggaatgagtgaatcaactctaaaactgacaaagaaatgttatccagagtattttaaagcataaaaaaacaattacctgagtgcaataggagtataacaagtgaagtcacctttattaaaatgagcattgtctcattacttttcatctctttcaatctaatgtcttatttcactatttgtgtataataatgacatatttttaagttcattctttcttataataaggagtctaattcaattttttaaatgtttaactgtcgtcggcttttgagcagaacccctgtatttggcatgtgctgggaattcagagtatgagcaagaaccctcatccctatacaattctctaaccatcattattattcttatccatctcaagttaatttttagctcagttggaagtcctgacactctctccccaaaaagcttcacatatgaattttaaaaaaattcatatactcttgtatatgtgaatgtggcaccattactatgacatctaaaccaaatctttccctcttgtgtacatgacctgagccaaatcttgagtgaggatctattctgattctgtaggatgactatgattttgctttgctcagctatgttctttaaattattagacatctttggatgaatattcttttttacattgttataatgtttaacaaataaaaagtaacaacataagtccctgaattaatagaataaagtttagagaagtgggaaactgttccccatgataaatataaacatcatttattttctttggtttatttttgtcttttgggggcctgaacatcacacaaatgtctttgtggcctatctctggaaaattaattattttaagctatctaaatatatttaattaaattctatgcatagtagaggaagcaggattattttaaaactaattatacataaaattgttgtaggtctggcagtggagctgatggttcttatagctttcaatagtttgtgtacagttattttcaactatacattcagtgatgccatgctggtaacttgttttaggctgaagtggaagtatttgcagcatcacaattgtcaaagtctacaaattagggttgcttttgtttgtttgtttgtttgtttcagcaccgttgtattttacaaatataaatacaggtgaatgattttattttggcttcaacaataatgcctgtctactagttactaactggagtgttttagctatttttaaatttattgaattacaatttgctcacaaatctgcataaaagatgtagtgacaagttcactttcaataggttaatttggtttttatcttcctcattgctacctttaaagcctactggtatgcaagcagtaaaaaagtagactgaggacacattatgatcaagtgttatctatcttatatcaaatctacttgaattcgttagctaggcaacagttttcttcaaacatgtttttcctcataaaaataggtaatcttttacataaatggctcttattaatggctattaaagtagactaaagagctatttaccaatgtgtgaataccatcttgaaaaataaataagaatctctggaagcagaaccccaagatattttaattagaaaccaattctgaaagccacgcatatttttctatgggcaatatgactacccttcatttcttacaactcaaacttgaccttctgaatatccctcattaagaagatatttccttgataagaaaggagagccacatctgtggcagtgactaaaattattgtgcaggaattgtttctggcgagtaattgaataacagatgttgtagccaaattgccagatcattctcacattcatgtcaatgagaaactactaagcacaaagaattattttgcaacatatgacatcaccagattaatcttacgtgtgttaatacagcaagtgatagcatgtcataaagtgtttatatagagacctgtgtaagagatcccttaaaacaattaacatattgaaagaaaaatccttatatctagaaagcagaagtagcagaaaaactattggagactttcaatgaatacgaagaagtgaataaatagattttttttatcaaattaaagatctgatctttgtaagtaattctgttttggaaatttaatgaataaaatatctaaactatgaataacagttgtacatagctatttataattttctaatatttatttatcataaagatataaaaagagaatcaataaagcaaatactacatgactcaagaactacctaatacacaggacatagcatattggtacacaataatttcttaaatttctcatatcgggaaacagtctcttgaggggttaaggcagctgctcatgttgactaaactagtaagaggcataaccagatttaaacctttttcctctaaacatcttaatacttggtgaaacttgtttcacaatcttttctgctttttttccataattaagggtagctatactcagtcgcttcattaattccaacctcatgcagtttatttatttaacaaacattttctgagtgacttctatgtgctgtgataggtgcaatggattcaaaagtgaataaaacaaaatagttttgctcttgttgaacttagaaactagtaatttgaagaagctattattctagtattttaagacttcctaaagccaaacgtaattaagaaaaagtataaacccagatatgctggatgaagcagctttgtgttctggctgcctctgaagccaatgggcagttctagtggtgtaggaggtgacagttaaatgctatagtctttgatagattggtgtcaagatgggaacaggtgtttggctggagaattcctgcacatcaggctgtatacatttctgccagcagggtaaaatatccttaataactctccttcacagaatccatgacagaaataatataaactggaattcctatgaagggaattatgtctagtttataatcttactgtcatgattcaactcatgattgatcatgagctttcaggaagacagaactgaccaccattttgtaactttgacatttctttacagtttctcaggacattaaaatttccaattcctacacatctccttctttgtcagtcactgatcaaatgaacacttgtcaaagtaaattttcaaaaagtaaaacgtccctcaaattagtaatagccatttatgacagacgcacacccaacatcatactgaatgggcaaaagctgaaagcactcgccttgaaaacggcacaaggtaaggatgccctctcttacactcctatttagcatagtattggaattcctgcccagagcaatcacacaagtgaaagaaacaaaaggcatccaaatagaaagttctcttctcaagtcaaactctacctttactgatgacattattgcatatctagaaaactctaaagacttcaccaaggtcttactagaactaataaaaatttttagtaaggtttcaggatacaaatatatgtagaaaaatcagtaacatttctatacactaataatgtccaggctgagtcaaatcaagaacacagtctcatttacaatagccgcaaataaaatgaaatacgtaggaatacagctaatgaagaaggtgaaagatctctataaggagaactataaaacattgatgaaagaaatcaaagatgacataaatgattggaaagacattccatgctcattgaatagaaaaataagtatcattaaaatgatcatactgtccaaagcagtttacagattcaacactatttctattaaactaccaacttaattcttagcagaagtagaaaaagactattctaagatctatatggaaccaaaaaaaaagagcatgaatagtcaaagcaattctaagcaaatagaacaaagctggaggcaccacactacccaacttcaaactataccataaggctatagtaatcaaaacagcatagtattgctacaaaaacagatacatagaccagtggaaccgaatagaaaactcagaaataaagcctcacaattaaaaccacctaatttttggcaaggctgaccaaagcaagcaatggggaatggactccctattcaataattgctgctgaggtaactggctagccatatacagaaggataaaactgaacccttacttttcaccatatacaaaaattaactcaagatggattaaagatttaaagacatcgaattataaaaatcctagaagaaaacctaggaaatacccttctcaacattaatcttggcaaagaatttttggctaagtctctaaaagcaattgcaacaaaaacgaaaattgatgagtgggacctaattaaagtgttttctccgagcaaaagaaactatcatagagtaaacagacaacctaaagaatggcagaagatattcacacgctaggcacctgacaaagtcctaatatccagaatctatagggaacctaaacaaaactagaagcaaaaacaaataacaccattaaaacatgggcaaagtacatgaatagacacttctcaaaagaaaatatacaggtgaccatcaaacatgaaaaaatactcatcatcactaatcaccagagaaatgaaaatcaaaaccacaatgagctatcatctcacaccagtcagaatggctattatgaaaaagttaagaagaaacagatcctggcaatgttgcagagaaaaggaaacatttatacactgttggtgagaatgtagattagttcagccactgtggtaagcagctatttctcaaagaacttaaaaacagagctgcattagacccatcaatcccattactgagtatatattcaaaggaaaataaatcattataccaaaaaccacatgcacttgtataatcatcactgcactattcacaataacaaaaatatgaaatcaagtgaggtgtccatcaacaatggattggataaagaaaatgtgttacatatgcaccatggactactacacagccataaaaaataataaaatcatgtccttcacagccacatggatggagctggaggccataatcctaagccaattaacacagaaacagaaaatgtgtattcacatttataagtgggagctaaacattgagcacacatggacataaacatgggaaaaacagatgctgcggactagtagatggaggaacggagaaagcatgggttgaaaaactacctattgggtactcttctcactacctgtatgtaatatacccatgtaataaatctgcacatgtatctcctgtatctaaagtagaagtttaattttgaaaaaaataaaataaaaacataattgtaatgcacacaaagaaaatacacatgtgaaatacttatatgatcaatattgacagaattggtaaggttgtaaagatgcttccaggaacatttgaggaactgtaaatttatagaaatttaaaaaatgtgagaataagatcactagattagatggagaacagaataagcctctactagggcaacaaaatcataatctttggagtcaacttttcttttttattttatcagttttattatttgtaaagtctacacttggtgaatcaaagtgaaaaaagacaactccaatgtacaagacaatattaaactatgtttacagatgctaaagaaattcagagaaagggagagattttatgggttaaaatggagtcaacatttcttctggaaagaaatatacaagttaacatttaactttgcaccttctaggaaataatcaattagaagaaggcaaagcaaaagcagatatattgttctagagaattaaatactccttagtaggactattaaaatatggccagagtgacaatgaaagaacattctgtactctttttgccttattttaaaagtttggataatctttcttaacacttcatgccaaattaatatctgtttccactctatttagggatacacctaaatgttaactgtcatctttgaaaaaaggtgatattaaaattcatcagaccataccttatatatcatttacaccttgcttaagatattaaaatacaatgcagtcaaacgttggaaatcctagcattttaaaaatatatatattttgaattattgctctcttctgatgcagtttgataaactgaaagcaactatgagttcatcaacatggtatatagcatctatactaaaaaggctatatcacattgcaattgattactaggtttcaccaatctttcccaaggtaattttaagatgcctaaaggacatacttatttcatattcaagaaataaattacaagatttaaaacatcaagatatgaaactgatatgtgccactaatcctctaattttctaacgctgtttattcctgtaacatataaatattttgtgcactttcttttataatgatttttactatatatttgctgaagagcacacattatgctccaaaatttgtcagttcccagatcctattgaacagttctaatctgcttagtttgcactgctgtacctcaaagaattctttcaatatgtatttgaaagtgtttctatctttaaatgtgaaggttttcaaatttcctctactgaaaaattgaatattaaaatatgcaaatatcagtagcatttgtatatctactttcctcggcatttttcttaacaactgaggatcttcttgagctcacagaagacatacgcatacaagcatttggaaaaaagcacttttcattcacttcctctctcacctggggagagaaaatgctgaaggaatataaaattggcaataccagatatttgtttttcctgctctctcttatttaatttccagacttgaatgtctaactttgtagcagaaatttaagtactttctgatgaaattcaagttgcccaacacaaaatttatcatcttctctccatactttttcatttactgaaatagcagtttattttaatatagctgcaacttctatctgcatatatctattacaattgagtccaaattctttttttacagacatgagccattgttgacaacatcctccctcattgtcattaggtgatgatgatcacactaaagttattttattttttataaatttagattttttttctgtcctgtcctttcatatgagcttctcatctagccccaaattctcagatgttttctttttgatagcacagaatttgcaccattgtttagattagattgaagatcattcctggtaaaaatattattaaccgagactaaaaattattaatgctgataccagtgcagccagactacaatgtaagactagaaaataaaataatagcaatacatgccagagaatcttagataaaaatacgtatccctaatatgttttcacatttaagagaaatgcagttttttaaataattttatagttaatcaaattctgtgccatcattttttgctcttgcttaaattatttgctacatttcattctatatagttacacaccaatactgaacacctgctatttactttatttattttattttatttatgtatttatgtatgtatgtatgtatgtatgtatttatttatttattttgagacagagtctcgctttgttgcccaggctggagtgcagtggcgtgatcctggctcactgcaagctccgcctcctgggtttaagcaattctcctgcctcagcctccccagtagctgggattacaggcacgtgccatcacacctggctaatttttgtatttttagtacagacggggtttcaccatcttggtcaggctggtcttgaactcctgacctcatgatccacccccgtcggcctgccaaagtgctgggatacaggcatgagccaccatgcccggccacacctgctatttataactatgtgttttctttgttgctgatgtctctcctgaccctgtaataaaatactatttattaaaacaacctttcagagattttacacctgtgacatcacaaaccttcaacagatgtgaagatatcacatatttgttttttatttatcgatttgttctatctataaaatatacaattctagctttaaatataatttaagaattaagcaaatctgaggcctcaagccttcacaatgataaaatcacacttgaatgaactattaatacttcagttctaaattagaactcattacatagaatgatggcttgagaaatgatagacatccaggatcagataatcgtttgctctaaagagctgcacagttcaagccttttgatatcagcctgcaggatcacagatgacattctccttaccttgtatcctaggattcaactttacagtcagaaacttctaagttaagtcacaatgcgtttatcagttttatttgaatacttagtaatagaactatttttgttatcaaataaatattcactatacatttacagatttattggaatcactcctccccatccagactaaatagagtttttcatagacaaaaatgttcatgttacgaataggaaagcttttccttccttccttccttcctttcttccttccttccttcctccctccctcccttccttccttcctcccttccttccttctttccttccttcctccctcccttcctcccttccttcctcctttccttccttccttctttccttccttcctcccttccttcctcctttccttccttccttcctcctttccttccttccttcctcctttccttccttccttccttccttcctttccttccttccttcctcctttccttccttcctcccttccttcctttccttccttccttccacatttccttgcttcctcccttccttccttctttcattaaaacatccctcccttcctccgttccttcctcctttccttccttccttcctcccttccttcctttccttccttccttcctcctttccttccttcctcctttccttccttcctttccttccttcctcctctcgttccttcctcctttccttccttccttcctcctttccttccttcctcccttccttcctttccttccttccttcctcctttccttccttccttcctcctttccttccttcctcccttccttcctttccttccttccttcctcctttccttccttccttcctcctttccttccctcctcctttccttccttccttccttgcgtccttccttcttccctccctcccttcctctctctcttcctggcttccttcctcccttccttgcttccttccttccttcttctaatgtgtgtactattatttccccttatatttatttaacatctcttttccctcaaacactaactcataataaatattaaccaagtgtttttgaagtaatacaccatttgtattattatttctaccactcacagttaccttaactagaaagctgagccacaccagtttattcttcataatcaaaatgaaaataattatggtatttacattaatatcattttactatcattatcatcatcattatcattatgatcatcatcttttctcagacatctactatgcaattatgtttattgtaattccctcatattttagttcaaaatatattttatattgataaaatattttaaaaccttacagaaaccatctttaggcagtacttcaaaagaaagtaaaatgctttaataggatgtctccaaataacttgaaacttctaattgtaattcatagaactccaatactatgtgcaaattaatgttcaataatgttttttgacagtaatcattgaacacacttttattttcaaagctcatttccaactgtcacttttcagaatgaatttaaccttttcaaagactaaagttaagctatttagagttttcacactatatatcgtgagtttttattattgtattaaaaatgtattttaatacagttaatttttcaaatgataacatcaataacttgggatgcattctaatatgttgcataataagagaaaaaacatttagtgtcaattacgacccaggtactcttgtatatactttacagatattaacttagttaatcctcacaattctttgagttagttactgtcattggtctcattacttaaaacaggagacagaggcatgaagtggataaaaagcctgccaaagataatatacctatgtaattgtggatcaataattcaaatccaggctgtcaaacaatatcgtttatttttttaaccaaactgctaaacatgtataaattacagtaaaaagctatcaccaattgatacaactcagattgtgccttaatctattttttcaagtgcatagtccatttgtgtgagtagactaccttctgtgagattcgctttttaaaaataaatgcatcttcatttttaatttctaagctaaattttgatgactataaaaatataatacaatgagttcatcaaaagatttaagaagaatgctgcaaagtgaacagattggattttccaccccatagatgaaatatctccatcttatcaagtcatttaaataatatgggcatgaggcatactgagaaatagaatgaagcaagtgataagagaggagatcctagggttgcatcaacaataaagaatggcagagagaagaagtttgtgttttcctattgcataaaatctcaatgatcaggcttatgaaaaaacaaaccttcaccagactgtaattctctcaggaggctggggacagaatgagaataaagggatcttaagaagtaaattctaggcttatgcaaaaaaattaaagatgctactataaaagtttctaaggaaatgttatgtaatatcaattaaaggacaggctttcctcgaataactaaatccacaattttatttcatagatcaaaatcgaatatgttccccaatattattgaaaatgatgatatgttttgaactgaattatttgattattgcaactcccgaagtgcaaattcactcttaataagtaatggagaagtcaaagaagtaagctacaaatattcccaccttagaattttgtcttatatttaaaatactacatataacgtctgtagaattgccaccatatataaagcttgcattattaaatttgtcttgtgacaacatattgtctcactgccgatattaaaccaaaacccattaataaaagggaatttaccctatatatttatttatttgtatgccgacataggattcggcacaggaccttgcagagaatgggtgcctgataaatgttgcacagtgtaacgtttagaaacaggcaactttgcaaatagaggctaagaatacatattcattactttgtttctgaaagtaatctgaatgtggaatataatttacactaataaagtttgaatcattcttcatggaaacccctgctgttctaatcaataaagccaacattatgaaagaaaaaaaataaaagatctaggtatgttgactctggtgccaactatatccctaaggatttcttctgtcatttaatctaattatacccagtactcttataatcatattaaaacttttcttaatgaagaaaggagagtaatctacatcttcttactgtttttccaaaaattaaggaagaaaaatagatttaggaatactaagcattcactaagatatctgaataggtgttatgttgttttatgtaacaaccctctaatgattgtatacattttctttatttactgtgctttagatttttatttaatttatattattctttagaaaaacttatatttgtcatgctaagaaaattaccaaccataactttacttttaatcaatattgtttatattttcagaaacaactgaactatccacaggttttttcaataaagcaaggctgaaatccaatcctcaaaagaagcaaattgacactattcatttttatttgtacattcatttattcagttaattacattttcatttttgtcagaagatgttcagaaatcatttgatgtggtcaaagttagcaccagaatctaggattatattatagccacctctctcagaagcagcgatttgtgatttgtccaaaccataagaaagaaagtttctactttaggatgtcaagtatcaaaaaatgaattaatttatctcaattatgctacaataaatgagtcagaagaatacaatatataaacctgagagggaacaaaatttgcaaatgatctctaaaatttcctccatgtcaatctaacaggattgacataccacttcctaccaaaacagacaaatatggaagtacctctggaacctataaccacaaagaaatcagtattatatatatatgtctatatatgtctatatatgtacatatgtacagtatgtctatatatgtgcatatgtagagtatttgtctatatatgtgcatgtgtacagtatatgcctgtatgtgtacatgtatgtacagtatgtctatattatgtatatatggacatatgtacaatatgtccatatatggacatatataccctatgccccttgaatatatgttagtgtgtatatataaatataaatgtgtctatatatagtgtgtacatggatacatatgtatatgtacatatgtacagtatgtctacagtatatgtaatatatgtatttaatacgtattttaatatgcttaattttgtggatcaaaaattacatatgtacagtatgtatatatgtacacatgtacatatgtacaggatatcagtatatgtgtatatacacatatatacatatgtatgtgtctatataggtacatacagacatatgtatgtgtctatataggtacatacagacatatgtatgtgtctatataggtacatacagacatatgtatgtgtctatataggtacatacagacatatgtttgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatatatacaccatgtccctcaactatatatatttgtgtatacacataattataattacaaatgtgtgtgtctatatatataatatgtatatatatgcacaaattcatgcttagtaaatgacagagaaatcaaagaagctacaaatgttcccactttttctaccttagaattttgtctcatatttaaatactacatataatgcctgtatatatatatatgtatatataaaaatactgtacccctcaacaattatatatatataatagttgttcatagaaatgctgaatagtagtaatatttagctaatctacttaatatgtcaggaattctatcagtacttgattgctaaccctagtcagaaaaaattaccaaggatatttaacagataacaaaagcggcatttagagagatcaaatcacataccttataaggagaagagctagaatctaaatccacgtatatttgccactttttttttttcttaagccattgggaaccaggatgttgacattttacagaccagaaaaatctgattccatatacttccccaaattacaacaagcaacataagattgtgatcttcttattttaaaaagggaattattaatgataaatgtatgagctaccatcaaatatcattgtattttcccaaagtcttatgtttactttctcttactcttgatgaaaatttctgtgttccttccttcctttttttcttcaaaaatttcctcaatatgaactatttgcatgtaaggattagtaaattcctcccttaaaatattcatttgtttgagaatttagataaaaagaaaactgacacattacttactggtataaataattgagtcactgtagttgatgtaaacaacttctgattaaacgccatttattcacggaaccaggtaagatgcagatcaactgagtttaaacatattgctccagttttcctcaaatcttatacatacatatatatatatatatatatatatatatatatatattatactgacagtatacatatatgcatatatgtagctggttacacttatacatgtatatatagatagaaattatgaaattatggcttttagtggactggctacacatggaaatctactacatttagttttcctcaggtaattttgacttttctgacacacaactgttaaaccttttaacactgaatgagtactggatttcttcacgaatcaaatttattttaaatgtccaagagtgaaaaggcacacattaatatatctgaactattcatatttttcaaatgtctgttctccaaaatcttctctaatataaaaccaaaatcagggcataaagatcattacttgttttatcttctgggcataacaagtattaaaatttctgtttattttttccttactgttagggagaagattttcttattttgtatatgatggtgtcgagtatgaattttgttcttccttttataacaacttcatactggataccatcatacacaataaaggggaaaatctgcgcaagcctggttgaaagggtatcacagatgttgaagttttaatctggtgtattttttgtcatcaatacacaggcatgtgtgtgcacatatgcagacacacacagaaacacatacacacatatacaccagattgcctagaacagagagggaaaagaaaactttacacgtaaaggtaaaggaggtcacttttatgcaaggaatgagcaaagctctaacacaataagaagtataaggcagatctcacagcacatgcatcaacaaaccttggaaccagaaaacttaacaggaaaaaaataaaaactcctcaagaaacactttataggtagtatacttttttaaagtgtatcttcaaagaaatgccttttagaactccctaaatatgctctagctggacttgcttacaaccacaagaggcaaaaggggtccaaggaatcaaatgaatcactaaagaagactactgtgctgtaagtaccacagaaccaaaatatttagtctgtctaaatctgtgtcactcaagtcactacaattggctcaaagataagaatttcaactaatatggaaaaataatgaagatgctcagttcctttttttttttttttagatggagtctcactctgtcgctctgtttctgaggctggaatgcagtggtagcatcttggttcactgcaacctccgcctcccgggtacaagtgattctccttcctcagcctccctagtagctgggattacaggtgcacgctgccacacctggctaatttttgtatttttagtagagacagggtttcaccatgttggccagactggtttcaaactcctgacctcaggtgatccgcccgcctcagcctccctagtagctgggattacaggcgcacgctgccacacctggctaatttttgtatttttagtagagacagggtttcaccatgttggccagactggtttcaaactcctgacctcaggtgatccgcccgcctcagcctcccaaagtgctgggattacaggcaccagccactgtgcccagccaagatgctcagttcttaagatttaatttcatctatcagaagaagtagaataaatatacaagaaatttaaaaacaattattgagaatcttttaaaaatatttttttttcagttgggttatgtaagatttttatctgtctccctcaccttcttattgtaacctatcacttcctatccaacatttaatactttatcatactggaagggaatggaagtgatgcactgggacatatgaaaagtttacagaaattttttcaacttaattaataaaataaatgcctataaagagaaaagtcaatgatgttatttcttcaggcaaagttttcacagatggcactgaataattatttttaattctgaatgtaaagatatacaagatgcgacatgttacttacctcagcaagcaaagtgataaacccacaacatttttattaaaattatatatagaaacaacactggttttgatatggaagaaaaatgtaaatagagggaaaaacatgtacaattgatcttaacaaaataaaaaacattattttctcataattgatatttccgactgttgctggtaatacttttcctgatatgagttagtgaaagaatacaaataatacagtatattagttgtacagatactatttctcattgtaaggtttgatgaataattacaaatttatagaaaatggaagatgcacttcagtgctgtttttaacgagtatatataatatctgctctgaattattaactttattataaattatatattattgagtgtcatttattattttctgtcttaaagtgtttacagggggcaaatgtaaattcaaaacagttttgactatatatgttataaagctagaggttttatttaccaatataacacaacagcaaatagacgatctgagtatgttattgttctcagcttccctttaggttaggataccggcaagcttcctcagactggatactatgcagatggttaagggagacatagttttatctgcttacttgttcaattatttgtctatttttactgatagccttacttgaactcccatcttgttctcgaaatagtactagtcactagaatacagcagaagtcctctgaggctcagatgaacagacggaattagaataacaagaaaatttttgggagaaacaacagggaaagatgaaggggaaaggaagcaggaggcagcaggagctttcagtccatgaggcaggtctgatacctgtgaaagaataagggaaaagaagggaaatagaataggaaaagaatccgaaagtagtgtagttctgaaaagaaaaaaaaaatctcagaaagtctgataaggagattcagaacaaagaatacccattagaggagttttgctcaggcaggaatggcctggctctagtacccactgggatcagtcactggcaaggagcagcccggggacgttgatatgggtgctgcagcagatcccgaagttgcagcagctgaaagcttccctttaactaatatgaaggcatatcagagaggatcccctccatggttattacagatatcaatgatacagtttctatgcacaagttcagagtgtggtgagagcatacgataaacaattatatgagaaacatacacacattagagtaagatgctgtgaggacccaagaaagggatgtgtaactcaggtgaaagagaggtaattgttctgacatggcatattggatctgagtaaggcaggatgagacagagatatccagattaacaaaggagagggaaaagctttggcagcaccaatagtctacataaaggctgcaacacatagagagcaaggtgagtaaggtgagtgctattaatcacaaattgttttcaattctgtatggctaaagtaaaaaaaacaaacaaaaaaacattaaacatggccacaaatatggatctcttccactgagataagtagcctaattttcctcactttaaagatggactggccttaccaatttctttgaccactagaaggcaggtggtgtggcattatggaatttttgaagctaggctataaaaatcattacaagttcatctagctctcttaaaatgttcactctgagggaagccagtcaccttgtgtgtaggaggggtcctgctaccttgatatcactctgcagtgaggaagcccaggctaacaatgcagggaggtggtgtgtgtgtctgtgtgtgtgtgtgagagagagagagagagagagagagagagagagagagagagacagggacagagaaacagagagctgacgaggcctagatattccagccatcccagtttacatgccagagttgagaagccattctggtcattctagggccaggctcacatgaaaaagaatgaaaaatccagatgaaagtcagactgggagatatgaattatttcagctttctccacctatttgagacaccttacctgagactctggtcatcatggagcagaaacgaactgctcctgccaaaccctctctaaatgcctaatgcacacacacacacacacacacacacacacacacacacacacacaaacatgatcctaatgaacagtgttattttatgtcataaagttttggagtggtttgttacacgccaatatataacaaacagacataatggcaagaagaaaatgtctaagaggtcacctgagggtatactgtaaatgccttgtttcaatcccaaggaatttgagttctatatggaaagcaatgcagagctatgaaaggataaacttaagtatgactgagtctgaaatgtaaatctgaaaggtcactctctagataatccacaaataatggattagaaataagtgaaccttgaaagggagattactcaggaggcagttcttgtggtcatgcttattctgtgacattcagcataaagctgagtgtcagctggaaaacagaaatcaagtttaaaaccctctgccttcaaaaagcatacactttagcaacagtacacagaaagtcttttccatgagtactttctgcacagcaaaggaagttttaagggtcaggagataagataaaatgtaccatgggaagtgaaaggaggagagagagtagggaactgtgaagtctttgaataagaaagaattcaggaagtaagggttgaagaatatatagaaaaatgacagctgaagttagagtagcattaaaaatggaaggtttgagtaaaagagataaagtgctttaaaaaagatgatggtttagaaaacaaaagaataattttagtattttaacctgtttaacacattttattagaaaaagattagtaccaaagcagccacaaatgaaataaaaatatattaacataacattggataacacacatttcaatcatcttgttttcattttaaaatataaccaaacatagctacaattcagtctactgaagaattgacatatctaattagggaagaagagggttttttttgtttgtttgtttgttttttcccccccagcaaatgttcaaattattcatattcctgtttttctgtgcttaaattactaaaatatattctctaataatattaacaataaatagaagttcaaatcattttcagatgaaagttaatttaacattgattacttacagcccgttacacatgttaaaattattatagaaaacaaaataatatgagtatgcttacaacattcagtacaacaaaattaaaaactccaagatgatgggtatgcatcaattgaacatcacagtatattttctttttaacaaggctctgtgtcagcattatgcatctagcagggtgaatcttaggtaggaagttgaagttggacaccaccaacagcacagggaaagataatgagggagggagaaacaaagagtgataaatgaggtgggctaaaagtagaagtttccattcttttatttattttcctttgcctttcaatttaggttattcggttgtctttggctgatgcactgacttttcaatgtttctcctaatgacttgaaattgacataggaagagaacatgtttcctgccttaagtctctaaacagattgagtagggacttaggtcctgttttgtcactaatgttgtcagtagaggaaatagtgggaaacaaaggcaactgttgtgttctctatcattgtcaattggtacgacaaatagaggagaaaagactagaggggagatagtgggaaatcctacgcctcacgcatgtgtttctgtgagtgttgggggtgtgtgtgtgcgcatgcgtgcattttagtgaactttgtattttttccctttctctaagactcaatgattttgtattttcacccatcttctctttgaggcctggcccattatattgctatgtacaaattcatatctattttatttttcttgttttatacatgtcaatctttttcttactcttcatgtcttgtgcaatgtctggtacttatgacagaatagggggagaggaaaattactgcacaaataaatgcatgtcttcttatctattgtattcttctaatcaaagttttatatttctatcctttattcatctactttagtgttgtaaaaatgatgggtggtgaaacttactctgttatctctcatttaaggagatgttactgatatattaataaaaagctaggattcttttctcttcataaaatcaatcatcattatgacttgtcctagggacaataagagatttgtggtttcactgaaaatgactacactgcctaggagtatgagtcatagtatggactccgtgttcttatagaatacagcctcagtaaggcaagcatgcccttgagcacgaaggtctgtgaaaaacagcttggaacactggaagcaagtattaattgtattgccaagtgtctaaatgtatatgttcattttaaatagacttactattatttcacatttttaaaagacaaaatattttgctctattatttaaattagaagcaaaaggaatctttaattaatgatttcactaaatctgttctcaatgaagaagaaatatacatccactgtatatttcaagaataaaacaagaacaaagaggcttaaaagaaaaatgttacccataactccttggaaatatttgccatccttgtaatcttaccttcttctacttcaaacatttcaagaacaattgcccctcccaaaatatataccttgatgtccggttttgtaaatatgataataaaaaagacagatgaacttccttccaatatttgagtcaaaatattttgtaatgaattctattctgttttccctagaggagtacgttaaattataatgtctaggcatactttgagggaagaaaaatcctggcacaaatcttatttctgaagcaaagaaatacaaaataataggcacatacttaatatttgagacaccacagtacaccacccacaggtgattgttaatacataagagaattacttattatactaagaatagtgtcactgcagggtaaaatatcaaaatttctctctttgtcttgtaaggctattatgaaaatagaagctatctgtagtaggtagtagttttaacctcaagatttttaattcataaaactgaatcacactgctaaatttaattcagctgctaattccttattctttcagttactgttgacaatagcaattttatggttacctaatctagtttacaattacatgcattctatgtgaaggcttttaagacaggttatatagaatccattacaatattcttcaatagcaggaaagtataaataatctttcagtctggtaataagaaatgtatttattctataagtagtaatttgtcaatttgaggaaaaaacatgtaacatttgaaatcagcttgtcaaaaatatttaatgatgtgtttcccaaaaaagttggcaatattgaaatgtgagtaaagtagattacaaaacaaattaacctcaatttgtggatataataaaaggatatatgaatagaggaaggactctaagaatacacattttcaatataactgtagtaacttctgagagctattactgtggttgattttaattattatttataatttttagtattttaaaattgcatgtaatgagtatgtacatattgcgaaatcaaagaggaataatgtgactttaaaagctattcataaatgttgaatttgagctaaatttgtccttttaatttgaaaattcttggcagtaacaaaatgtccactttccctttacttgtctaagtgtaaaatttagcattattttttctttattcttccaatatctgaaggttttccgtatttaaataacacatctaaactctcgctaaaaagacaagtgaaaaaacaaaaagtatccatatgcaaaaacactgaattgcacagcaaatttatttattgctttcttacatctctattattcatactgcgtagtcagacttattcaaggaaggcttaaatgctttaaaatatcaaataaaatattgccttctggaattactcatattaatttcaaacttcctttaatataacaatatatcaattttttctaatcatttaatagagtagatttgggagatttcacttctacattccatgtgattgaggataatgttttcatattctttattattgtgaacagattttcaaaatttcttaaaatagaaactcaaatgaaagtataatctttaaataaatcttaaaggtactgccagtatttttgcaatgataaaatctattattttcttgtgggttaatactaaagccacattattagtactagctgtgctatgtgaggtaataataaagctgttattataaatataaatatttcactataattgtaacctcaattcctatctttgtgttcccaaatcaaaagctaagaatacttttagaacaagtagttaattagcacttcataatttgaaaaaatatacagttgttacagtcaacattttattggtagagaaaatgattatggttttgaatgcattcttttaaatttagtgagtgaattccaattcaaaatatactttgaaaatattaactaatgcatgacttacaaatattataaaacataatggcttttattataaactattataaatatatgtactaaaagagaaaaagtaagcaaatcattttttgccccataaatgtgattttgttttcttaaaatgcagggaatactaaacaacgtttacattttagaaataatttaaacttaaatatgttaatccatgtaatcttgtgaagaattacatcagtcactttggttatttaattaaaagcccattagggaaagaaacaaaacaaaaagataaacaacaaagtgagatacattaattgacttacacagagtacacatgaaagtttttataagttttaattatataaatatctctcaatttttcttaaattgctgatttcataaattaagtagagataatcattgaccacagaataagtgatggttagattctttcagcaacataatttcatttactcttttctaccgctaggttaataaaaaaaaaaaaaacatgaaatccaaattcatgttattttgtgtggttcacctctggatttctgattctcaaagtacgcaaagcaaatgtgaagcattccataaatagctgaattattgagtaaatgtaattcctaaattttcattaaacataaactttctatgtaatccagtaattaaaataaatcattattactcactaaaggctttaaaatagtatgctaaccctgaacaaagtggtgttttttattctttaaacaaaaacttattcatcataaaaacattaaaaatactatttttaatgaatattcattgtcattttggcacattccttccaatttctgtcctgtgtagtatctaacacagaggttgcaaggagactctgaatttgactttctcagcctgaatttttgtcctcttgttcattagctgtgagaacaaggatcagtaacataaaccctgtatcttaaatttttttgtctcaaaaattaagctaaaacttttaactacattacaggactattataggattacatgagttaactaatatgatgagtatgtagttgagagtctgttacaaactaagtgatcaatatatataagttctgcataattaagatgattatggtgataatgacgatgctgatatctatacgtccttaaagaacctgactataaaaggcactgaaaaatagactcaatttggaaatgttaaatataagtttttaatttgtctaggaagaaccagaaccaagttttaacatgtagttcatacaaaatactacctaaattcttctggggttcacaattaaggttgtactctgtactcaggaaaatgtttatgtccataacaaaagatatgtaaaacttgtgcttgttcccactacctctgtccagcccaaagaactttttcaattcctgttcaaaaccagtgatctaataattctgaagcaatattcaagaagactggcatacattctccagtgccacatttgcattaggaagctgcaacattttctagtctcaatttctcaacctttaaattaggcataactctatttttcttcgtttttgaaggtatggaagaatagatgataagatgtgtaaaaatagtctagaaaggttttttaaatttattaatagactatattgatagtttaagatttacagacaacttgagcataaattacagagatctcatattcttttccactcagtttcccctgtcattgacatcttaccttagtgaggtacaattattacaattaatgaaccaatattgacattattacagttgaactttcaacaacttgagttaggactgtgcagggtcactcctatgaagacattttttaatcaaacacggatcgaaaatacagcttttgtgggatgcaaaacccacacatatggggggccaaatattcctatatgttgcttctgaaagaatgtatgcaggacttcagtttatgtggatttgggtattagtgcaggtggtcatgcaaccaaaccctgtgtaaaatgagggacaaccatattaactaaagtccatagttaattttgatttccttagtttctacctaatgtccttttatgttctagtatttcatccaaaataccacttaaaatttagttgttttatgtccttaagctcttcttggcattcctctttttgatgatatagacagttgtgaggcatactggccaggtatgttatagcatgcctctaaactgatatttgtctcatgttttacccctgaaaagggtttatgggtttgggaaagtctagaaaagttaattagaagatatcaattacttcttccttactatttgaagaaaatcagtatttccataattaataaagtaattttctgttttgaagacattttaaaatgatacattaaaacaatctttgggatcatagaagctatttctaaaccaattaaaattattaccagtaactactattttaagaaatcactctatgctgagtgtttcaagtccacttaatcctcacaatgattaaaaaagatagatcagcttatccctatcttcaaagcagatgaaaaaatgggctcttcaattatataattttcccttgttcaaaagctcatcagtagagctgagccctaaagctgcttacttctgatttcaactacatcacccagtattttcaatataagaaagccgttttattttctctcaaagttcttctgcttctccaatacttaaaaattcatttaatcctgcatttatacggatatctttcccagctaatgggcaatggttatgtggtgtagttttcctcctggataaatgttttattattctctagagatgcctcttctcaatttttgacttaaagaaggagaaacaagtaagtgaagaccacttattttacacggactagatttaaaattaattattaaggagaaatgtaactatagatgtagaaaatatcctatctttgaacttctgcaatctttgaatgacatgttagaagtaatgagggtgcttagtggattttttttccttttaagtgattttaaagtatagtctaaaatgtacatgcatagaaaattaataaaaataatatgaagaacaccagagaatctgccatacagatgatgaataaaattattaaaaacatatttcaatggctctccatagtcgcattatttttcctccccacaatttgcctgacatcatccaaagaaatcacttccagtgtttgttcattatcattcagataccttttttactagttttgctttatacttaatgtattctaaaatatattttttgcatatttcaaacttctttaaataagcttctttaaatgttctaaatctgacactttttctttttctctctctccatatatacacacactatagctctagattattaatttttatttgttgtttataattacaccataatttatttattggcctagtggtgtttataattacaccgttacttatttattgccctagtggtgaacacttaggcttttccaaatttttgataagacatgtaataatgacatgctataatgaaaaatattacacatgtcatctggttttcatagaagacagttgctttgggccctaagatttacattaaagaatggaactcctgggatatctattgctgcatatctttgcctctaccatatattgtgaacctgctcttcaagatgcttatgccaaatcatgctgctaatggaagtggaaaatcctattggtttctgatactatatgcttttccccaaaacttgcaactatgagattgttttaatcttattttttgtagactgggtttaaaagttatttacattgggccaggagtggtggctcacacctgtaatcccagcattttgggaagccaaggtgggctgatcacttaaggtccggagtttgagatcagcctggccaatatggtgaaaccctgtcccgcaaagaaaaaaaaaggtacaaaaattatttggatgtggtggcgcgtgtgcgtgcaatcccagctacttgggaggctgaggcaggagaatcgcttggacccgggaggcaaattatgaagtgagcctagatcgcaccactgtactctatcgtgggagactgtgtctcaaaaacaaaacaaaacaaaaaagttttttacatttttcttaacaactagtaaagttgaatattcaatcataatttattaatcatgtgtatttgtgtatttgctctttattgaatgtgttttcacattgtttgaccaattggcagagggaaggtttcttcaccttattgatttttatgagttctctgtatattctggtgactatctctctgctgcttacattttgtgcaaacacattctttagcattcctgttcacaattgtaccagttttaatatagccaaacttatctatcttttaatgtcttctgcttttaatctgcaatatttagcactaaaatacaaacctagttgcaatatatttttatacatctttgatttgatttgctgaaacatttaagtttattgagtgaacacccataagcagattgatctgtaaacttcttttatcatattttcataacataataagactattagacttgtagagtttgttttagattattcactaatttttacttttctggaaaatattgtgatattaggctatgtgatcagaactggttaccataaactggatttggtcaaaatcaacaagttaaatgtagggctgccattataagccagaagtgaattccattataagccagaagtgatgaattcaagatcatgcagaagtagaatcagagaacacaaataaactgcatgagacgatagcccccttgtcatctctcattatcttactatggcttttgcctcatctcaggctttcattcattagggttaccttatgaccaagtaatggaggtgaaaaaaaaggcccagctagcttaatagatgggtttgcttaatatgggtttcagagtaatgaaggattgctgctatcttaaagccaaatcaatagtgatcccgaaggacagaagtcagaaaaattttccccatggacactcactacttcattcatgttttctgaaaagaggaaagaaccgaggtaagaaaatacactgacatatggaagtggtaaagagtttggaggtttacttagtggtctgggtatacagagattaaaggggagagaaagagcattggggaaaacctatttgatggacttatagaaatatcaataagttatgaagactctttaatctcgtgttaatgctaactaaataatattcaccatggagagggcactagacaaccaagtagataaaatgactatgccaactgacatctgctaacctctgtcattagatggcctagtgctggcataatagatgcctcagtgaagagactgtggtagcagagatggaggctaatccagactccacagcatgggcttctgttcaccagggctgatttctttatagccactgcttattatatattctgacagccacagaaacaaacgctggacacctcacttggcactatagtttgagaggatcaatcactttcttggggacaagttgatgatattgtgatcatcttatttttaaagaagaaataatttgtctggattggaattgactcacatgatgggtatgggtttggtttgcttttatgtctgcaggtgtttagctacaacttctatctaagaccttcagagtgcttgagctgctgaacaagatcctgcgcaatactgcattaactcaaagaactcattttacatctaatttttattttatatgaaagtaattctcagggaattgttttaaaacaactgcagaatattttatttataaaaataatgtataatgcctatgcatacaattagtgtgcattacaaaagtacttatttattagctttatacaatttttaaaccaaacactatacataacattatctagcattgccataaatttgttttaaacttgttaaaatgatacagaatataactcaaatgacctagtaatatcatatgtttctattctcagaatttccccctcacagattcctgaaatgtttttctttccattttacctaccttaaatagaggtagtcttttagtattgcctataatgtatttgttatttttgttgttagcattttaattgaagtgtaatacatgtacagatacgtgaaaaaatattattggtataaataaatcatcacaaagtgaaaacatttatgtaatccccacacaggtaaataaataaataacattaacagttctctagaagtctcccttatgtcacctcccagtgccaactctctatccagactctataaccatagatttcttgtaagcttgcaggtgttataacagtatttcattcctgattatggccctacacttccaccttacatctcacacagcactttgtaaggcacatcacagatgatcaggtaggacaaataccatgtcccaaatagaaccaaatgtataccaatatagtcgatgggcctattattactctaaattaataataaaaaatatcatatagttattcaaacttcacattgaataacagctttttaattttgaaaagaagtgttgtataacaacttttgttacattaatataatcaaaatacagtgtagtagagttttatttttaaagaaggataatatgtagagacaatgataaactattttcaaaagcaaatcatatgtggccattataaatgacaagcactataaggctagctgcggaatattagcatgtcatatgtgagaaatgaataaaatgatgtcatggagaatagtatcggagcattatttactttatcacaagtaaagatagttaataggtttgtttttactagttttaaagtagaccactgatattgaaatgtaaaaattgtgttccatgttaatgcaatacaaataattctcactagaaaaaaaaatcctagagttgaattttcttttttttcatggagaaagttaactgaaccaaaatttctgccagcagaattcagtcttacacatgtagatgtgaaagtgtgcatctcctctcaacacagctttcttcagtaatgacagaatttttcctaataaagaaaaatgtttttcaacatcctgtagagttctctttacataatatttcaaagtaccaaaagactcttacaaacactgtactttccaatgatcactaaaaaggtctccaaatgccaccataggaaaactattaaacaggcagtgattatacgcctagactcatacaacactgtaggccattaaggacaaaccattttccaatgcatttaagagttatattaaaataaattcatgtgaactttctactctcctccttcaaatgtttacagacaaacatgtcgtatcatttgtaaaatggcctgccacatttagaaatttgaattaaatttctgtaataatttaggtccaggaaaaaatgtatagtgattttcccctcagccagtagaggacataatgaaggaaaaaatgcaggaagatggccagaacacaaagcagcacttgatatgcacaatattttacaatccagtattcttagactgggaatgcttgatgttttttccaacattgtgaatggacttatcacacccaataacatccttcatacctttgcacatcaatgaatttggttattttccttctgtcttggttgtccaatagtgattgccttaattgatagtgaattaaaattatctgtggagctttaaaaaatatgttcctgagtaacatactgagaaattctgacccgtaattctatactgaaacttaggaaatcccagatgattatgacaccatatatccaaaagtaagcattttgaaagcactaaaaccttcaacacttatcaaaacacagtgaattgtcatctgtaaatcaattcagtaatgaaaaagagtaatgtcaccatgtaatatcaatgatcttcaaactttctcttttgttgacattgtatttattactcacatttccactttcaagtcctgtgacatatctgcaagctgtattccagtgccattaattaatatatcctttttagccaatgatgttagatttttgggctattaatagataaagactaacatgtaaatataaataagggaaatataacatataaataagggaaacaggaaaataaagagtaacttttgttgcaaaaatttcacaaatgcaagtcaaatttcacaattttattttaagtattaagaaatatgccttctttggtgaaaattattttcaaaacaaattcaataattcatttaagatactctgggaaggttatttagaaatgttctggagacaaaagagaatatatattttaaaaataactcaggtgttatctagggagtaacctgaaaaatactttcacagaacaaaggttaagaaattaatcttcagaaagaaattcaggtaaaagtacatgtctaaaaagacctttgaaaactgggaagttaacaacttttcacatcactaaacattttatataaacttattttattatagccagattagaaacatacaggctacagttttcaaaactagattaatgtgaaacccttggatttttaggaaaattagtctgtttttctactatcacagcaaacaaaactttgtcatcataagtgcttaagaattagctggaatagctagaatgtatttatccaaaagttgtctgtatttaaacttttgaacatgataggacaataaaaattgtttatgaatgataataatattttttcaggtgtcttaactatagtctttgaaagagtacaattccaaaatagtatgatgtgagggctgatgataagatgttcctgttcccaaataggcctcttaatccacttagtacataaatagattacatgaagagagtaccacatgtttgccttaagacaaacatcttacctggtacattttaaaactaagtatttcaaggaaataccagagtaaacctgtggaaagaggagagcagcctgtttttccaagaggccaataactgacacttttcaaatttcttgaatttggattcattttggggagaatagaaaaaagaaagtagcatggttagtaaaataagaaaagaacccaatattattaacagtcataacatttgctagtaatagagactgccccagtttaaaattgatttttcaattaaaatattaaatgtcgttttatgattttttagtctgggaggcaagtcaggagacttttattaatagtcattaactgacaaagcttctacagttgtgctttttatttaatataacacattaaccacagacatcctttgattttctgtcatattttcaattctctgtctgtacacgttgtctcaagagtagcaacatttgtgaatttattttacaattcatgattttgtcagcattttaagggcttactgttccaaggggacattataacaaagcactgaagaacacagaacttcagtttagctggaaatttatattggaataccattgttgtcccttatttactgatttatacactgttcatcagtgaaattgaaataagattagctattttatacagttattataaggatgaattcaattagttttgaaatattggaaatatatgtatttgatataaaaacttgtatatattattttaaaaatatttattcataatagtttaaaacttttgtttagcctaatctaacgtcattttccagaaaataaatgtgaggcatcatgttcagtaaaatgtgtagaatcaaactgactgtataaacccagctttgtcacttagttgagaaatgtgtcgtacatctataaactccagtgtccacgtggcatacctgagcataccaagtccttgctgagatatgtaattaaaagatatgaaatcaatgctcaggagtatgcaggcacccaaacaatagtcattaactatttatgtgatatttagaagttaaaattgaaatgactttgtgagaaatgatacgtgtggggaaaagagaaggatgtataaattttggtttacataactggatagacagtgatgtcattcacggaaacattgtgaaagagtctggtttacagaattctgggaagatgatggaaaagcaagcactggaaatctctttacacataagtaataattacactggcaaaatctctctgatacaactcttttggaattcttgaatttagtgaaacttacaaattccaggagaaagcatggataataaattttagttaatttcagccgttagcttaggagcaactatctatccccaccctcaaccccaagacagggagctgtgcacgtatttctgctgcagcttgcctctagcttgcaaaaactaccatgagcaaaaaggaccacatccttcggttatcaaggatctgtgctgtcatggttgattgctgcttctgagcacaatggtagagacaaaaaggtggtagccattgtttttgcactcccttcttttctaaaacccactcttcctggctaaggtgacttccaggagatttaaaaggctgtttgtccccctacatttttcctttacccctttgagaagtcaaacattaaagaatagtatatttccagagcaactgcatacatgagggaaattagaaagtttcagtgtatcatcaagaaatggtgcaggttcatgaaatactaataaaagtctttaagtttacaactcaggccgatcttcagcacagacacagcctgcaacaatataaacaaaataataacaaaaacagcaagccctggggaagggagaaaatctgatttcaagatttaccatttaattaaattcagatgtccagttttcaacaaataatcacgaggcacacacaggaacaagaaagtatggctcatttaaagaaaacagataaagcaaaatagagtcaccgagaaagacttgatggtagatctactacataaatactttaaaataaccattataatggtgtccaaaaaactaaaggaaagcatacagaaagtcaaggaaacgatgaacaaaatgaaaatatcaatagagacagaaaggctaaaaatgaacaaaaaaaatcaggagctgaaaattaccactgaatgaaaattccataacctatcccccagagaatatataaattattctcatacataaactaaggtagttcattaaccgctataaatgctcaaggaatcctgcagcttaaaataaaaggacattagatagtaactcaaagctatatgaataagtatatatctcagtaaaggtaaacgcatggacaatataaaagctagtattattgtaacattggtttgtaacttcattttttattttccacagacttcaagagactaatatattaaacaattattagtctaaagttcccattattataactttggtttgtacatctacattttgttttatacataatagagaatactaatatatttaaaatgattatgtttttgaatgcacaatgtatagacataattttgtgacattaataactaaaaaaatgtgaatgaagatgttataggagctgagtttttgtatattattgagcttttgctaatatacattcaaattagagtattataattttagagtgttggcggttaatactcatggtacccacaaagaaaataattatagaatatacattaaaaaacgtatgaaaggaatttaaattttcactacaaaatataaattcaatactaaaaaagctacaaggcatctagaaaataaataacaaaatgacagttacagttatcttcttattaacaattactttaattttaaatagcaaagcccttcaaacaaaagactgatactggcagcatggattatggccatgatccaactatatactgtctaaaagagactcactctatatctgaatacacaaacagattgaaagtgaaaggatagaaaaagacgctccatgtaaacagtaaccataagagtactggggtggttatattaataccagataaaatagactttaaataactgttaaaaggctgcaagagtcaaaggaggacataatatattaataaaaggttcaatattccaagaagctataataaatatcaacatgtacataacagactattagaaggaaattttgatataaatgaaggaaaaataaatagttctacaataataattgaagacttcaaaatctacccttagtaatggataaaccaatcagaagataagtaaagaaataaataacaatagaggacttaaaaaacacaataaaccaacaagatgtaagagatatttacagaatattctaccccacaacagaatatgcattcttctcaagtgcacatggaatgttttccaggacggattatgtgttaggccacaaattacatctcaataggtttaaaagatatcatacaaagtatctttgccaactacaacaaaattaagttagaaattagtaacaaaagaaaaagtggaaaaatcaaaaaatatgtggaaattaaacatgtatttctaaattaccaattgatcaaagaagaaataacaggggaactgtacaagtatttcgaaataaatgaaaactaaatcacaacatgccaaaatttatgagacatagaaaaagcagcgctaagagagaaatgtatagctataaatgcttacatttaaaagtaagaaatattttcttttaatttagaaaaagacatatctcaaatcaaccactttacaacttaaaccagaaaaacaaactgaaggcaagaagaagaaagaagataataaagactagagcagagatagacaaaatagatgatagaaaaacaatgaaaccaaaagttggttgtttgaaaagatcaacaacgttagtaaacttttagctagacggactaagagaaaaagaagactcaaattactacaatgagaaatgaaaatggtgactttgctatcaattctacagaaataaaatggactataagagagtactatgaaaacttgtatgcctagaaatctaattacatatgaaatggaaaaattcctagagatataaaacttaccaacactaaataatgataaaattaaaaatgtaaatagactgatacctactaaggagactgaaccactaataaaatatctcctgacaacaaaagccctggacctgatggcatcaccagtgaattcgataaaacatttaaagaactagcatcaatctttttcaaacttttccaaaaatgctgtcatgagggaacatttccaaaactcattctataagacatcattaccctaataccatagacgtatcctttataaacactgatgcaaaaatcctcaaaaaatttctagcaaaacaagttattaagcagcagattaaaatgattacagaccgcaagcaaaagagatttattaatattaatggaaatcaaagatatttcaacatacaaaaattgttaaatgtaatataccatattaacaatgaagggtaagaatcacatggttatctcaattgatgcataaatagcatttggcaaaattttataccctttcgtgatttaaaaaaaacactcaacaaagtagaaatataaggaaaccaccttaacctaataaaaaaattcatatataaaagtcccatataaaacatcatagtcaatcgtgaaaaacttaagagttttccctctgtgataagcaacaaggcaaggaagtctgagcttactactattcaatatagtactaaaagatctggctagaaaaaaatatgaaaggaaaagaaaaataaaaggcataaaattggaaaggaagaagtcaaattatctttgtttacagagaatataatcttatttatagaaaacgctgaaaattccactaaaatagtagaaccaataaattaagtcaccacataaaaatcaagtgcatatctatacaataacaaagaataatccaaaaacaaaattaataaaataatttaatttgcaatagcatcaaaaatataaactatttttatttaaccaagaaaataaaagacctgtcttataaaagctacaaaacattccaaaagaaattaaagaatataaaaatgaatggaaaggcatctcatattcatgattggaagacttaacattgttataatgtcaacaccacagattcaatgcaaatctatagacttaacgcaatccctatcaaaatcccaatgatgccttaaagcagaaatacaaaaaactcatcctaaaattcataggaatttcaagagactccaaatagctaaattgatcctagaaaagaacaagctagagcactcagactcctgatttccaaacttactataaagctacagtaatcaaaacattgtggtactggcataaagacagacatatggaccggtgtaataggaaaggttgcctagaagtaaagtctcacatgtatggtcaaatgattttcaattacggtgtcaagagtattcaatggggaaaaggcagtattttcaataaatgttgcagggaaaattagatatccatatgcaaaataataaagttggatccttacttaacaccatatacaaaaatttagtcaaaatggatccatgacctaaatggaaggcctaaaactataaactcttacaagaaagataagttttaatacttcagatttggcaatattttttaataagacacctgacattcacaaaacaaaattaaaaagaggcaaacgggcttcacaaaaagtaaaaaaaaaaaagaagatgaaataaaaatgcatgcatcaaaagaaaattataactacagtaaaaggcaatttacctaatggaagaaaatatttgcagaacatatatctagtaaaggattaatattcagaatatacagagcactcctaaagctcaataacaaaaaacaagcaacctgattcaaaaatggtcaaaatacttgaatagacatttatccaaagaagatatacaaatggcaaataaacacttgaaaacatgctcaacatcactaatcattaggaaaatgcaaataaaaactacaatgagattattttgtagttcataagcgcgatgactgggtgttcacacacaggtgcaagttgtgccaccctcgaaacttgttacaccgttggcacattacccatcagacatgaaaaaaaaaactacaatgagataccagcccatacccatttaggatggaagctatcaaaataaaacagaaaataataatttggtaagaatggagagaacataaaacccttgtgcactgttagtgggaataaatataaaatggtaaaactgttgtgaaaaataatatggtgaatcatcaaaaattcaacatgaaattaccatatgattctgcaattccatttctaggtatgtacccaatagtttcttaaatatgtattttatacccatgttgttaatagcattactaataatagctaaaatttagaagcaactcaagagtctatcaagagtagaacggataagcaaaatgtggtttttgtatacaacagaatattattcaaccttaagaagggaggaaatgctaatatatgctacaacatgtgtgaaccttgagggcgttatatcaagtaaaataagccactcacagagaggcaaatactctattattcgacttatatgaggtactcagtgtagtcaaaatcctcagaacagacagtgaaataatggttgccaggtgctaatggagggaaaatttttcagttttaaagattgtaagagttctggagattgacaataatgacgactgaacaataatataaatgtgattaatgataattacattatgtgtatttttaccaaaatacaaaattggagaatataaacaaataagaataaataaataaaaaaacaaatcaaacaaaaaccctggcttaaaagaacagaattatgagtttggctttgaacaagctaatttgacatgttatcgggacttccaaaagaggattcaagtatctaatgaaatatagttaatttaatgccacttattgctattgtcattcacagattccacactcagaagttggaacagaaaatgtaattttttgagtcatctgcacagatccttgatcactagggatgctctggagatagaacagcctcacgttattcatcattgagcaaagatacccaggtcttaaagccatgtcctcgctgcatctgtcactgcatgcaggattctgggaggggtaactttgagcaaggcagctgtgtgatgctagttgaaatctctgagagagggaatggtggagagagtggtgttgctgagagcgaaagaatgtttgcagaaagcactccctaatgctgggacaacatgtcctcctttgaagaggcaataaggcgacaaatcactttgtccacaattctagttatgcatcaccacatctaccgtactcccatgtaatatgtttaacttggtccctcctaagctactaatgacctggatctataagatatacatttaagaatgactaccataaatattcatttaaaagaagtatatggtttatggaccatgaagatattaaaattacctatgcaataagatgcttcagtactttcaaaagtatcaaacaagatgtgatagacctttactgcagatggaaatgcagcaagataaacctttagctttccaggtcatatataagcatctgttataagttccctatatttagtgttatgctcatccatactctgtccacttctaggacaacaaagggcaaaaagtgttcatttattcaggtgtggaaaggttaattactcaaaaaataaattttaaaaacaatcaaaacaaacagaaatttccaaattgtatcaaatactcagagaactcatccttgatttttcaaagaattttctaaaaaaaaaaaccagaaacaataatttcaaatgaaacatcatgatgagaatatcttcagaatattttactctgtttctaaggaaatgtgggtgagtcctacattactgaaagtggtcttcgttttctccaaatatgctattttcagaaataagaaaacgtaaagctcagtaaaacactgtaataaaaagtatgatatttaatgtaaactcattcagagtaatcgtgtgaacatggttctatttctgtctatgtctatacatcatcaccctaatgccagtaaatttattttaaactaaatattggtctcctgaggcagaggtaatacaataataataatttagaaaaaaatttacattttaacactgccactttttcataatagtgctatttttccctacataatgcaaaaacacagacaaatccaaaaagcatatttgtgccttaaattggggcaaaatagagcttttttttctcaaacatgggatagtaagaagagctttcatcttaaattcttacagttagttgaattgtttacaccaacattgcatttttataaatagcttctctttgtttcttaaaaatactagaatttcatgttgcattttttgacagctttatcgtctgtaatagtcatgtttagaaaagacctggcaggtgaacaaatacagccaacaagaagtagaaagacaaacattattaagaggtttttgacaatttttacagagaaaaatattttataaaagacaaccctgttcacattttagagctagtcttcataagtgtctaatacaacactggatgattgtaggcatagtttttcacttaagtattaatagaaataatttattactaaaatattcatttatttttaaatttaagttagaaagaagtttgctgctttctgatatgaaattttgaagctcaggaaccaattttttttctttgagaacacatctctgaaattacagtgtcagtcaatgagaaatatggcttgatattcaaagagcataaaatctgatttatatatgacttttaagaatgtcttcttgtataaagtaatatatatttacttattctatgaatgcagtgatttatactatactgcaggatttactatgagatatttatcatatctttgcctatatacataaaggcaaagtggaaaatgttttcaaatgctattgatttccatccagacttaatgaaaagcctgaccttctgaaaacagacttattatcactacttccttattagctgttatacactatttcttctttcaagtgttatcgtctgtttagcttggcattagcaaaggcaataatcattacttttagttgttccccatgttaaaacttttttaaggccactatcataaaagcaatatcaaaagcaaaattccctaaatatagaatatagtttggatgttttctcccctccaaatctcatgttgaactgtgatccccaggtccgttgaaggtgggtcctgttgggaggtgtttggatcatggcaggtggctccctcatgaataccttcgtgccttccctgcagtaatgagttcatgtgagagttggtttttaaagggcctgacacttcaccactcactctcttgctctctcttttgccatgtgatgcacaggctcccactttgcctttcaccatgattggaagtttcctgaggcctcaccaggagcagatactggcactatatttcttatacagcctgtagaactgtgagctaaataaaccccttatctttataaattatgcagtctcaggtattccttacagaaactcaaatggactaacacaatatttttaatggaaagaaatgtgaatggctttatgagcacattagttctcatacaaatacaaaacatatagcttaaatatgaaaaaagtaataagtaaatatcattattaataggtaataatttaagaattccacagtgaagaactccttcattacacatcaatgtgtaccataggaaccacagataaggtggcaactagaacaaatctcttcaaattagtaactaatctttcaaaatctgttattaggtaaaaatataataattgtatttcaagtattacattgactttgcttagattaaaatcacacatatgagacaactgcataatctgaaatataaatttagggagaatgagctacaaataaacactaagatagtgagaaagatagtagggaattggacaaagatattccagtttatacaagcctgagattaagtatgccaacttgccttagattcttgaaatttatactttatcatcgtatgcactgtatctttgcaaagcaataaaagtgtgtaaggaaccaagaatgacataagtctgctaggatattttttatatgccacgtgtcttgctataaacttccttcaaataattctgattgtaacaaaaatatcattttaattgttttcaatattttatgaagttgtaaaatattcccaaggaatgattatcagacaaatacttggctctgtgctctctttagagcagttttccaccttgggaaactgcttttgagatcagcaaaataaaactgctgatatttttagagcccatacagtaatgtttagagaagttttctggtttctttttggatacaggtaccccagaattatttaaagtaatattcataaaaggactgacttatgatatttaatataaaatgaaagtaatttatattagagtatataaagtatagtgaatattcaaaaagctccaatacattctgtctccttcacacttgtttttagttctgaaactaatacaaggatttagaaaataggactttatgcaatataaaccacctagctagtatattaatatattataatttttaaatattaattattaaaaattatttactgccttcattatgccaagcactcttctaagcactgaagaaatgcaatgatcaaaacacatacaattatgctatcttggaatttacagtccatgaggagtaagtgaggagagataaacaataaacgaggaaacaagcaaatacagaatatgtcatgtacggattttggttgtgatgaaatataaatcacgtaaggaaggaaatggtggtgcaggtgttgagggcaatatttcagatgctatgagaaaacaggtctctctgtgaaggtttcatttcagcagagagctgaatgaaatcaaggtaaaaggcatgctgatcattagggaacagagtgttcgtgtaaagtgcaataatgaaattgaaaaggtctaacttgatgtggtttggggtacccgaagagcagcaagatgactagtatggctgaagcaaagaagcaatgcatggtagaaaattatctcagagaggtcactagaacaaatacactgatctgtttgcagtgaattgattcttaaaattttagtaattatgatgttatatttactctattagacaatgtgacaagaagaatggatcattaaagaggcataagtggaaaacacctgtttcaagatatgtagtgctatgataacaccaagggaatacatttgaaagcattagtttgcagctgcagatgtaatgagtttctctaatattacttctttgtaagtgaaaaggagctgagaaaattagatgacaaaaattctaaaaatgttaaagcaacaaaggtaaatgtaattagatgtgaggaatgttcaactgccaactggcagtatagctgtacttgaaagaaattgatggaccatctaacagttctagtcccttatattccagcagccacttcctgaaaaaatattcagttgggaagaaagttagataccaggatctgtctttcaagatgaagcttcttgaaacttcttctctcaacattgtagtttaaacggaagtttgaaataattacaagttttcaataattctactacatttctttattgtatattagggaattctgtcatttgcaacaacacagattccatcaaattttatgatctcattgaaaagctgctatatttgaaaataatcaaatgtaaaagtctatttcaaagcttttgacattttaactgtttatcaaaagaaaattcgaattagtaataattttcagattcaatatcaaattatgtaataactcagcatatacttcacactaagccaataaggtatgcttactgttttgatgtgtttttatttgatggcatatcctgctagactcaaagtctgacccattttctgtgtaaaacaatgtatggtctatgatgtttccatttcttatctgaaagcaatgatttgtaacattgctttatttattgtatattattataacgtttcttttaaatatattaatatataagctaatattcatgttaccaccattaaatgaaaaacatgctaggtcatagtgtggtatccttattaatataacataatatttctgtaaaatttgaaatttattcttggttttattgtcacaaaaaaaccacaatgaagaatgaaacaactgctttcagagccaatatattcatccaacattttcactctaagacccaatcaacattctttggtctttaaatgttaatgtgtgcactgtcaaatgattccttagtcatgagttttagcaagttataactggatagttttctctattacagaacttttttgagtctgacataccatatatacaatatgacaatgaaatagtggtaattcgtaggtttctctgaatgaacatatttctatgtccttgaaacactattccatggagcagagcatgggaaaagatgtttctgtaccacaatttctagagaccaggacatagatcttagtatcctaacctcttccctcttagagccttcctttcacagagtaggcaatcaactttagaactatcaatgaatatcacaaaacaatgtcagagtattgctttccaagcctcctgctattggcaacatgaaggataatgtaggtaggcagtggggaatattttattttcccctttataatctgaaatctactagtggacagcaaatatataaaatttttaaacttggaatcaagtcacaccttagtttcagggtgccaattatcacaaactgtaaaactctatacttttaatgagaaaagaaagaaaaatatggtgatagtatttttgacagaaccaacaatataatagacaataaagattttatgtccctgagtcaaatgcagctgctgcaagaacctgaaaactctatgagggtggatattatactaaggaaacctggggaggataatagtttatctatcttcttattgttatatttctggctccctttataggacctcattaataatagacttttagtaacatctcttgatggttgaacctagaaaatgtatgattattttcaacatagttatctctatatatactttcaaataggaagcaaagtagtaataaagtgtataattccttcaaattatttcaactcagagcttttactcacaaaaatcagagctcttccttggctctcttatttgacctctggtcctaaggattgcagtggaagcagttaacctccatctataacacatgatctgaatcagtttagtaatattgatttctgtaacttcccacttattaatatataaaagtgttatagtcacattggtccaaatttgacatttccagaatacttccagtttttggttaatatgtcaaatttgtaatcttataaggacttaaggcccatccttacaatcagaggtaaaaaaagacaaataatgttttcatagaaaaccgtgcagattcagttattgccagaaaatacccaacacataaaattttgccaaataaaagtgtatgttttttcaaaagtctattttccaatgtttgaggtggggacaatagacttggtagccaaatgataccattaattcaaccccatactggaaaacaacaaaaaataatttttagagaaaacttatgtccttagtttgtaacgaagtgtctataaaagactagtctttcagagtagatttatttctaattgaaaagctaaattatcaacaaatgttaacattttataagtggtaattgccacttactatttagttgtcaaatgtgcatgtccgcagtgcattcctctccaagatgctattgtcattttctgaaagtaccaaaaacacattgcactttaatactgttagacacttggaggaaattcacgaacaattccctttggactagcaatgaaataccacacttgaatatcagccttacttcttcaaggtacttagaaaaggtcattcattcagaaagaacaaaaccaaataaagttagatactctctgagaggaggcttgctttgatagttgtattcacatctttaccaattaacatgctctagaatggggcatccacgtgtggtatgcttcacgatgaaccgttcactttcactctattcaccacctcactgaatactcttagtttatttgagttgaatattcagttgactcttgaacaacgtgggggttgctgcctattgtgcagtccaaaatttgcatataacttttgactcccccgaaatttaactgctactagcagttaatagataatagttgactggaagtcggtgataacatagtgaattaacaaatatttttcatatcatatgtattattaatatataccatattattaaaggttagaaaatgttactaagtaaatcataaggaagagaataatgtatgtgctgataattaagtgtaagtggatcatcataagggtcttcgcccttgtcatcttcacactgagcaggctgaggagaaagaggaagggctggtctttctgtttcatgggtggcagaggtgaaagaaaatccacacataagtagactcattcagtttgaactcgtattgtttaagggtcaactgtattacactttgtgataaggataatgtgtgttgcatgtttgatgtaatgctacatggaaatgaatactcccaaatggggtaatggtcaaattttctgaaggatttgtagcaagattaataaatttcatccatccacaaaatgtttttagtttcaaatcaatatgaaccattagaaaaaagtagatgtgcttgatgattaaatgaattttgtaataaactttcatttatataccaaaaccaaaataacagatatctaaaaaaaaaatgcctaaaatgaaaacatagagttggacaaaatagtgaaagcaataatatttacctgtttaactaaaattctattaaaacatgagttatttgcatctcatctccaaaacaaaaataatttctcaaattcattgtaatgtcaaactatgtatgtgggtacatgctttgaagtataatatattttactacaaaaattcaaaattgtttaagaagtgttttgaggccaggcatggtgactcatgcctgtaatcccagcactttgggaggctgaggcaggtggatcacaaggtcaggagtttgagaccagcatggccaatatggtgaaaccctgtctctgctaaaaatacaaaaattagctgggcctggtgttgcacgcctgtagtcccagctactcgggaggctgaggcagaaaaattatttgaacccaggggtgcagaggttgcagtgagccaagattgcaccactgcactctagcctgggtgacagagtgactccatctcaaaacaaaacaaaaaggaaacaaaagagaagtgatttgaattcatatttaaacttggccaaaatttattttcagattttatttgtacatacacaaacatataaaggtttagaaaaatttttagatctttacatttatgcagttgttatataactaatgtcaattttaatattatactaaattctgtggagatacctgaagaaaaagaaagaataattattttaagtcaactatgtatttatactacaactatttattccagccctaccctccagaacttattagtttacttaaaatcatgtaaattattatcagtaactattttgaagactttttatggcattgttttatataaaaacgaaaaacactgttcttatgggtaaccaccatattcctggtaaaagacaaaaaataaaatatattgaaaattgaaaagagtcagttaacactggtttcaacagaaattaattttggagataaagtctaatgttaaattcaccttggtgatcaatccacacaacctatggctaacagcattcttaaatgtgaattcagttgttaatttgctgacatcttttatataaaaaaataagaatcataatgaatcttttcacagtagtaaattaaatgatttgaatttctgaacccttcagaaaggagaaatttaacttttaaaacgtccatcttttaattaagaaaggttaaagttaggagagagagagagagagcaactgttacttttccagtccctggatttaaccataacaattgaaagtgaaaaatttctaaaagtttctaaaatttgtttaaccttaagaaccaaaacaggtaaggttaatatacccatggctttaaaaaaattacaaatacttctgaatgttttaaattgcctctttgtctaattaagccaggttgaaagttcaaattaactgaaacacaggattattttatattttattttatttatcttattttattttattttattatttttttgagacggagtctcactctatcacccaggctgaagtgcagtggcgcgaattcagctcactgcaatctccacctcctgggttcaagtgattctcctgcctcagcctcctgagtagctgggattacaggcgcctgccaccaagcctggctaattgtttttgtatttttagtagagatggggtttcaccatgttagccaggatggtctcgatctgctgacctcacgatgcgcccgcctccgccttccaaagtgctgggattacaggcataagccactgcgcccggcctgaaacacagtattttaaagtgataattcccaatgtgtcattcattatatttagctgaattataccaaccgcactttcattgacgttgattttagttttaattcaatgtgtgtattagttcgttctcacactgctaataaagatatactcgagactgggtaatttataaaggaaagaggtctaattgactcacaattccacatggctggggagtcctcacaatcatgttggaaggggaagggggagcaaagtcacatctaacatggtggcaggcaaaaaagatagtgtgcaggggaattctcatttataaaaccatcagatctcgtgagacttattcactatcatgagaacagcagggggaagatccacccccctatgattcaattacctcccacgggttccctcccatagcatgtgggatttatgggagctacaattcaagatgagatttgggtggagacacagccaaaccttatcaatgtgaaaatagaagaatatgcacaagctcttgatgttagttctccattttaagcatgtttattttttcaaacttttgtggttttggaacaaaagagaattgttaatacttgttaatttaataacaattttttatatagcatatgtgaactatagttactgaatttagaatttcaaaagaaacagtaaattacacagaaatatctgattgtattactatcacaaatctccaattcgaaatacttttagatgagtaacaatataaaagtactataaatgtactttagacgtttcagtagctagatgacacaattatcatagaagtgagggtttttaaatgatttcaaaagcattattagtgtaacgcttcaaacatcagctccttcagggagtaattcctgattagttccatactctcccttggatcacctacttgtacaactcatctctgtaactgtccttaactactcatctctgtaactgtccttagctaaaatttttatatgatttctttaagtgactttctgttcctcaagattctaactagacactgtcttatgttttttctaagcaactttgttgtatgaagtggcaaaattaggtattatggaaggaagcaaaaatatatgtagctaatattactggatgattaagatctcagaaaaaaaagatgtcaaaaatatttatgatcatggcagcaaacattatgctaggaattgtaatcaatattaaccaatgtccctttgccctcaccctccactcttattcatccattcactcatagattacttgagcaacgtattgggattttttggtttttttgtttgttatgttttttatttgttttttgttgtttttgttttttgttttttgtttttgagaaagagtttcgctcttgttgtccaggctggagtgcaatggcgcaatctcagctcactgcaacctctgcctcctgggttcaagcaattctcatgcctaaacctcccgagtagctgggattataggcacctgccaccacgcctggctaacttttgtatttttagtagagacagggtttcagcatgtaggccaagctggtctccaacacctgacctcaggtgatccacccgcctcggcctcccaaagtgctgggattacaggcgtgagccactgtgcccggccacatattgttgttttatatgcacacacgtgaatttatataaataacattttgttatatacttcattttcttaactattttcactacacactatgttttaagacctatatgtttttctgtgtattcattattcatataactcacccatatccaatggcttctaaatatatggctatatggcttcttcattttttttatttttttatttttttttttttttgagacgaagtctcattctgttgcccaggctggagttaagtgacatgatctcggctcactgcaacctctgcctcctgggttcaagcaattctcctgcctcagcctctcgagcagctgggattacaggtgcccaccaccatgcacagctaatttttgtatttttagtagagacgggggtttgccatgttggccaggctggtctggtctcaaacgcctgacctcagatgatctgcccacctcggcctcccaaagtgctgggattacaggcatgagccacagcgcccggccattacgatggcttttacctgaaaaatcctcaagtgttcatacacatctatgaaacaaaatctatttctaatctaataggaaaaatggctcatttctcaccaccttccattgcctctagccgatgttcttctattcagcatcagactgcatcttcacaggctattgtcctgaggaatgttgtactggaagctggtggctgatttagtataggccatacattgttgaagttcatgaaccatcacagatggaaaactcaaatttccatcaagaaagaggaaatagttctccccctttttccttttcctctatgtgaaaaccacaatgagatacgttgcttatccaattctctgaagatgcaacttaatcaggagtcagtgattcctttggaatccaaaaatgtactaaaattttatacaatattttgaatgtacataatacgcatttttgcctaattgtcattgaatctttaccctatggccatatatagagtcagcagtgcttttaggaaagtaaacatacaggagacttttttaaatgtttagtttatgacttggtactgtgtgaaataatcaaggacaaaatatttccaaaactaaactaatttttgaactaagtaatagcaaaaatagaaaataaataaaatatataacagaaaatgctaatattcagaaaaatatgcatttataactggatatctatttagattgaaaatgtttaattttcattgaaacattgaaaatgtttaattttcaatctaaatagatatccagttataaatgcatttcaactgctgactacctaagtatgaaggaggtctatttgctctgttttttttaaatgtaaattttgcttctatcttagcatgttgcttttcttttctgcacataagtgcaaatattttcaatagtggactgcatcacatatatcccaaaaatacgtgaaatgattatgagtcaatttaaaatctctgaaaattaaaacttaattttagttccttgatgtattaaggtatattaataaaagataaaagtagaagacatttattagacaactgtctgaaggacctggtatatggacttctgcataaaaagactgaaggtccagtaattaaataagaaatccactaaagtctaacacacacatacatgcgtgcacacacacactgttacacatgtgggcaatttttttttggaaggaggcatggggaaccgattcttgctctgtcacccaggctggagtgcagtggcacaatctcggctcactgcaacttccgactcctgggttcaaacaattctcctgcctcagcctaccaaggacctgcgattatatgccaccatgtaatggtggaatgtaattggggaatcctgatcactacctttaaaaagcattctctgtcctgtgcctatgctaatcgtgtggacacggaggcctccaccacttctcatcccagtggtgcctgagaaagtgtccgggttccacccacaggtgcaagaatggcttcctcctcaaagccgtgctgtactgtgcaaccaatctagaatctcataaagtctcatccctgctgagaagctcatccagtcatccatgagcaacagtttctaaatagtggcccttgcttgtctttctttaatcctaaaagtgctgagaaaataatctaccatgcaatttatcctcctgagcattcctaggatcgccttccccaacagaaactgctcctttcttcttgagttataaaagaaaggtctatatgcacatttcttaatgtaatcagatacaatttttagaccagaagagtaaaaaggaattgggattattatgtgccttaccttgcatatgtctatgttggcagataaaatatagggccatataaatatctccctaaaaaaatagtggttgatctgaaattcaaactggctattctgtatgtgtatgtgtatatatatatatatatatatatatatatatatttttttttttttgctatatttgatgaacctagccttaataagaaagggaaccacaggtcagccaaccacaaaaatccttcttaaatctgtaatcatttgaaaatgtggcttcgaataaataatttattaattaaatccataggcagcagttatcccaaaatggtcactttattaatgtgatatgaacagaaagagttattgatgaatatttcactaatgatccaaaatcatattgaaaattaaatgcagatgttagattttgatagtttaaatacgtaattgccattaatatattcacaaaatattattaggaatttaaaatcctttttattaagttatcatgatgaaattgtcataaattaagctatggatagcaaattccttctccataaatttttgaccatcactttcataacatcaagatttatttacatttttcctaccatcaatctttacttcattataaaatgcggtgctcttctaattaaaacatgaatctccatgactgattaaaatggaattataaaaatttaacattcactctgataattttgcacattaatcacggtgcaaactaatgagtacaatgggcattaaaactaatcacatgattatagtaaaataaaaatattgaggccacagattaaagttttcacaggaagaattatgcaagtgtaaagtgtttgtatctttaactcattccattaatttatatagcttcaatagaatataacatgacccataatgtttcttgttttgtgtaagtgtatgttctgttggatcttaacactatcttatttatttatttatttatttatgtttaagacagggtctcactctgttgcccaggctgcagtgcagtggcacgatctcagcttactgcaacctctgcctcccaggttcaagggaacttcctgcctcagcccccctagtagctggaattacaggcatgtaccaccatgcccagctaatttttgtatttttagtagagacagagttttgccatgttgcccaggctggcctcaaactcctgacctcaggtgatccacccatctcggcctcccaaagtgctgggattacaggcgtaagccactgtgcctggccaacagttatgttattgacacagagaattccacaatatcggttacataaatgcaatcttttcaccacttttataaaacatataatataaaaagattcagaaaattttaataaatatattttgaaaagtaatattttatatatatacaatttttttgtttgtttcagacggggtcttgctttgtcacccaggctggattgcagtggcgtgatcttggctcactgcagcctccacctcccaggctgaagtgatcttcccacctcagcctccccagtagctgggactacagggtcatgccactgtgcttggctaattttttaaaaaatatattttgtagatatgaggtctcactatattgtccaagctggacaataactcttgtgctcaaaaactttcctgctttcagcctcccaaagtgctgggctccaccgcacccaccttaaatcattttttctaaaaataaatacttttttattattttcagagatgaagtttgcctgatcttacatctgctagatgtcttgaaagtcaagtctcaccagatgagtgggagaaaaatcacataagcctaaatagtatatgtaaaaaagtgtcagcattggaattttaattctggaagtttccttaaaaaaaaaaaatcaattaggccaggcacggtggcttaagcctgtaatcccagcacgttgagagaccgacctgggcagatcacgaggtcaagagatcgagaccatcctggccaacatggtgaaaccccttgtctactaagaatacacaaattagctaggcgtggtggtgggtgcctgtagtcccagctacttgggaggctgaggcaggaaaattacttaaactccgggaagcagaggtcacaatgagccgagatcacaccactgcactccagcttgggtgacagagcaagactctgtctccaaaaaaaaaaaaaaaaaaaaaaaatcaattaaaatcccagggcttcagctttctcatctctaaaatagatacaagtatgtagacacacatatagatagatataaatatcttatatttattattaggattttgttgaagatcacagttggatcgattttaaacttggtaaaatgttaggctataaatacaaaagtaattattgtattagcacataaattatatgtagatgaataaatcataggcacttgaaagtagtatttgagtaatatatagtttttttttaatccctggaaaattttgacatcattaatttgttaagtaaacccttcttgctcagtaaattttttcatattctattcagataatggagaattataaattaatctatattattaatactatataaaattaattccttatatgtatatttatggaattattgtagccttttttcttccttcctgtaaagaagaataactctttgcaaataacctaaaaattatgatcctacagcctcacgggattactggggattgttttgttcactcttcctgggggtaaaaaattacatggataacagagactaatgttcttgaagaaaatcagtgcttccctggcatttcaggaatcaaattctcagctatatcttcttttaaagattcagaacactataaacactttttcattagatgccaaacttctgttacaacacttcactgctctagaaataaattttctggccgggcgcgttggctcaagcctgtaatcccagtattttgagaggccaaggagggctgatcctgaggtcaggagttcaagactagcctggtcaacatggtgaaaaccatctctattaaaaacacaaaaaattagtggggcatggtggcgggcgcctgtagtcccagctacttggaggctgaggcaggagaatcgcttgatcccaggagatggaggttgcattgagccgagatggcgccaatgcactccagcctggtcatcagagtgaaactccatatcaagtaggtatgtgtatatatatgtatacatacatacatctcaagtatgtatgtgtatatgtgtgtgtatatatatatgtgtgtgtgtatatatatgtgtgtgtgtatatatatatgagagagagatagactgttctgttaattttaaatagaatggaaacatcacaactcaggataatttgcttgtcaaattatacatagaactactgttctgccaggcaattgttgatcttaatctgctgttttcaccgtatggggtctctatataggatgaatctccacatttttggtctaaatgtaaaagactctatccagctctcacttatgtgtatgaattcagcctaatctgtttggaaatcatcatcatcaccatcatcaaatagtaatactcaaatttgacaaatgttctctattttctaagtcttgggcaaaaagggtcatttcattaaatctgaacagaaatctcatgacataggtactatgattattcttgcctaatagatatagaaacagatgccaaagtatctcactcaagattatatgactcataagtggcaaagctggtttttaaactctcatctaacttactacgaaccccataattcaaatattatttcaaataataatattattttaaatattttaagtaatttctattttaaataatttgattaaagaccaaatgccttgccttcttttctagaataaatgcaagctaccagttccttgcactagcctaggccagtcttgtaactgaaacccattggattcaaaatctatttcaagtacttaactttcttctgaaaattccctcagctataaatttgaggttggtgataattgcaaagatgccagggaaatttataatcattactgaactaatccttttgaaaatataaagcagcattaaatgttaatattactaatctttctaattagataaaggggcaaatgtgtccaaaaagtctgtaactaagttcattactctcatttatgcagctaagcttaagttctaacaaatgtatgttttaagttgattaaaaatatggttggctgcatttataaatacccattattaacaggctatattggtaaatatatttttgctcttatgacaagagaatgatgtactttggtcaaaaaaattatacctcaataattatctgctctccttctatttttatttgcaatagaagtgtatttattcatgcatttgtattcctattgaatgaaggatgttatgtcacttgcattgggtacataggcatcccttttgacaaataaaatcagaatctaaactacagaaccaggttaaagtgggaacagaagtacaattttaataaaggccaaagttttgctagtgtttcacttaaaatttgtttttaagctttctgaatgttctctcaaagataaagacttaatcatatatgtaccttttttgtattgttaacagggaagaaacatactaatatgaatggtattacatacattatacatgttatacaagagaagaaaattatatattcaagataaacatttttataatcacaatacttcaacataaatatgttcaatatagtaaagatggagtttgtatgatttgtcaagcaaattcttctcaattatgtttacattctatttaaaatcaacattaatgttgacaatattcatatataaggctttttaattatttaaatgggttcaaatttgctgtgttcagtattattagtaagaaaagtaggcactggtacggaaaaatatatatttttagctcccttctatgagtgtttccattaaatgctatggtctcacagttttacatgcctctcaccacctcactgctcttgttgcctataatattttattagtttaatccttctgaaataatcctggtcattcaaaaccaatacatcaaaatcttctagagtgaacaaaagaaaaaacatttgtgaagattaaaagaaaaaggagacttctcagatataataactttaaagaatacatattacaatggtggtttgatataaagataatttagatccatctactttgaaaagatgctttcttgacagttgaaattttttacactattttaagtgttttcctcaagaatttcttgttaagaggtcgtttgttagctttcaagttccttgaggcctgggtctgaaagagtatctgaacagtgggtgctcagtacaggtttgttgaattgaaccagaataatgtcagtcatatcaaaaaaagaataagagggaaaaagaaagaaagcagagcaaatgaaccgctttggttttgacacttgtacaagtgctgaatcgacagcatatggccaggtataacctagtgtgtgagtgggaaggtggattaatctgggctgaccttttctaatggacaaagcaacttggatcctctattttaaagcgcttaaaactttgatgtaggaggtgttacattatttggtcttgacttgtcataggcctctgtcaccttattagcaaatgcaaacctggggctaccttttttgcctatctggtagatatttatggcaaagacagcaataaggaattccagaaaataagttgctggcagctaagactcttttacttatctgaatggtaccaaacccacaaacttctttgtgaggtttgcaagttgcctgcttctgaaaatttttactgttcaaagctgacattaattcaaagctaccaagtattatagatggcttgccaaaatacaatatggatcgtagtttgtataaaaacaaaaatgaaacaattaaaagaaaccccacacacataaagaaagctcgcacaaatgcaagaagaccatgagatggtgtgtcttagttctggtatgacaataacaatttaatgtcaattcataattttattaagatgggagtcataatgatcatgtgccatgtgagaatatttgagacagatcaaagaagagaaaaaagaataaaacctctagtattaccaaacctttgctctattatcatttctgaaaaaaaaaattgtaaaactaagaaaaactgggacattttgaagaaaatgaagtcaaaaaggtgaatataaaattttgctctagcaacactatgaaaaactgttcgaaataaaggaataggcaaggcaaggaacctcacacctgtaatcctagcacttttggaggccgaggtgggtggatcacccgaggttgggagtttgagaccagcctgaccaacatggagaaactccatctctaccaaaaatacaaaattagcctggcgtggtgccacatgcctgtaatcccagctactcgggaggctgaggcaggagaattgcttgaacccaggaggtggaggttgcagtgagccaagatcccaccaatgcacttcagcctgggcagcaagagcaaaattccgtgtcaaaaaaaaaaaaaaaaaaaagaaagaaaggattaaagttacaaaatctcatgcctatgtcctgaatggtaatgcctaggttttcttctagggtttttatggttttaggtctaacgtttaagtctttaatccaccttgaattaatttttgtataaggtgtaaggaagggatccagtttcaactttctacatatggctagccagttttcccagcaccatttattaaatagggaatcctttccccattgcttgtttttctcaggtttgtcaaagatcagtagttatagatatacggcgttatttctgagggctctgttctgttccattgatcttcatgtctaaaacaccaaaagcaatggcaacaaaagccaaaattgacaaatgggatctaattaaactaaagagcttctgcacagcaaaagaaactaccatcagagtgaacaggcaacctacacaatgggagaaaattttcgcaacctactcatctgacaaagggctaatatccagaatctacaatgaactcaaacaaatttacaagaaaaaacaaacaaccccatcaaaaaatgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggggaaataggaacacttttacactgttggtgggactgtaaactagttcaaccattgtggaagtcagtgtggcgattcctcagggatctagaactagaaataccatttgacccagccatcccattacggggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaaggatgagttcatgtcctttatagggacatggatgaaactggaaatcatcattctcagtaaactatcacaaggacaaaaaaccaaacaccgcatgttctcactcataggtgggaattgaacaatgagaacacatggacacaggaaggggaacatcacactctggggactgttgtggggtgggggaggggggagggatagcattaggagatatacctaatgctaaatggcgagttaatgggtgcagcacaccagcatggcacatgtatacatatgtaactaacctgcatgttgttcacatgcaccctaaaacttaaagtataatagtaataaaataaaatttaaaaaaagaaaataataatatcatgatactgttcttaacagttcatctcaattttgtagacttatatgcttctgccacatgttaacttgtcttggtagtaaaaagacaaaaacagatggatgctgattgcttaatggcagaaatatttgtctgtagtttttgctactttataaaatattacaaaggaattcagaggtgggccaaaacctcaaacttaattgaaactctctagtgttgtctgacaaattaagattgtaagtcactttattatacagcatctggtcatatggtatatcatcaatgccaattatttcttttttctttaaaaactacaatcactacatatacacagttcctgcactcctagtaagaggttttgttatacatagaagtaagcaagtttaatgtactcatttcctaagaaataagagaattatcaatgttaatgttagccaaaaacgtgttcttaatgctcagtttgtacctatcattaaaatttaatataatctaacccaattatcaaaaaataaataaaacaaaatctcacaaagaggttccattgccttaacttatctagcaactatataataacatttatcttctatcaaaaacaccgagatagttttcattttagcaatttacttgtttggcactctacatacattgcttcataaaatatttaaggttatgataggcagtcctggtgtggtggctcacacctgtcatcccagctcctgagtccagaagtttgagaacagcctgtacaacatagtaataccccatctctaccaaaactacaaaaaaattagccaagcataatggtgtgcaccgatagcctaagttactctggaggctgaggtaggaggcttgcttgagcccaggagatggaggcttcagtgagtggaaatcaggccactgcactccagcctgggtaacggagtgagactctctctcataaataaatacataaataaataaagttatgataggtagaactttttcagtatttaaaaaaaaggtaagtggtcatcatccacatttttcagtaaagaaaaaagcaaggggtcaataattaaacataattaattaaaataaaattcaagatttaaaggaatatcctatttgacaaacttttgctttctttttctgtgaaaatctcacctgaagatgtctgagtatcaggggaggagtaaggaggaataggcaggaaaacctggctaggagcaggatgtttagctttcatttgacacacagctgtcaaactgcactgtgtgtccttttccattgtaaacagtcacataatacataacaaaaaaattttaaaaagcaatgcatgtatacttctagtttatatgttgatttatttgaagagtcgtaaattattaaatactaagatatactgtattagatgtgtaatacacatacgttatatatacatgacatatatgtatacatgctacacttgttttcatagacattgagttctatacatgtaaattaaagtgataaggattttcaagatctcactgaaagaatacctcttagagtgaaaatcataaatgaatatacataacgtatttctagtagaaaaatgaattcccttgtctagatgcagtcagtcgtgagaaaaaaataaaaggaggaagatatctttagagatttcttattgcgccggtatttttcatttgccctggcaagtccaatctctattcttctcaaacttgctctgtgcacccaggaggctgaaatatacaatgtattatttccagggctcccttactgcctgatgtcagtggggttcagccaataaaaagcaggagcaagtgactggaggaagagagaagaacaagaactggaggaagagagaagggtttggtaagtagttacactcctggctccctcctgcttctaggaatgctggcattaactatttccttgaccaaaactcaaagatccagccaggcagctctgtcctcacaagcttctctgtctatggattttagtaaattatttacctctcccctataggactaggaatgataccagggtccctttattactaactgagaggttctagactattcttgtgtggcttccctgtggggtgcccaaatctttattccatgtttctcaagttaccacatcagttatcttttggaaacctgaatgcacacctaaaatatctagaaatttgagacctttgttttctggatctttttcaagaattagtttaggtgctgacttgataggaatttagcagagtattttttcaaaaatacacttaaaactacgtcaaactgttatttaattatgtaatatatttgttgctttatctaattagatttgcatttcttatatataccatgcatataaaaatatatttgatacaaattataatacaaggcatacaaaactagaccattataataacagaacattttctaaagagattttaaaagtgtaagtcaaatgccttaacgtaatactacttctaaagtgtattctaaagaaataatcttctatgtgtggttagatttaactacagaaatattcattgtaacctttctttagaagtgaatattgaaaactgaaataaatctaaatgtccaactttataattgctagttatggaatactaacaaatgaaatccatgcttttaaaatagcatttagtgacccaaatatatgttcaaaatacgtataaaagaaaaactggtatgttattaaagaagatagaataaaatttcttttccaaaatgtatgctaacaagacagttttgaaacttccgaaaacgaaaatgttgttaggtaatattttcactaaaattaaattttctgtttgctgagattataggtgtttctaacaaattttactgttgtttatgtatgctatagacactgaacatgtataatttatgtatcaaggaaaaaatcagtaagttcaattttttcaataaaaattaaaagtcacataatatatccgagaagataaagacgaattacactttatctgacaaaagagagtgcatggtttatggagagagacaattttttctctggttttagctctaagatataaaaggaatttattgtatacatctggaaataagaggtactgaatacctaaaatatattaagattaattactgttttagctttttttttaacagtatagaagtattgtgtgatgacttatcttatcaaccattgaaagagccattttcaaagactgattaaaatagaagacttccataaacaattttcaccgaagcattgaaaactattatctaagattaagaaaatacttttctagggatccctcatatctagggatctaattaccattagatccacctcatataatggaattaggacaacccaaagatctggatgattgaattgtcatttggggattattaccatcatacagctcagtttatggcaatttctatacatgtatttagtattaattgaaggaaactcataggaattagatgtcagacatgaggactacatacatatctttagagtgcttgtgtcctaaactgaaaagtgtattttaagagtctgggatatgaaaccaactttttctctattcttgtcaaatccatgtcattctagctactgacataatttgcacaatataagtacaaataataatgagcaaatttatgtgaaaatatgtttccagtgtacaggtagttttaaccattctttttacaagaaatgtgtgtgtgtgtgtaaatgtcttaattgttataatgattaagtcattcacagatgtgttaacaatgttttctccatgtagacagagtgataataatttgtattacattttagagttgtttgatgcaaataaataagaactcaaaatttttttgaggttaaacttcaagaagatgaaaggaaaactaaaatcacaaagtaaaatataattaaaacatttcaactaagaaaaaagtaaaaagttaggctgtctagacaatgtttgaagtttaagttggttaattgcaatggaaaaactgctaattaccacaaatagtaatttagagacataaatattatacaggtgtggctgcaggaagttgattttaatcaaacacatttggcgtttccaatgttgcaaaaattacaattgtaaacactgtccaattcaatcaaatgttatgtgaattttaagtgagtctcagtaaattatactgtataaaaacaggatttttactatggatcataattgctaatgtgtttcatactcgatgttgaaatataaatcaattcactctcttatttggtttggaaatttaagaagacaattcaaatttcccctgatacactctaccagtgtcactggactggtgatgtgacaagaaaggtcttctgtagaactgaactgcaataatatggagactgtaacaaaattacatatgtacctaagaatattgactttaaaagccttcttcagattgcagcattgatttctagatctgttgggaactggctgccttacttaatgtaacagtcttggcaatagaataatcatatttatcacccatggataattaatttttaatcattgaaattcactgaaatatgttgaatatgaaaactatacaaatataattttgtatgctacgataagtttcagattctttgaaattttattctaaccatcaatcataatggtatagtatgataaaggtagaacatgtaattataaattcaacatttaggaagtttatttttctcttctttttaattatctcaaaatgatcttgatttctgcaaagtattagtatatctggtaggtgagagtctatttcttttaaacttcatctgtattaaccagctttataccaccaaaatgtcccccaaatttaaaactttacacagtaaggccttatatgcacacctggcctcatttcaaaagactaaagcagtggttctcaaattcagctgcacattaatagaaactggaaaactgtttaagctcctgatacaaagccacatgtcagactaatttatgctgaatcactgggccaaggacccagacatcagtatttttaaaaactatggaggaataaccaggattaagaaccactgcacaaaatggtaaatgcaacttttatttaagttatttttttaaagaaataatggttgaattgatactgatcttagtaccaagtcacggcaattttttctgacttagagaattcatcctggcgttaagattattaaagaacctagaaattcaagtgtttttgtttacatttttcctgtaaatattagagtatgctagtgctcagccttatttgataattttggaaaatatattaaacatttgagattaaatatcaaaaatctctaaaataattttagaaataccattcttctatgaaataagtaagctcagtcaagatacatattatagtgcccatttaagaacgtctaataataatgtttgcactgcttaaagattaggttgataaattaattattgttgattctacttgcataatcaacagacacctagagatggagtcttaagtatagacacagaagttgaatacttttaagaacttttaaatttacgtcctggttaaatcttactctaaaattatgttgcatggttgtgattagtacatgtgtgattagaaccgtctttctcaggttattacaccaccatatagacacagcaaaaataataaaattaaaaataaagcaagaaaaataatgtaacactttattggctttgagataattattttgagatcctaatcctaccaaaacattctgcttttcttaatttgatcctacttttttttctttgctcgttttaataaaggatgaaccaatatcctgagaaattttcaaacagggctgagtataacactcagtccctagatctcactgtattttagaaaaattgtaaagtatttcaaataatgagtaaagtttcaactctgcaccattgtgtctttgtaatacagggaaagtcacttcacttctctccctctctcgtttttggcatatgcaaggcagagaaaataatatctactccagctatcccataggttattataaaatataataaaagatagaaaatcactttataatattcaaagtattaaaaaagtaaggcatgattatatgtgggattaacagcagtttgttatttaccatttaatgtattttaatgtacgtttttgccatatttaaaaattataatttttacattttgatttttaattgaaagagtaatagtatgacattatgccatgttatatctgatgccattatgtcaaacaaacaaacaaaagcattttaaactatttggaatatgataaaaataaatcttttaactatgataatacaggtttttgaggatttagtttgtacagcaaaaacagaggcaataaaggcaaaaatagataaacaggattacttaaaactataaagcttgtgcagagcaaaggaaacaggagggtggagggtggagagacaacctacaaactgggagaaaatatttgcaaaccttatatctcaatgtactagtgactatcaccctaataactagtcacgggagcattgtcatgcatttcgtattttttaattttcgagatgctgccacttaccatggcgggagcctgatccctgcggaatcgattgtggctggacttatcttgaatattctgagtcaacatacccaaccataaggtgctaattcattcatgcttgaagggcataacaatcaatacacgttcacgcacacaagtacgttcacgcacatacgtacgttcacgcacacgtacgttcacgcagatacgttcacgcataatttaaaggactacttctgattaaatccgaaaatccaccctccctccatctctgactttattgttaaattaggtaagaggtacccttgccgacccccagaaacaagatacttaaattgaacctagtcagaaccctaaaaatcataatttaaccatgaacactccaacactagcccctcgattaacgtaattttctaaaaaatcccaatattctccaaccaaataaaatctcctatttatatgttaactaaatttctgtcttaatacttatataatacttcaagcatccctctctgaaaagtgtgtatcccagatattatagtcctaaatcaaatataacttcaactacaaatgtcaccttagccaaaacctctgctaattcaacttttttaaaggccctaaacttccaggactgcaaatgaccacttcagatttatacccaacaagattctaccctgacatccccctagtatttcaaaataccactcaaatgtttttcatccagttaatgtagcttaattatttaaagcaaggcactgaaaatgcctagatgggtccgcaaaaccccataaacatagaagtttggtcctggcctttttatgaattctcagtaaaattacacatacaagcatccccgccccagtgagaatgccctccagatcacctggttcaaaagaaggaggtatcaagcacgcataaacgcagctcaaaacactttgctcgaccacacccctacgggaaacagcagtgataaattttaattcataagtgaaagtatgactaacctatacaatatttagggttggtaaattttgtgccagccaccgcggccatacgattaacccaagctaataaaactcggcataaagagtgtttaaggtcttcagtcaacaaagttaagctctatctaaatcgtaaaaatctccagctgaaataaaatatactacgaaagggactttaatgtcctgaggacacaacagctaaggcacaaactgggattagaaaccccactatgcttacacaaatagttatattaacaagactgttcgccagagtactacatgcagcagcttaaaactcaaaggacttggcggtgctttatagccttctagaggagccggttctataattgataaaccccgatatacctcaccatctcttgtcactcagcctatataacaccagcttcagcaaaccctaatatatatatatatatatatatatatatatatatatatatatatatatatatatagtaaacacaagtatgcactaggtcaaggtgtagtccatgggatggtaagaaatgggctacattttctacatccagaaatatctcacaataaccttcatgaaatctaaatgttcgaagaggatttagtagtaaatcaagaacagagtgcttgattgaataaggccataaggcaagcacacaagcccgtcaccctcttcaagtagtgctctagaaatcactattattaataattgcttacacacatacagaggagataaatcgtaacacggtaagtgtactggaaagtgcacctggataaaccaaagtgtagcttaacccaaagcactcggcttacacccggaagatttcattacaacctgatcgctttgagccagctccagctccaagccttgctaaaaaatattattagaactacttaaatcaaaccatttaccctcgacaaaagtataggagatagaaattacttattctggtgcaatagatatagtaccgtaagggaacaatgaaagaactatatcaagcaccaaaaagcaaagacaaatccttgcatcttttgaataatgaattaactagaataaacttcacaaagagagctctagccaagtcccccaaaatcagaggagcttctccagaacagctagaagagtacactcatttatgtggcaaaatagtgagaagattcattagtagcagtgacaagcctacggaggctggtgatagctgattgtccaaggtagaattttagttcaactttaaacttaacctacagaattacttaatcctcctgtaagtttaactgttaaagggggacggatcttcagatactagaaaataaccgtcctatagagagtaaaagattttaccaccataattggcctaaaagcagccaccaattaagaaagcgtttaagctcaacatctgactaacttcatttctaatcaccctgttaaactcctaatattacattggactaatctattattcagtagaagcaataatgttagtgtaagtaacattaagacattatccattgcataagcttacatcagaccagaataatccactgacagttaacaacctaatattaacaaatgattaatagacatcttattatctttattttaacccaatacagtcatgctctaaggaaagattacaaaaagtaaaaggaactcggcacatttcaccccatctctctaccaaaaacatcacccctagcattgctagtattagaggcactgcctgctcagtgacatatgtttaagggttgcggtatcctgaacttgcaaaggtagcataatcacttgttccctaagtagggacttgtatgaatggccacaccagggtttagctgtctcttactttcaaccagtgaaattgacctacctatgaagaggcgggtataaataaataggagaagaccctgtggagcttgaattcattaatgcaaatagattcaaacaagccaacaggccccaatgtatcatccctgcattaaaaattttggttggggtggccgggcacagtggctcacgcctgtaatcccagcactttgggaggccgaggtgggtggatcacgaggtcaggagatcgagaccatcctggctaacatagtaaaaccctgtatctactaaaaatacaaaaaattagccgggtgtggtggcacatgcctgtagtcccagctacccaggaggatgaggcaggagaatggcatgaacctgggaagcagagcttgcagtgagcggagatggtgccactgcactccagcctgagagacagagtgagactctgtcttaaaaaaaaaaaaaattggttggggtgaccttggagcataattcaacctccgaaacgacttaaactaagaccgcactagtgtaagtcagttattacacattgacccaataattctatcaacaggataagtgaccctagggttaagagtgcaatcctattctagcatccatatcaacaacagggtttacgaccttgatgttggatcgggacatcctaaatggtgtagccgctattaagggatcatttgttcaatgattaaagtccttcgtgatctgagttcagaccagagcaatccaggttggtttctatctatttagcatttttcccagtatgaaaggatatgagaaaccgggcccacttcacaaagtgcccttacaagactaggatttttacacaatatgctattggttactgagtgctattgtagaaccggtgcccaggtcttataaatttcaggttcttatgctttccactaagctgcattgcccttctccttttttaaaattttttaaattaatttatttatttatttatttatttttggctccatcctacagactgtctgggagttgtggtacagatattttcagccatatttatggtagtttcccacctcacttgaggtctgtgggtagcaaaagagaaaagttagctttttttgccttttccatgccctcctgtttcttcactaaaccacattcaataaatgatctaggagcttttacaatgctccatgtacaagaacctcacagaggaattacacacagttcctccttccagagagctctccatatattacgagatcaatttggcaaagagaattacaataaaatgcagaagtgctgtgagagagttgtgaatggaatgatgtggaaacacatacacttatatattgaattctatcctaagaagttaggaaaagttttcagtaagagttggcatttgaactgaatcttacaggaagaaagtatggtaagataattagaggaggatgtgataaaaacgaggtaatcaaagtcacattgaaatgtgtgaatttggtggaaagtcactagttgttgaaggagagaggtagacaggaataacgtaaaagacaggagccaggagaagtagatttaaactagatcatgcagaattatatacaagactaggatttttacacaatatgttataagcaagtacaagtaagtgatgttaattaggtggattgaaataatggttgcaagatagaggtgatagagaaattacagatatattatgacaatgatataaagaataaaattgagtaaaaaaatagaaagctgttaaacataccagagaaattattaaggttgaattaaggtagcaggaacaaaaaagaatttcatgtaagaaaaatcttcagatagtattgaaaaattcatatactgactagatacaagaataagagaggtagaagaaaataactctgagtttccttgaatgaaaggcagatgacaaactgaataattaagttataaaatacacacacacggggggaggagccaagatggccaaataggaacagctccagtctacagctcccagcgtgagcgacgcagaagacgggtgatttctgcatttccatctgaggtaccaggttcatctcactagggagtgccagacacggcgcaggtcagtgggtgcacgcgccgtgcaccagccaaagcagggcgaggcgttgcctcactcgggaggcgcaaggggtcagggagttccctttcctagtcaaggaaaggggtgacagacagcacctggaaaatcaggtcactcccacccgaatactgcgcttttccaaccggcgtaaaaaacagcacaccacgagattataccccgcacctggctcggagggtcctacgcccacggagtatcgctgattgctagcacagcagtctgacatcaaactgcaaggcggcagcgaggctgggggaggggcgcccacaattgcccaggcttgcttaggtaaaaaaagcggctgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacaggcagactgcctcctcaagtgggtccctgaccgctgacccccgagcagcctaactgggaggcaccccccagcaggggcacactgacacctcacacagcagggtactccaacagacctgcagctgagggtcctgtctgttagaaggaaaactaacaaacagaaaggacacccacaccaaaaacccatctgtacatcaccatcatcaaagaccaaaagtggataaaaccacaaagatggggaaaaaacagaacagaaatactggaaactctaaaaagcagagtgcctctccacctccaaaggaacacagttcctcaccagcaacggaacaaagctggatggagaatgactttgatgagctgagagaagaaggcttcagacgatcaaattactctgagctacgggaggaaattcaaacgaaaggcaaagaagttgagaactttgaaaaaaatttagaagaatgtataactagaataaccaatacagagaagtgcttaaaggagctgatggagctgaaaaccaaggctcgagaactacgtgaagaatgcagaagcctcaggagccgaagcaatcaactggaagaaagggtatcagcaatggaagatgaaatgaatgaaatgaagcgagaagggaagtttagagaaaaaagaataaaaagaaacagaaacgagcaaagcctccaagaaatatgggactatgtgagatgaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctggagaagagcaactccaagacacataattgtcagattcaccaaagttgaaatgaaggaaaaaatgttaagggcagccagagagaaaggtcaggttaccctcaaagggaagcccatcagactaacagtgaatctctcggcagaaaccctacaagccagaagagagtgggggccaatattcaacattcttaaagaaaagaattttcaacccagaatttcatatccagccaaactaagcttcataattgaaggagaaataaaatactttacagacaagcaaatgctgagagattttgtcaccaccaggcctgccctaaaagagctcctgaaggaagcgctaaacatggaaaggaacaactggtaccagccgctgcaaaatcatgccaaaatgtaaagaccatcgagactaggaagaaactgcatcaactaacgagcaaaatcaccagctaacatcataatgacaggatcaaattcacacataacagtattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaaccaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacagctacagaactctccaccccatatcaacggaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaaactgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggtttttcgaaaggatcaacaaaatagatagaccactagcaagactaataaagaaaacaagagagaagaatcaaatagacgcaataaaaaatgataaaggggatatcaccaccgatcccacagaaatacaaactaccatcagagaatactacaaacacctctacgcaaataaactagaaaatctacaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagtcgaattctaccagaggtgcaaggaggaactggtaccattccttctgaaactattccaatcaatagaaaaagagggaatcctccctaactcattttatgaggccagcatcattctgataccaaagccgggcagagacacaaccaaaaaagacaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcattatacgcaaatcaataaatgtaatccagcatataaacagaaccaaagacaaaaaccacatgattatctcaatagatgcagaaaaggcctttgacaaaattcaacaacgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagagaagtcaaattgtccctgtttgcagatgacatgattgtatatttagaaaaccccattgtctcagcccaaaatctccttaagctgataagcaacttcagcaaagtctcaggatacaaaatcaatgtacaaaaatcacaagcattcttataccccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcattgccaagtcaaccataagccaaaagaacaaagctggaggcatcacactacctgacttcaaactatactacaaggctacagtaaccaaaacagcatggtactggtaccaaaacagagatttagatcaatggaacagaacagagccctcagaaataatgctgcatatctacaagtatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacgaagggctaatatccagaatctacaatgaactcaaacaaatttacaagaaaaaaacaaacaaccctatcaaaaagtgggcaaaggatatgaacatacatttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaataggtgctggagaggatgtggagaaataggaacagttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaattgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacaagttagtgggtgcagcgcaccagcatggcacatgtatacatatgtaactaacctgcacattgtgcacatgtaccctaaaacttaaagtataataataaaaaaaaatacacacacacacagagacagagagagagagaaagagagagagaatatttaatgttattttatactttataatttgagtcatttataaaaatatccaagcaaaagcgcctactggtcaaatgacagaacctgagtctagatctgaaagaaacctttggtttgtagataaagacgggagcgtctatgagtgtagaagtaataatggattacacatagagtacaaactggactgataagagaataaaaacaattacaaacttcacagaagagacacagcgagtgactataatttgtaaaacaatatagacactccaaaatttggaggaaggaaggaagaaagggaggatggaagagacagggaagagatagggaagggaaggggaagggaagcagagggaaggggagggggaagaggggagaggagagataataaaatacagcagggagaagaggcaaaaaaattagaaatgatctgtgttccaggactcaagaaagagtctcatctcctttaacacattttctgtacttcattgggtaggacagaaaatgtgttaaagcagatgagactcttccttggcgaggtaaaaattagatctcttttcatatgaatttacttcaagctatagatatccataagtaattggtatatatctgttaccaaaacaccatgggttctgtctagatcctgccgctcaccacacaggaagccaatcactgagacaatgactattgccaaggaagaagactttaatcaggtgctgcagccgaggaaatgggagatcagtctcaaatatacctccctgatcgactaaaactgaggggtttacatagcagaaaagaagtgtaactatgtatgagaataaaaggaactcagtgtgggataagaaagcaatcatgatgaagaaagggcctggcatttcattatctggatgtgatgatctggtttcagttctttgatatgttctgagaggcctggggatcctttcctgaggaaggaactcagataaaacaaatgtaagtttcaagctttaaggccagaagggttaatttctgttaatccaaaagcgattgtctatgggactatacatatatgttatatatatatacacacacacacacacacacacacacacacgcacacacatatacacacaatatttgagtacttttctttttttttctggacttgtgtcccttgctaaatgtttcactattggctattccagaaggtaaaaatgacatctgacctgattgggaagaattgtaattcttatatgtgcaaaaacagatgagagaggatttgcactttcagataagtgtaaccaatctaaatgtattgcattatatacaaaccacactacaccagatgacaagagatgagaaattcagaggcagctccagcattacaagttgtgtgaagatgggcatgcactatgccttcaaaccttggtctttatgttcataaatagctataaatataccttccttaacatctcatagctctcatggtaatcatgtgatgtcaaatatgagaaaatttttaataatctgtaaagtattgttaggtactcttaggtattatgaaaaattgtgcccactgttcagatctttatatctccctgtgtacctaactattggaatcatatgtcaaaatgaaaggcctcttcatttatgtataaagatattgtatcatccaaatattcaagttcatgtacactgtccataacatagtatatgcaagaataatatatatcaaaaatctgaaaaaaatcataatcgtgctatctatttaacattaggcttatgctcaggcatatgcataaaatgataagtaattcataaaatgagtcaacacttcatctggtacataagcttgcaattgcacacagagatttcatgtgtggaattgctctgaaaagcactgttctgtaaagataatatttagaaaataaatatctgatcatatattgttaactgtaatacaaaagcaagtagaaatagctccgtaaacaatactgtcataataaggagcaaactgtcataataaggagaaaaaattgaaactatttttaaaataataggcaaaatagaatgtgttcttcaaaccttgtggattttatactgaaaacttccagagatatatcttaggtaattataagaccaagcacaacaacaacaacaaaatcctaacttgaatccatcagttgcagatttcatggctgagtacatcaagaagaagttgcaaactctaaaagctggaaggccagtcaatatcaggaactcctcagaagtgaatgaaaagcagtttaaatttgtttaacaaaaccatgttttcaaactaactttaatttatgcatgagggccattaaatttgttctttttaaaaaggaaacttcttaattggaactaatcattcattattcactgtgatacaggttatatactcttaggttccatgtgattattcacatgttcagctgacagaaaggagacaaagctattctaatgacttagctttgctttgactcattggtttttatctcactttaacttccaatctcggttacaaagagtgttaaaactggaagaaataacattttggtagatggtaaaggataagtacgagtcatttcaagttgttgaagctttcattaaataaagcaagctatttgaaatcttaaagctatttaaataaagggctaagacgtttctgttttatatacttaagagcttaaaagatactgttgaaaatttaactgttaatctattgtagggtgtggttagacatttattttgacagtgctcactgaaaattcaattatacccccagagtcaaacttgcccgtcatcaaaatgtctaaagatctgagtgtttatggggtaacaacaaaccccatactaaacagtttgccagaaatctgtcctacaacatctaaatggaacaattgggtggttgtctaaggcacctaaactcaatatgatgttttagctaaaaagagtgaaattatacctaagcacttcatgcaagttaccaaaagagaagatattctttaataaaaaagtacatttgtagaataaaagaatctcagtgttgtaagaaatatttgagatcatttcagttaggcttttcatttcttaaattagaaactgaagctgagattaaacagctaataaaaagacaaagttgatccatgacattggtttgggcgatgatttcttagatatgaccaaaaatgcacatacaacaaatgagattacatcaaactaaagagcttctatacagcaaagaaaacaattaacagagtgaagagtgacaactcacagaatgagagaaaatatttgcaaatcataggtctgataaagagttaatatacaaaatatacaaggaattcaactcaataacaataaaacaaataaccctgttaaaaaaatgggcaaaagacctggacagatatttctccaaagaagacatacaaatggccagtagagatattaaaaggtgttcaatatcaccattgattaggaaatgcaaattaaaatgagatttcaccttactcattttagaatggctattacaaagaaaaatgaaagacaagtgttggtgaggatttgaagaaaagagaacacttgtaaaatgttgatgggaatgtaaattagtgcagccattatggaaaacagaagggaggtttctcaaaaataaaaaaaatataattactatatgacccagaaattctacttctgggtgtatactcaaatgagttaaaatcagtatgttgactagatatcaacacttccatgttcattgcagcattattcacaatagccaagatatggaaacaatctaagtgcatatcaagggatgaatggataaaggaaattatatatacatatttatagtgtatatacacaatggaatactattcagcttttaaaaaggagaaaattctgtcatttgtgaaaacaaagaaaaatctagaggatcgtatgtaaagtgaaataagtcaggtacagaaagacaaatacatcatgatctcacttacacgtgaaaagtaaaaaatgtcagactcatagaagtaaagagtagaatgatggttaccagaggctggaggaggcgggatagacagaaaaagaagatgtatttgtcaaatggtacaaggttcagctagataggagaaataagtcctagtgatctattgagcaatagggtaattatagttaataataatgtattatatacttcaaaattgctaaaagagtatattttaagtgttctcaccataaagtaatgataaatatgtgagttgaaagatatgttaattcacctgatgtaaatgttccacaatgtatacatgtatcttaacatcaatattgtatgttataaatacatataattaattatcaaataaaaaattaagatggagctgagccaagaatccaagactctgaatttagatttttcattttctattatgccaaagtgtttcctgaaaattaaaattgaatatggcacgtccaaaagaatacgtcataagaagacaggaaaggggggactgctgcatatactcatatttttagtcagttgtgtaagatcttattagaggaagaaaatcagatattttaagaaaattcttacaactcccattatactgaaattttatggcaaacctaaaaccttcaaaatatagggttttatttaaagtgaatcatatatttgcaaagtttttattgagattatgaaagcaaaatctctcaaagtagcaaaacataagtatatattttagactgtactgtgcagaatagcagaatggtaccaatggcaaagaaattttcaaaagaaataaaaattattgaggtctcatcccagctctactaatctatgtcttagcaacctagtgtaattcctacaaattctgagcattgcctttaatgtatctgcatggttcccacatcatttcataaacttcaaatactcacactttataattgaaacaatatacaaactatattattaaataagctatggtatgatattctcaatctaccctataaggatactatcttcctgtcagaaaagttgagactctccaatacatatttactagccagattttttttttttttttttttttttgagacggaatctctctctgtcgcccaggctggagtgcagtggcacaatctcggctcactgcaagctctccccagatcttaattgtggaatctccagacagtgtccagtcagaaatccattattagttttgcctcatgttccctaaccaccttctctttaccttcaatcttaagccccaaaatgaaagttattattcttggctcaattatccaaattctttgaagggaactggtgacactatagcctatctttacctgccgccttgtgatccaggcttcctaggtatctgtgaatattcacattaggttacctggactccatagaggcagcaccaacaaaaaacataattgggatatacaccacttttagactttcaaatacatgccccaccttataatatgtgaactgattattcacttctagacattcaactttcaaacagttatgctctgtattaaacatcaacatcctccttccctttcattgaaaggacaccgggaaaacaaaaagatgcaagggaaagttcacacataaggataatcatttgtgataatggtgacaatgatccctatttctttttctgctcttatgaatttgcaaatgtcctacaaactaagtgtattaaatgaatctgtgaaagttcatctaagtccctagtattatttttttcttactctctagaaagtcatagcctcgtagctcaaagccaaatagaaaagatgcaaatcattcgtaggacaagggttgatgcagctttcaattactgaatacatttttagccatttaaaactaaaagaaaagtaatgtcggtaatcccagcactttgggatgccgaggcgggtggaacacaaggtcaggagatcgagaccatactggctaacatggtgaaaacccgtctctactaaaaaatacaaaaacaaaaattagccgggcatggtggtgggtgcctgtagtcccagctactcgggaggctgaggtgggagaatggcttgaaccggggagacggagcttgcagtgagctgagatcgtgccactgcaatccagcccgggcaacagagccagactccatctcaaaaaaaaaaaaagaaaagtaacaaaactcttttcctctttttttatgatttaaattttactttaggtttgaaaagtgagatatatatcacttaacagtcaggaagcgtgtagtaaactcaatctctgaaccgacattacctaaaacagagatgttcgttttcttatactcatctctaaaatagaggtagacagagaaagtgctgcttttttagagattgtaatgaattcaaacatatccattaatattatagcagttattttggtttcacagtgaaacataaaaagttctatcttattggaaagaaaaccaagtagctacctaagtacttgatgagaaggaatttgttctactgttttaagtgcatgagggataaagcaagacttagaaatatttttgttagaccgtttcattttaatagtattttctgttataacagaaatgacctacagtaaaataattcaaaatacccttccttctgaaggtgatttccacataaaattgtaacattactatgatctaaatttaaataaaattttctattgatgttaaaagtttgataatacacagtttgttaaagtggtttggtcactatttgggtatgatcaacttcaaaccataggtgtttaaatgaaccaaagtctttggtttatttctatagctttttgtctaattttattaataactagtataccagtcattcatatacagtcataactggccaaccaaggtttacttcgtaggagggtgacagtttaccctttaataccacctaattaaaatacacaaaatgttctacacaaataacagcaaattgtttatttctaagaacataattttccttttataggaagctctcaacattaatttggagccacattttaattttataatgtaatcattcagtaaatggtcattagatattgggttatttggaaaattgtaaaaaatcagacttctgaccatgtcctttaaaataattaacttagctggaaacagtaaagcaagacttaaaaatacaaatcataacatgaaaattcaaatgattgtatactaaaacaattgtatgcaaataattaagaacagtgactataataaaaaagtttaatagatttgacaaaacatttaaagaatataacttacatatatgaaaataagacatcaaaacttgaattgaagctgtcaaactgtgaaaaacagtagtaaacaataaaaatcacttactcattggaaacactgcaaaatgtcattaaatcatttcagaaatgaaggtacattaatgaaaaataatcatagtttttaactcagtctcacctcacctttaagaaacacacagtataaaacagcaataaatgggataatttatattactgcaacaaaatgcaaatatatatattgtatacgagcaccctctcttcaatgtatactttaacccaatagctttctaccactagaaatttatcagaagaaaataatggtggcttaataccagcactataataccagccctctgataggctgaggcaataaggtcaattgagtctaggagttccagatcagcctgggcaacatagtgggattctgcttctaccaaaaaataaaaataaaaaataaaaaatgccagtcatagtggctggcacctgaatctttgctgcttgggagactcatatgaacctaagctgatttgagcaggaatataatttcagtccaggaggttgagtctgtagtgagctatgatcattccatcgctgcagcctgggcgacagagcaagaccctgtcacatacacaaaagaaaataattcagaatgtgcacaaaaatgtataaagatgtttctgaaagttgcatttgtaatactgcaaaatcaatgccacattgagacagaggtaccaagattaagctggagtcaccactgacaattgaaatctggagtcagaatgctgtatctaagtgggacaacagtttctttcctgcagcccaccattaccatgcagcaaagttgctctattacttctgaattttccacatttttaaagaaaagcagaaaatccagtttctaagacaaaaatcaagttacaagtattgacagaaaaatcacttttaaataattgtaaacagtaacaacacactttaacagtaaatctaattcagcctgataccaggctgtaccaatagatacaatgaaactgcataatattggtaaaacaattgtatggtagaaaaatactggcataaaaatgttcatagcaaattcataaatggaaaaagtagtctgttttatttaaataaaaaggagctagatgaattgcagacaaccatgtattaatagttacatctttcaattttagaattaatatactttattttttgagttttcattattgtgatgtattatgctgaaattagcaaaaaaaaaaaaaagagtaactctctgagtgatacagaaatttgtaatgagaaataaggtgtgtccctaaccaacccacctatgtgtcagtttgaaggtagcaagaaaatttttatcacagtcagggagaatgggaacctgtgatatgtggcagtgacatattgataacactgtgcactgaggtgacttgagaagtatttgtgtacctaacgatttccagtgtcataaaacataggtaagaacactgaatattagcactggttgatatttggtctctacaatagtgagtatggtggttacttctagatgtcaacttgaatagactaagtgttgcctagataactagtaaaacctattaaagtgttatttaatatagtattgtagaatatacattaagtacattattatgttacatgtattataatgtaacacattataatatattaaagacattattacattaatacattacttagtatagtattacttaatacattaaaatggtagctaagcttgaagaatccctgagcagacaaacccagttagacctcataagcaacctctcaaccttgcttgctttgcaaacataaacaaaacttcaggtattttttgtaaatgcctatatgaaagaaaaacagaactttctttttctttccaaataggagtgtttactatagttttcctattcctgtatcacattacacactgagtgtgtgggagagcagagagatttaatttacaagttttagatcaagagagcataaccagatcccaggttaagacttaacactacagaatgctcacattagtaatactcgtcttataaaaagatatactcttcactgtaattgctgcaaacaataaaatactgtaaaataatatgcagtgtgtttgtgaaaggtcaataacatgcttatatttttgctgttgaaaaactacacaaaagcaaatgactagaacagtagaccaattagtatcagtagaattataccatcaaacattccactgagcttgaatgtaagatctgacataaccagataattccatggcagggcaataaactgcatttacattctctttctaacaattagtgcaagcatatccagataaactatattgattctacattatcttagagtgaaatcacctaataacttcttcagtactctttcttttaatttttatcctaattatctgtctgaaaatgatcttttaaattgggaaaactgattacattacatccttcagttcagagtagcattgggtaacgacattttggctgcagacaaatcactctttcacagtcatcagcttttagaacattcttagactttgttttccatctaaacttttcagttaattttactctaacttttaattgatgttactgagtagcaaacgagactgaaggacactgctttgttttaaaaaaatgaagaaagaaaggcatgtgaatcctataaatgtaattctaatgaaatcaagataaaatatagtgtttatagaaagaaatacaattatttctaataactgctttcatttcaaacaattttcaacaagttagtgacatagaataaatacaattctagaagaatccaggattttttttctattgcattgctgtttattaaattatagctacttgaaggctttgaaaaattgaacaccagtaaaactgtccttcttttgttaatatgttttgttttcttgtttcatttttaattcaactagtcattcaccagaaaaatttactgaggtaaacttttttgattatcctttcatagcatttaacacaagtgttatttgttgtagtcttttgtatatgaatctattaatgctgagaaactgaacattcctaggagtgtcctaataggaaataaaaattaacaatttcaactgtactgttacttaaataaatattcatatagtttacctttcagtatcatgacaaacactttgattatataagaaggtctttgtatacacatcaaactaccaagaagtcgtatctgattttgtgcttttctactactcttccccaaaacacttgttcaaaatgtttacttttaaagggtctgaactgtgtgtcaagcactgacatcagcatgttacctgaattatctcattaaagtcttgtgatactcatgtggtattagcggtgaagaaactgaagcacagaagcttcaagtaaaatgtccagttttagagaaactaaacagtagagtctggaagcccaattactgaccttgtacaattgcccagtattgtgtactgacctaaaaaggcctatgagatatcaacccattaagatccatgacataaagaaaattgtttgtcctacaatatcccaatctggatgaaggcagataaagagaatgtgcttaggcatgatgacaaaaaaataagaaagaactgtgaatgcactttacaaaacagaaaggaacacaagggagtttggaaccaagttgaaaattaaacatgttcatgtgcacataacaaaagcgtgatcgtaaataaactgtgtcaacactgtactgtgaaggtgaaactttctttttaggatcagctaaaccctgtataacttgtaaaaaaatgcaaccacgtatgttgatgtactaaacccaatatttcttttggcttatatactaaaagcagcaattctttcctgtaatgaagaaaaaaacacaggcatcaaggagtaataaaaataatgtcttagagtataaaatacagaaacaccaattaaggcttttttttaacataatacatgtaaaaactgcatcagaattttaaaaaaactatagcgtcattggttctggcaataagcaaccacactctgctggaggtaactttagtaacgtcaaacaaaagtcttaaaattatgacaggtggtattcatttaaaatatgctcaagagctattagaaatcaagaacacagtatctggacccttgatttgaatccacactcaatctctttctaactgggaaattttggacaaagttttaaactttcctgaacataaaatgcctagcttgcaataactttagaaaatactaggagtttgtaaagttacgagaatcaaattagttaataaatgtaatgtacttaaagtaataactggcacaaaataattataattcattattatttttcaatatctaaattctctagcttgtagctattttgagcatatttgaaaatttctaatatgtgtttttgattacttatcatgtagaaaaatatagctttccagatgaaaatgtagtatccaatgtagaagtcacatataatatttattaaactggaatgctatcattttaaattattttgaagctcattaaagtaagtctgcactggccaactttttatttattaattaaatttttgcctagcacagttaatctccttttctaagacttaattcccaaacctatagtctttcttttcccatttggagatgggtaggagtactattcctttcttgcccaacccttcctctattttcattataataaccagtatgcccttgcctaagcatatgcccccagttaataatacagattcactgtactgtttcaccaaatttaacccgttatttttggaaataggatgtttaaaaatgggtttgttattccttaatacatgccaaatgtcatcagtatattgtggtccagatgtattctaaataccaattgaaaaacattcttaaagctaagaacacatgacatatttcacaaagtgaataactgtgagaagcttgggaattgtaagcattcttgaaaaactatttttttttttgcatgtgtgttacaagcatttgcacaggttatatattttatagctctagttataaaaatagagaatagattatattccctcacatttgtacaaaatggtcagcaagaatacacatctacagaagtttaaagtatttactctttttttagttaatacatgtttcagaaccttaaagagagcaaatcataatgcccattgattataatgtcacattttagttattacattattacatttacttattataacttttagaattttaggaggaaaacaataattctgagtggaaatttgaatatttgcaccctaaaaattttcaattccattttcaataatgtagtagaatgtttcctagagacataagacaattaaaaatatgaagtactaggttttcaagtatattgcaaagccataaataatatataatctagcagtggtacaataattaatatattatttttcaattatattaagttttaagaactcaatgctcctaaaatttttaaataatactatataaaatacaactcaaatgatatcagctcaaattcatgtatacctctttgcagctaaagtcttttaaaattaaaaataatttaaaattttgtcatacatttatgaacccattttaaagaacataacatgtcatgcaaatgttaatttaatacataatgcattagtaaaaactgttctgaatatatatatattatgtttatgttagaaaaccatttttaaacaggaattagattctattgattcatcaaattattaatcacaacattgctaaactcaatttttactctcctaagcatattggaatctaggagaatgtacagtagagataataatatgaatagaatttaacttatatgttttagcaaagaagaaataaaaactggaaaattatgggtttctaacatgtctatttgttagttgtccttttaaaaatttctttatagaagcattttgagtgaagcccacagattatttaataatttattaattattcaaaaaagtctgtccttgttggcaatgtggaaaaccacactgccaacagagcaatggtccccgcaccccagagcaggggtcccccaccccaggggctgcagaccagttacctgttcatggcctgttaggaactgggcctcacagcaggtggtgacctgcgggaaaggtaatggtgggtggcattaccacctgagctccacctcctgtcagaactcagagcggcattagattcacataggaccaggaaccctatggttagctgcgcatgtgagggatataggttgcacactccttatgagaatctaaaactaattcctgatgatgtgaagtggaagagtttcacataacccccatccccacaatccactcacccagccatccctggtctgtgaaaaattttcttccacaaaactggtccctggtgccaaaaagtttgaggactgctgtgttaaggtgaaaaagggtacatgtggtaattacaaaaaaaaaagttcaataaatataggaaaaaactctaacatcatatgtatatgtggacatatatactaacatatacatgattttctgatttgaagaatgtataaaaaatgaggaaacgacattgaaaccctttttaaagatcattcatagttaaatataaatatactctcgttctctctctatatatatttatatatgtatatataataaatatttatatatgtatatataatatatatataaattgtatatataatgtatatataatatatataaattatatataatgtatatatattatatatatctataaatatatatattatatatattatatatatctataaatatatatattatatatattatatatatatacattttatgtagacagggtctcactatgctgcccaggctggtcttaaactctagctcaagtgatctgccagcctaggcctcccaaagtgctgggattacgggcataagccactgcgcctggcccacagttaaatatcttaagtcaaaactgataattgtacttcctttcacttcttctcttcattcttgaaaggaattcaacactgaaaaagaggtggagacctaactgaggcattcacaaataagaactttagaaaaatgaaaaaacatagttatataaatcatttctaatgatttgttcatcttcaaaacataggccaatatttctattttacccaactttactcagctgtaggatgcagtccagaaacatcttagtgtaagagtatttttcataaaatgtaagatattttatttaaattgaatggctgatcaaccataagaattccactgtaaagtaaccaaagaagtacaattcttagaagactatcatgaaatagttttatgaattaaagaaaaagtaatcacttctcaccaggaatcaaacttttagttggcatagcataaaataatttctcacactggcaaaagaaaaacctccagaaactgcaggcaaatgtcctctccccactcccactcctaaataaaatacgggctggaccgaggcattatgatttctcctgcctcttggatttgctctctgtaccacagagctgtcttctagtctaatcccactcataaaactgagcaaatggcataccaagaaatggcataccaagacagagcatctaacatgtgtttgacatttctgaagcatctcaagtccctggattccgcctcctgttttccatattttcaaacatgttctcgaacatgtgtttgacctttccgaagtatcgctagtccctggattccacctcctgctctatatattttttaacgttaatgtcctattctcattgttaaaatgtgagtttctacacaagttatttcttatttgtacccgaagactttgaataggctctggcactcccagacacaggatatcaaacagattcaggccttaactaggtcgtaggactggacttacatacaagtggctgtggtttgtgagactaggttgtagtggtttttttgttgttgttttgttttttcattttgtctaaggacttgaaaaccttcaggggagacgtgtgttaagatttgtcttcttctagtgatcttcttttaaaacacaaatcaatcctgttaaggaatccattaaatcactattagtgtgaatggatttttttgggtagtatggatgaattcaatgtaaatgcaaatgtagtatgtggaagaagagccattctcattctatgaacataggacagggatgagaatatatataacactatagttaatgaaaaatatatatttctgatttatgtgaaatcaattcaagagattatatatacatattctatagatataatatgattttcatcagagcacagaggatgaagagagaagagaaaagataggagtggtggctactagatcctcttgggggattattttgaaaaaggcagtctttggcaataaatgggcactaacaccttctaatagatatccattggcttgaagaaaaaaagtgtcagaaaatttatcattggagaaaagtcaatgtttccattagtattaatgtagctaaagatggctcaagggtaaaattattcaaaatactatgcatcacaatagtggcatcctgtggactactctctctctcaccctatggggaaaggggctatgtgaaaagaaaatgaatttctagagcagcaaaacaaaattctttatatttttttacatagaaattgattgtgtttgccatcagttgtgtaattattttacaaagaagcccttgaactgtggcagaaattctggatgctctgtcactatgtgtcaatctcaatatatcaatcataatgcctgtgatttgtggttaatatgaagcaaaaacaaacttctcttaggttaagtttattttccgagaattaaactagtttcctaattttttccccagggttccaaattcttagtgtaacaccaaccaaatatcaaaagagattattagagcttcaataaaaaaaattaaagaataagcttataattcacattattccattacatgcattattagagaggacgtttcattaaagcatgcaagctgcatttttttttaatttcgacatgtagatagtttaaactagaagccacccgacactttgatatagcataagacaactgggaaatgtcagttgactaaagtggttatttaaagaaaataagcaaatacaatattctttttgtctattgatatgtgatgctgcactgttattgggcaaactttttaattaatagaaaactctaatgcttatgatgacaaaaacatgttctgtaaaatagcactgtatatgaaaatagtacaaaagggggaaattagaactctgacaccacagtgtcaatgaacatcacacagattgaagaccacagtaatgaatgaccaacatcgttaggctggaaagagtgggaaaaattaagaatttcatgtagatgttattttcaaaaatagactcaataaaatgaccagactcaccattgggttcagaacgtgatcaatcatctctttcacttttatgttacctttgtgaagttttattaatggaaatgaagaaatttactagaaaaaaaatgattgtaggcactgttaaatttactttctctttgtgtaatttcgtgaaagtgacctgaactgctttgcatttgtagggaaaaagataaatatgtaaatatatgaaattaaaaggtgagaataaatttaaaaagtttttctctctccagtgagaaagtgataatcataatgtttagttaaagctatcatctaaccaaagccatcagtacactgatttttttttaacttaagattttaataatgctgaagcatttctgtcacctcagtattagtgcttcctggtttaaatctcaaagggccaccatccaaggctgcaaatatacaaatgataaaattttggtatttgagaatacccatcttctaataggacagccatgacaataataatggcattgatagaagaaaacaagaaaatttcaaaaagataaatactagggaaagtttttagattaacatgcaagtatgacaccctccctcacaaaaatcaagttcattaacactaagcctgtaaatttcatagaatacttcttgaactagcagaactggaatcacccatcctgttagatatgcaattaattggaccctcttgaaacagtatcttgtgtgttaggagttgtaaatctcaattgttaagcatcttcaggcactaaactttgagaaaaactgttctagagcctggaactaaacagtttatttgaaagtcaatagttacaaatgagatctgttcttccctccttgggattctaaagtcttttcaaagcatttaccaagcaaagaatctgccctttgagataaacctgctcatgcagatttaagataaggttgatttccgctgaagataatccatcttctacacacacactctctctcatacacacacctctcagatttttgttttatttcctcctcttctacactgtcctaattctccttaagtactgtccatcttcctaatttagtcctactctcaccactttcgtggtactctggtctccctatactctccatgtcctccaacacacctggttcagcaggaagcctaggcatacgtagtatatacccaggaaatgtataaactatactgtcagaggattaatttattttaattcagggcaacccaactgtgagctgccctaagagaaagaatacaagtaacaagggccattgcacagagggagatttaagttcagactggaagctacaagtgtacagaagcaagagagagagaaagagagagagagagaataaataaataaataaataaataaaataaaaaagcaagcaagcacaaagcagcagcagcagttcaagttccagattccactagttgcagtttaatgtaaagggatccttgcagaggagagatggtaatgttagtaaggccagatcttggatcttgcctcccactgctttataggatatcccgaaatctacagcacgcatgtgtgaaaaagtggataaaaccgtctaatattattctattcccacaaatgagatcagaaataaaatgtacagtagtgtctttatggaaccaagtatttcaagatctgaatactaacgggttcatttatttcactgattactgtatgtagatatgaaattccaggcactgatttttcattaaaccactctcttaaggttaacttgccgctctctttacacctatgaatccatatgcttgccacgtaaattgtaatattgatttttaacatttccccacagttcaaaaatattgtttgccaaaaatcaagggccttttctaacaattcatgtaattcctgttattagctaatgtgtaagagttgggaacaattaaacatactgtatacaaaatcttaccatgctgaattgcacccaagatactagttcagtcatccttcaaattacctcacaactaaaaaggatcagatacttaaataaaaactttaggcaaggtaggaaagaagtcttttatcatccctgtatattgcaaaagtgttccattctctctaaattcacattatatttattaatgagcagcacatggaaagaaagaaaatgagagagagagaaagaaggaaggagagaaggaagagaagataaagaaggaaagaagtcaggatggtaggaaagtgagagacagaaagagagctagagctagagataacgatgagagagataaaggagagaaactctaatgtctttgatatcctccaacttaaaagagaaggatgtaaccccccaccccctccccgtttacatataatggaacaagccaagtctccattcactacatgtggacattaagaaaacttgcatggggaaaacttttggggggaaatgaaggtgatttctgagctgctactgcagttgtatatgacactgacatttatttcccataattcttgcccacaggaaacacaacctttaagaaactgaataaaatcaagttggacattctcaaaatctgcaaggtatcaacttccccgagaagctcacattcccccaacacaaacacatacatgtaaggagcgagacattcaggcgatgagctttgaaaggtacttccaccttgtgagggtgccacggatttggttgttcctgaacctgaatctgaaaagcgggggtggggtgtgcgatgacaaatgagggtgagaagaatgtttccatgaaaccagaaacccttttggaatctgggctgagaatcaggatcccacccccttgcctacctccaggctccagtaagcaaccgctggcgtcctcccctctgctccttcagcagcagcggacgtagggatcccgagcagccacggagcttaggtcccgcagagagctcctgccaagcgcttctctctcgactagttaccaattgagaaaaaaaagggtcagagacacacaaggatggtgatcaaaatccagtgtcaggcaccagggtcccagaaggttccggctcctcttctgcgccttacccagctcttttcgtctggcaaagggtcacccagcgagcccccagcagcagatccttcccttttgctcctcctgatagcgccaatcttcgccgccactgccacactgcgcgcccgctatccactcaccgcacagcgagaaggcctggcggagatagcgcggggggaggagggtggattaaaaggatagatttttggaagggtaagggagaaaaactttgatgttgtaaccacacacaggactgagaagaaaccaaaacaagttgcagcttcaggagcggggaggacgcttttcggggtaaaaaaaaaatcaccccctaccaaaatcagggggaggaagctccctgctccttgagcgatcacccagagcacctcgcaatctctgatcttcgaacccactgaaaaagcacagggcatggggagtcctgttggttcatgcccagggtacgaataccaaaagcgcctcccgctggagaggctgcggggaactcgaggcaaagacagaggcaaacgcaacgctgggaagagtgaggggagtccgagctgccgcctgcaaaagcagagacgcgtcgcccttcgggcaaagtgactgctacaaagtccgttccctcctgcgcagggacagagacatttaaaggcctgaatggacgtcagcaccagtcgagctcgctgggtgagcgccaggtctccccgccccacggattgtagcgcgcacagggcgatctgctgctcgcgaggtagagtggcttacttggggagaaaacagagctggtggcgctgcggagtgtcaaaccctggagcccatcgtcaagacgttatactggtggcagttctgctgtgagtgcacttgccgaattaaaaagagccagagctgcgtggagaggggtctggccactctgcgcgcgcgcacccagtattgggttaccaaggagctcaacacctggtttttagaaagaaaaaaaaaaaaaacactttctctttagctctggtttgagtaggtattctgattcgtttctcaaggttagttgaaatccatcgagatgtcttttacaagaaagggattagactttcctgtcttgaaattccaatcaagataatactcaatctttccttaacccccactgtctacttcctaactcagagtcacagtggatgaaagtattcaaatgtcttcaaatgaccattaccctgcattctaagacgatttgcatacttagacgccctttagtaactttaagagcctttgcacaaggaagttgtatttcttatattaatacccttctataagtgatattttctgaggattctgcaactatttccagatagacaatgaagaattaaattctaaaactcagaaatataatggaaagtggatttattttttcctgtctaaagtgatcaattatgtttccaacttatttttacgtttttgcatggtatatcagctattacttaaagccacagtatcaaacagaggtggaaaaaaacggaattcacattactgtggtcctttcctacaattcctttgaggaaatacgtgtgtgtgtgtgtgtgtgtgtgtgtgtgtgtgtgtattatctgtatatcatatgtatatataaaatattgtctgtgctattaggagcccaggttctgtgctgagcaccttgagacttgttgtgtaggaagtagtgaagaatcggtaaacagaatagagaatctcaagaccaaaggaacccgtgaaaggcagttatagctgtacgttttttccttgtttagttccagcctaaccaaggtagggtcttccttgcttagtcacttgaagcctttcaacagtgacatcagcttaacttaataattccacactgcatacaaatatcaaaacatcagaatgtatcccataactatataacagttatgatttgtcaaataaaaatagtatttttaaagtgacataaacacaaattctgccagacagcagggtccatatttattcatttttgcacaactgcccagcggccctccctctagcggcggtcaaggagtctgtctctctctttcacttggtgtgtgtgcgctggcgcgtttatgttgggaaggttgatcactaagagagcttacaaatatctgtaggctctcctgtgtaacctccttctcttcctagccagggccattcaccggtaggctctcaggcgccacttctagagcatcctctgatgttggtcctgaactgggagagtctgaccaaacttgacgaagaggactgtcaaaaggcgttagaaacttcggaaactggcaacagttacggcatttttgctctgcgaagaatacgcccagaaggttcagaaagaagtcgggagtggggatggggagaaaaacattgaagggctatggaaaagcgtcaataacataaactgactttaatttttcttcatagaaatgtttccggtgaaattttctaagaaatcaggggacagttaatttgcttggttgacgctcacactccttgctctcactaagtctcaggtcttccaagcctagcactctgtcaaaatgctttcgggttgagggggagggctttcctggattccgcgaccacaacccaccaccccaaaccccacttcccatgtccttgatttttgaggctttttgggagggcatgatttcagggaacattactcttggccagctcaggggagcatagtcggaaatcttcggttgtattcctgactcagcctgggtgcggagcgagcgcggacaggaaccgagatgcaaaggcggacgcaaccagcgcacccgcagacggcgcgcggcaagaaccaccttctagccctgagcctgcggtgccgggcgggctcaggaggctagtggggtattgtgatcactgggacatcaggatgaaggggtcactccaatcccttggagatcagattctcggggactccatggccagacccgaacggcgcccttcacatggtgggtggagagggtactccttggccgaattgacccctccctgtcccgcagggtcagccccgcgcccacccacacatccagtctccgggaacaaaactctgtctggatctacactgacccgttgacgcgctttcccaaaggaggaacgacaccaacaaaagcagaatcgctcgtgggagattttctaccaagaactgttacctccctccccgtgtaatcggtttccactcaaaaggatgcggaaaggacctcatcctctgctgtccctttcgattggcccgggactgggcgaagccgggagctgcagggaggggagccccggcaccccagcctctgcccaacctcccccagcacggcggccctcggccctcgtcaccaattcctaggcagaaaagcgcgcggccggagcgcgcaagtcttggcgtccggaaacaagtgttttccgctcagtcatggcggcttcgccagtcgaacagagcgaaagggctctgggcgaccctgcgacttccaccagaccgcgagcccggagcaccggcggagggtggccaaacgcgggcctagggctcccccagcgcttccgggcgcgccgggaactgcagctggtgcgccactgccttccccgcgcggtgcccaagagcgccagtagaaggaggaggtcggcacacctgctgttcctgcttccttcccaggaggccgattctctccatcccaactcgctccgtggctcctgcttgctcctgttccccctcccgactccccgggtaacagtcgaccttagggtcacagcagggtgggtactaactagcacacagttagcgtggactctgacaatccagggctcataggatcacgtttccaaaagcgccgaggaaaggaacttcccttgactatgcccagaaggatcaacttactgtgtgtttgcgatcaatcatagcaaagctgccttatgtaacctaagcacgtccttgcctttgtttttgttttttgttttttttcatgccttgacaagtcaaagaaacaagatttgtagtactgtgtagactaacaactgtttctcttctacaagataattaatatattttatttattttctcttctaaaatagtgaaaataaccttggtttaatacacataataaagtacattttaatactaattgatggattaaatttacaggacagtacatagtattgaatttccacttataacctgcttttgttataaaaataatgaaactcattttcttagatataaatatatatacacacacatatatatataaacttatagaaacaataagcttcaaattcacagtacatggcaaatatagtcaatagttctagtgtaagtcaaaagaaaaataatgtccttactctctctctctcaaaaactgtgtcagaattcaacagagcaattgattagaaaccatactcaacatatttattcacaagtagtagtaaactcagaaaaaaatgtattggtagcttaataatttatatttcctataaatctcatttcttacaacaacttttaaaaagtgccttgacaagccaagtatgttcttgaatatttgaacagattgtcttaaaatgtagatgtttttttctgccatcatcagtgattgtcatagcaaacagatgcaaatagcatctgcttccatggcagatgccaggatggtactagcatccttaaaatgtccacagagtctgtctggacagtgattagcattttgtgggcccactcgtgctgtgtcaagctctgcagcagtagtagagatactgttaaacaacccgatgttttatgattactaattatggcaacagtactaaaatataacaatgatcttaatgatatgcctcttcaaattatatttaaacatttcccaattacccttacactaactatagccaatgaacaagttaagaaaatttaggaggaatagataaaaagatgtacatttttaattgtttgtcccattccttcagttgtatttgtcagaaatactataactaacatttattgactatttcttgtttgtttagttctacatgaaactttttatgcacatggccacattatttcctaacaacaaatccgtgaagtcaggatgattatccccatttgtaaataaggaaactgaagctttcaaaggttgtaatactgtggacagattccaagagctggagaggcaatatgctgatcaaagtctggagttcaggatgtgattgtgataaacaaaataatggtctctcaaagacatctacatcttaatccctgggacccgtgaatttttaaagttatattggcaaaaaagaatcaaggttgccaatagaattaagattcccaatcagctgaccttaaaatagggagattatcctagattattggagcaggcctaaaatctggaaaagagaggcagaagaggaggtcagaatgatgctgtgtggtaaggaatcaacctagtattgatatctctgggtttgaagatggaggaaaggggcatgcatgggccaggaaacgtgggtggcctctagaagctagaaaagggcaaggaaacagattcaccctaagagaaggtcagcaccttgtggacaatatcaacccagtgagatctgtgtcacacttctgatctacagactaagataaagtatgtgtggtgtaaagccattacatttgtgataatttgtcacagcaggattaggaaagtaatacactgatgcagatctttttgagtcagaaaccgcattttaacctctgtacttttcagtcagtgatcaacctctgaataagaagaaggttatctacaaagaccaaataagaagcccttgggagtcaaaagaaagtaatctaggggaagtttgacactgattctatttctcctacactaataaatccacttacatctggcaaaggaactaggtaacaaatacgcttttatgtgccctctattgtcattttacaaaaaaatcacatataaattcaaatggcttatttatatgcttatttttctactctatcagtttgcctttttctttaaaaatatacttaaacacatgccttagcaagcaaagtaaaccgttaagagagcaaggctggtcgcgggggttcatgcctgtaatcatagcactctgggaggagtgtatccaaaacgggtggatcacctgaggtcaggagtttgagaccagcctggccaacatagtgaaaccttgtctctactaaaaatacaaagaaattagccgggagtggtggtgcgcgcctgtagtctcagatactcaggaggctgaagcaggagaattgtttgaaccctgaaggcggaggttgcagcgaacagagattgcaccaatgcactcccacctgggtgacagagtgagactccatctcattaaaataaaatagcagtcaagtgaaaataataactcaaaagtatggagtctggagtgaagttagtaaataaagcacatgccactaaacatttggtaacagttggctataaatcttattcaagttttttttttctataaggcaacttgaatagagaaatgtgattacagtatataataagatttatggtttctgtaacataaacctaaatctttttctattgatagggaaagaatggaagcaaagaaggaagaagagaaaatagcacccaatttctaacaacaaatttgaatctagtaggacaaacttatgttccatgaaactaaagcccctttctaacttataattattttatttttaatttaattttattttttgagagagggcctcactctttcacccaggctagagtgcagtggcagggtcaaagctcatggcagtcttgcctcctcaagttcacatgatcctcccacctcagcttcccaagtagctggcactgttagtatgtgccaccatacccagctattttaaaacatttttgtagatggggtctcaccgtgttgcccaggctagtcttgaaaccctgggcttaaacaatacttttgcctaggcctcccaaaatgttgggattacagatgtgagcccctgggtttggcctatgattagtttagatgtcaaaacactgagccacaaattatgaacccttctttttcatgagtaatacaagacagaggtaaaaatcaaaggatggattacatatgtactgcagcccatcctgtgttaccatttttttctttgtcttgtctttttgctatgttgcaataacagcattataatatttgggctagattgatattgctgtatcacacagacaaaatagatatttcaatatgattgcttctgatcaatgggcaaagagaaaaattagttttttcttcagaggtttttacttctcaaattattatttttgataaaactatgcttgtggtacaaacaatacctttcaaacagctccaagagtatataataaagtgtaagtttgtttttacattcagaacctctgtctcttattactttttactttgcttctactcagatcatatagggagaatagatcctacaattttcaataaatgtcattggtctgaacctggatcaagcataatgttgaagtgagctaggccgattggagacattccatggagatatttaataagagcagcaagattgaagggctacttttgttttcattctattgggaatgtgaagccttggagccacggctattgtgatatttgggagagtcttacttacaggcggtgggaatggaggcaaaggtagaacccaggagaaacatgaggctgttaaagacattagacttccttgttaaatatatctctgaggcgtaatagtgtcactttatattctgaagtttaattttatgagctaatagatactatccattcatctatttacctttctatttttctatcaactatctttctttttattcttctacccaaaccaatttaagttgaatttctgtgattttcaactgaaagagacatgactaatagaaaaatactagttacacaagtccatccttctaagataccatgtggcaaacaaaaggctgagtctactgattctggaaggagcaggttggggtctaagcagcagaaaaggtctcttggcagacacatataggtaggggcacaaaaattggactgcatcagatggactgaaccccaatcttaatggcctgaaccccaatcctaatggcctgatgaggaaatgaacattatattcagtgtgtaaatattatttgccaagttttccattgttcttgtatatatatccaggatacaatcacaaaatataaactactatattaggaaaaataagaacatatattaatagtatataaacaagacaaaaatgtagtcattgatgcagatgcacaaaggatccagatattggagttattacataaggactttagaataataatgatgtatttattagaatttattgctataaaaagggaaaactatgtgaacattttggggaattttctagaacattggaaactctgaagaggaaatacttagatattctatagcagaaaggcaaaaattaagatgtcctttcattgggtttaactatggactgaagttagctgcagaacttaccagttactttaaatactgatccataaaaattaatgcagaaacacaaaggtaaaaaataataaaagtgtctctgatttatagtttggtggcaaaaggaaaaacatagttctaattggatttcaggaagaagtagagctggtgagtaaagacatattagatgagctaatacctgagaatttcccaaacattgaagaagttcagcaattcccaaatagaactgatataaagaaaaccacactgaggtatacaacttaaaagcacctacagaatatggaaaaagaaacatcgaaatgagatatttggcttttcatctgaaacaacagaatgcagatgtttcccatctttcccctagtaattccgtttccctgttatctttaaagtgctgttagaaaaatagtcaaatagaattctgtatttttaaaaaatatatcattttacaatgaatataaaatctttccagaaagagacaaaatgagaaaaattatatgttcagcagatttgcactagaaaaaaatattaaaagcattgatggtaaatgataccaaaagaaacccaaaacacaggggaaaatgaagactgctggaaagggaaaaggtaaacgtataggtgactacaaaagggcattttactataaatttgctaatttcttaacatttatggagtatttaaagaaaacttaacaaaatgcatcatgaatttataaagcatggagatataaaatagaggataactaaaaatacaggagtaagtagggtagaattttaccattgaaaggtttttactttcttatagtggtaaacatttttgaacaaggactggggtcagttaagtatgcatatcatattgttttgtaacctttagaagttaagccaaattgatatttaaaaaagtctacagagaatataaatttaaatgcttaaagtatttaacccaaacgaaggtaggaataaagaaacaaactaaaaaggcacaaaaatagaggcacaacacattgaaaaacaaataagatgacaataaccattttcttggccacagtaaatattaaataactaaacaattcaattcaaagtagagattttgagccaggcatggtggctcatgccagtaatcctagcactttgggagaccaaggcgggtggatcacgaggacaggagtttgagaccagcctggctaacatggtgaaaccccatctctactaaaaatacaaaaattagccggtcatggtggcagacatctgtaatcccagctactcaggaggctgaggcaggagaatcgcttgaacctgggaggaggagatggagtgagcagagatcgcactaccgtactccagtttgggagacaggacaagactccttctcaaaaaaaaaaaaatcagatattttcaaactggatttttaaaaaaaagctttatatattccatatataagaaaaatagcttaagtataaggatacagccaagaagaatgcagaagattggaaagattataccgtgcaaacagtaaacccaagtccatgtgactatattaatgtcagataaggtagatatcaagaaaaaagagtatttcgtgggatgaagaggaacaccaataaaaataaaagatcaatatttttatgaacccagtggcagaaattgaaaatacataaagcaaaatttgatagaaataaaataatatactgaaatgtagctggaattttaacacctttctctgttagtaattgacaaaaggaaacaaaatataagtagagtatagaagatttcaacatgatcaatcaattttagctaattgacatttatagaataatattaccaacaactacatagtttgaatttatttatttatgaaacattacccgtagtaggttatctgcagagacataaaatgtctcaaaattttaaataaataaacatgacatagagtaaatttttaaccacaagcaattaaattataaataattttaataagatatctaaaacttcaagaagcatgaaactaccatgaagatatttaaaaattatgtgacactcttctaaaactgtatagatcaaagaactaattgcaaggaaaatgtgtattttacacatatatatgcacatatatatttatgtatgtatatatatacatatgtatacacacataaatatacacacagtatattttttaaacaaggtaatactgaaaacatgatgtattgaatgaaaacatatgtgagagtctgcccaaaaaatgattaaagagaactttaatgatttttccaaagtttttattctttttctggtctcttttgcagatacagttaagttctctaccctcagattccactcttggtcctttgcctgttttatctctgaatgtttcccatctttcccctagttattccctgtttttcaggggctgactactgcaaattatatttcttcaagttcgtttgccaactgacttcagatcagattcagtcaatgaaagctagtgtgtaggagattggccggtgcccaaagagtaacagctaggttgttcctcctactttgcctcggctatgggtagcatctacaccattacctgtcctctaaatggttctagcttccatcagggaaccctggctccttgtctttagtagcttgaccttctccctttatactttcaacctgtttctgattataatttgacttctcatatagagtaatcagagggagacaatctaccgatttcaaccaattactattctctatgatatattttatttatttatgatactataagactgcattttatgtgtgttttaagcatgagtcagcccctcaaaatttgacaaaagcagcattggtatcttccaaaaggaaggtcagatcctgatgtgtggtaaactaattaacatgagatctatgacctaaaggcttaaggttttactttgatgattgttatttttataattctgagtatcagtgttcaacatatttgatggctatcctcatcaaatgatcctaatttatttactcactcatttatgtactctttgaaaatatgtattgacatcttctgtgtccctatcctcatacatatctcagtcttgttgcaacagagaaaagcatatggtgaaacaagggagttggcccattcttgacaacttgtgcagatacgagtgttttgaaaggggaagaaactgggaatgcaattttcttagtgtggtgagctattctgcaatattataacagattcaatatttaaagagctgcaactcaaaatgaataagataaattgaagtgttgtgatttaagtgcaaattaaattctcaaaaacattcaaatataggttttgcctgtaattaacaaagcaaagagagagtgtaaatcttatgtggtgattagactggtctatggtaaaactgtggtagctggtaatttatttttctatgtcaggaaaaaaatggaaaacaaatatagtaaacagcaattaatgttttatgatttgtaagtaaagttatatttttaagattgaagcctcgcttaccattctcaaagagccatttcaagccttgaatctctcagggcttcagtctgaattattataactttccagtttgagaacatttttcatttattcaacatttaaattgtatgatattgtattttcaggaacaattatgtttattttttatatgaaataaaagtggacaaaatattaactgataattttaaaactattataatgacaaatacaaggcatatcataattatgtgtgaataaaaagagaaatgcctgtaaaattataataaatcattcaaatatcttaaaagcaaaatgcataaaaggtagaatgtgtatattttcaattgaatgaccgttttttaattaaaagaaataagaggattcttaaaacattcaattagaaactagggattttcagcttttcccttgattctattagaaatgtaaaacaaaataaatttaaattcaaaaacatgacagacccttcataatgtattctctgcctactgattccatgtcacttctaatttctccctccatacaaaatatgttgaaattacactaaatctttgccttctgtgcttttattttaacacactctatcatctttgcagttgaaattttctctgttcatataacttgccttctttcttccactttatggtttagcatctttttatctttcttggatcatctaaggtttagctttcttgtggaaatctacattggctgcacttcctagatattcccattgggccttgagttcctcttatagcacttcctacactgcgatgtgttgccacgcttactaacatagctaacctattatacagtaaaaacagttaggggacagttagggtaaaaagactaaagtgggtaaagttagggtttgggttacaatactagttgtatcttgatttgctagcatagcatacatactagtcaccaagtatatatttattgaatatatctataaataaatcaataataacttttaaaacatggacctttggtttgtatcttataaaaagcttctctaaaatatatgaaagttctcactgactttatgaaatatacattgctctgatttcttatttatttttatttatttattttgagaaagagtccctctctgtcacccaggctggagtgcaatggcgcaatctcggctcactgcaacctccatcttctgggttcaagcaattctcctgcctcagcctcccaagtagctggcattacaggcacatgccaccacaccaactaatttttatatttttagtagagatgggatttcaccacgttggccaggctggtctcaaactcctggcctcgtgatccgcctgcctcggcctctcaaagtgctgggattgcaggcgtgagtcaccgtgtccagccccttgctttgatttcttagtcttcttaagctctggtccttaatatttgagaatgtctggcaggatccatgaattttaaattttaaaatttgtataagcccaaaatttgcatgcagtttgcatggaattttgcaaaatgtatggaaatcctgaggtctggcttttttttttctttttttttttttggcagtgtctcattctgtcacccaggctgggatgtggtggtgttatggtagcttactgtaaccttgaactgctgggctcaagcaatcctccaggctcagcttctgagtagctaagattaaaggcatgtgacaccatgcccagcttattttattttattttttttcagagacaaaatcttgcattgtttcccaatctggtctcaaactcctgtcctcaaagtgatcctctggtctaggcctcccaaagggctgggattccaaacatgagcggttgtgctcagccttgaggttctggctgtaatctggctgttatttatggaaacaacagaagttcttggtattaccagtcattcttcttgagacagtcaccccacaagactgagatgaatatagttaagaactgaaagtgaggtcattatggcagaacagaattgacagtgcacattaaaagacattacacactttgggtgattcaactaaatcatagtctaaaatgcagttacaaaatggtaatgttcaaaagatcatttattagtcaaagttacaagaagggtcctggttatgttggtaaaaattgaggtatctgtgattatccatcttcaaattatttgttaaatgcttattaagataaaaaagttacatttcaaaagtatttatattattcgtcaattcctgcataacaaattatcccaaaataaagtataataataaaatttaaaaaaaagataagaaacatattcttcatgaccaaaaaaaaaaaaaaaaaaaacagcctttattatctcaaagtctctgcggggcaggaatctgggcatggcttatctgggtcttctattcagagactgtcacaagttataatcaatctcactcacatgcttgttggtagattcagtactttgacaggtgttgtccagaattccatataatgtgagcctctccagcatggaagctttcttcatcaaaatgtgcaaagccaaaaaaaaaaaaaagccattgaaaagagtcaaagacagaagtcacatcttttgtcacctaatcacagaatcaacatctcatcatgtttgctgtattctatgcaatagcagcaagccaatagatccagctcacacacatggggagggtattagacaagggctggaatcccaggagatggagaccattaaaaactatgttaatctgccgattacagtagtttgtcaaagaatcctgagataaaaattctgggctcaaagttcttataaggcacttaggcaggacaataaaggaacagaaaatagtactatattaattttactgatttactaatactaatatactggtataatgtactaaaacagtatactacatttttggtaatttgttccagaagtaatagaaaaaaatccaaatattaaatgttaaagcatattataattctgtgataattaactctgtaatttaaaaagtctaatataggaatatacctaaaaagaatgctttaaaaatatactttatttcctaactaatatatcaaaatggagccttcacatatgaaattagtaaaatatttttgacctaataatttcatttttagcttttcactaagaagtaatattgtttgaaaaatattatgtaccaaggagtttaaaacatgcagttgtagttaggtaaaatttaaaattaaaattgtgcaataaatgtatgtaaaaacaaaataatataggaatctaaatagccctatataaaaaggcaaacataaaattaaaaattagcattaaccaaaaatatgctctgaagtatgtcccctgactaaatttacttaatttagtttcttttggaaaaaaatttaaataattgtatttgctagtaagagaaggtagaccattatttgcccatttgttatcagaagtaaaacaagacatttatgttttcagaagtaaaacaaatacaatattttctaagtaataaggttgagacaagaaaaaaacagcaatgagtcaaaatgtctatttacatgcttttacaggaaaacaagacttagctactttcttcccaaaaaaaagaatttaagtagaaatgttattgttttactaaaagtaaatacattttacatacttctctcataattttaatctggagttcagttatggtgatcatattagtcagtgttttccagagaaacagaaccaataggagagagaaagagatggggagatgaaataaggaattgtttagtatgattgtaggggaaaagacatcccaagatctgcaatcagcaatctggagactcaggagagatggtggcatagctccagtgtgaaagctggcaggcaggtttgacactaaataaaagccaaagtttcagtttgagtccaaaggcaggaagagacctatgtcccatctcaatgcattcaggtaggaggaagttccttcttacacctaggaaagtcagcctttttattctattcaagacttccactgattggatgggacccatccacatcattggggaagtcttctttacttggtctacgaattcaatacagaaaaagatatacataagacatcatttaaattttttaaaaatcatttctaatcaaattgtagcattttaattttgtttttagagttttgtaagtgtccttaatttttcagcttattcttaaaaaatcaatttcactttattcaaaattgccttttggaaaacattaaatggtggcccatataatcttagactttacatgctttttgataaatataacattaaaagtagcttgtgtagcaatttaaattacatatataagatgtacatatattatcctccagaggaaataaaaccattaagaactctgatttagtcagggttctccagagaaacagaactgataggaaacgtgtgtgtgtgtgtgtgtgtgtatacatatgtgtatgaacatatatatgtgtgtgtatatacacacatatatacacacacatatgtatatacacatatgtatatacacacaaacacacatatgtatacatatatatagaaagagagagagagagagaagaagaagtgaagagaagacatttattaggagaattggcttatctgatttcagaggctaagaaatctcataataggccatgtgcaagctggagaaccaagaaagttgttagcgtggctcagtccaaattcagaggcctttccagaccttaccactaatcaacgcattatatttagaaaggtatcatagtaagtctgtatttcaatttaaaattctctattttcggtgacagtgaaggacaaaggggcaaattttataattattgtgaaaagagattatagagaaagggcctggataataccaaaaatagaagaaagaaccatccatctgtggcagagaaccagcagtgatattacttgaaatatggaaattaataatatgtatggttgagtttaaggtctaaaacataaaagttaaacctaaatctaaaatatatgatttaactctctagaataaatctactcaattatatgaaacaagcagacttattctcaatattttatcaataataaaggtttttccaaatagtattgaagaaatagcaaggtgtcttaaaaaatggccttagaccatgaaccatagagaaaaagacaaggtttgccatgaaaagtgaataacctttttatttccagttgtgatgtgttcatacaaaccattagcactttcatttcagtgaattatgccagttcttgctgtaccttgtcaaatgagccagttaataccctaaatctaaatgaaacttttctcccttagatgaaaataaaatgaaaaatttatctaattaagttcagacaaaatataggtcatgcttttaaagattttaaaaagattaaaatgtcaggcatggtgttattcccaggattagctttggcctatacatcattctgcaatgatagaaacatttgtatgctcacaagcggcctttgggcacttggagagtgaccagtgtaacagctaaggaactaaaatttcacttttcaaaattttagctaattcatatttaaagaactctgtgtggctagtggctaccatattggatggagcaattctaaatgaatgaaagtggttgaaccctttgtcaattttagtgcctttgactattagggcagatggtaactagagctttcccctttcatcctccaggatgttgaaacaacatccacctctgctgaaaatacttctgtctgctgcatgaagagtgctgcaatccagctgagcaaaactaaaatatcattgacctctattgtttgagagtatgctgatatttgttcatcgttttctaaagtattaattgcatgtgatcttgagtataaactggtgttgaacagataatacatttgtgaatgaggcttacttttgcgaagtagttgcaggagtttgtgctgactcctctctattcttcgcaaagctggcctccttttagtgtcttccatctcttatttttctttaccttaaataaaaaacattcctatgttacatttatggttcataataactatcgtgcttattttctacaatgtttctattatgatgattattatgttctttgctataatagtaagattttataaatgaaaaagaaaataggtagcactgagtaatacttaaaattaactagaagacaatttctgaaactttgtgaattggcaaatataagacatataacctagctaaatttaagcaacaaatacaaaggatacaattaacatgttagaaagtatgtgtttgtttctttattaattggtgcagttgaactcttcggaaaaattgcatctcccgaaaaactttgttttgtagagtataggaggactagtgcatccatcctgaatatataaagagctaatcttctggaagagatatgacaaatgttattcttgtgccaataattaaaaagaaaaaaaaggaaaacgtaagacttttaaaactaataatctaggatcaaatattaaatgtatgacaagtgcagatgatagcaatgttctcatgcaattatgtgtagcataaaaatttctttaagaatgactttaaaaaataatagaacatctgtgcaataccattgtataaaacaaaaaatcaaggaatattcttgaaaaaagtattttaattattattttcatcaactctacaattattagacaattatgtaattgcaattcattacattttaaaatatattgacattttattttctaatttgcatgtatttcttgaacatttccagttttattaatcactacttttgctaacattctacgaattgaacttttttgtggctgactttaatgctttactgtcttcacgtaactagactggactctcctttgaaaatatatgatcgacataagcaggctcatctccagatagaggttatttattggcatttcgaagttgtttgagagttgttattagaaagctatggaaataactatctctgaattgtccattgccttcaggaatcacttgtggaatattgaattgaataataaagaaagagaactttatcaacttcttatcaattttttttttgaggcttagttttgctcttgttacccaggctggagtgcaatggcacgatctctgctcaccgcaacctgcgcctcctgggttcaagtgattctcctgcctcagcctccctagtagctggaattacaggcatgtgccaccacacttggctaattttttatttttagtagagacagggtttctctatgctggtcacgctggtctcgaactcctgatctcagctgaccttcctgcctcagcctcccaaagtgctgggattacaggtgtgagccactgcacccggcccccaatctacttttttatagatgtgaacgcattgcaagacaaagcacaaaaaatgaccaagaaaccataaatagaacattcccacatggccaggcatggattaaagtctaggatattgaaggtcaggcatggtggctcacccctataatcccagcacgttgggaggccaaggcagaagaatcacttgagctccggaggtcaagaccagcaaaacccccgtctctaacaaaaatacaaaaaatcagcctgacgtagtggtacaagcctgtggtctcagctgctttggaggctgaggcaggaggatcacttgagcaggggaggtgaatgttgccgggagacaagccacacccactgcactccagcctgggtgagagagtgagactctgtttcaaaaaaaaagaaaaaaaatgtctaagatactgggagttctctgccactcttccctgtttcatctaagatttttagtacaatctcctgagtcacacaagcaataaggcgccactatttctcttctaaaaataaggatgtagtgcaaatgcttccattttaaaataattgctctattaagtgcccaatttataccttcttgaaaggttacctaattgcttcagcatacatttatcactgtcttataaatatttttagcactgatttgaagttacataattgtatgacctgagttagaaatgtagttctgcttttaggtattcatttaaacaactactatttaatgaatactgagctgttttcattaaaataagagttatttgatatataaacaacaagaggaaatggatccttcagccagatgaagaattgattcatacattttaaaattgggaagtgcttggcactataacttgatggtcctgatgaaatatgaacttgtacagagaagcaacatttttcacacaattactatacattcaacattgtgcttgctgatgaggatgccaaataaataaattaattaattaattatcactttttgaggattttctgggttcttgttagaaagatgaaatgaatatgtacaaaataattttaaaattataaagggcatgattatatacatattacatggaaatttggaaagacaatattaatgacaatttttgtttatatgccataaaattaaccctattgcagaaaaaattatattataactataaatatgtaactatatagcaatatatacagtctatgactttgttttgtatatctatatagctatctgcatttatgactcttggccagttaaacctagtctgttttctcatgttacctgtaacatacagccacaatatcaatataacaatactatttactattgttctaagtttaatatctttccaattcaaggtcgttattgggtccaaatgtaatgttctaacttagtacatttggaaaattctttcctaacgcctctgggaaaacacaaaatattacttacaaaaataaatgcataaaaatgattaaaacctctatataagtttgggtgagtattttcacattgctataaagaaatacccaagagtgggtaatttataaggaaatgaggtttagttgactcacagttcagcatggctggggaggcctcaggaaatttacaattatggcggaaggcaaagggggaagtgaagaccttcttcacatggcggcagaaaagagagagctagcaagagcaggaaaaactgccttataagactatcagatctcctgagaactcactcactatcatgaaaacaacatgggggaaaccatccccaggatccaatcacttttcaccttgtccctccctggacatgtggggatcatggtgattacaattcaagatgagatttgagtggggacacagagccaaatgatatccacggccttaggaaaaactattgtatgattactctatttagatgttttaaatgtcataatttgtaatgtttaaaatatgttaattacaaataaacacagaaaaaataatgactacaatgtatttttataaagtcatacatagaattcatgattaaagtggaaataatattgtggatttaagatcaaacaatattttttgaaaaattttgaaactttaattattattatttctctgtgaaacatcaatattacaagagaacaaagagaggaaaattcagtggaagtaagtgttggctcatgaattgtaagttcagttgtaccttgcaagattatattattggtattgttaacaccactcagtaaatactttcttttttcaaacacaggaagacttgcaatctggtagctattgcttctgtactacagataaattaaaaacaaacaaaatttgaggtcagcaaaactgataacccttgataaaatttccaaagttctcttacatagttcaatgattttcttaactaccttctcaaggactcccataaattaatccgaaataactgtttgaatactatttatctcaatatctttgttcttgtgacttatcagagaatgaaagatggtaaaaagaacaataatatcttttaatagtcttcagagtaattttaggagatgaaatataattttatgactttttttactttttacgaacatatggagatatatacacactaatacaagtttcaaatgtattactgaataactgattaaacgtgggttttgtttacattcttttaaatgagaattaaggaaagaaaaaaatgagtgcttcttcatacctacgagaatgcctaaaatgaaacagaaggaaaatacagaatgttggtgaccacatggagcaaccagaactctcatacactaatagtgagaatattaattggtatagctacttctgaaaattgttgagtcatatctactataggccaatgtacatactttctataaatcagacatttcttccccccgaagcatatactcaacagataggcacacatatgttcaacaacagcagcaacaaaaaagaaactggaataattgtaacagacttacctgtaatgacctaaaatggaaaattacttaaatctccatcaagaacatacagaaattgtcttatattgtaccacagaacactttcgagaaatgaggactgatcatgcaccattggacacaaaatacgaaggaatcttacaaacatgttgttgagtgaaataattcagtaacatgatctcatttgtatacatttcaaaatgataaaattattcaatagtaaaataaattataatagaggttatccttgtgtggaggcagctagagatggaaggcaattatgaaggcagcagcttggttgtagaatatcatcggtatttttttctcaatatacattgtattttttaaagtgttgagccgtatatttataatttgtgcacattattgtttcaaagtaatttttctacaaaaacccaaccattaagactcagattttctaaaaagaaaagaagaaccagctacttttaatgttttcatgttttatcccagaaaaataaactttgaataagggaaggacaaatgggtctggcttaatatttgaaatgatgagaggagaaaatataagaaaaacatgtctatattttattaaattatggtagaaaaaaggcttttcaacactttacgcattcacaggttcatgagtaactttgtaattcacaatcaagtgttcaattacaaaatactggaaagttataacatgtgtttgtctttacgctggagtacagcttagaggaagttgatcagttgtgtattttaaaaatttatttattgtgtaaatataaaaatacattccaatacagagattcaacaaaataaatattcgtctgaactttggcttagaaaataattttgttttttcttcttctgtcccataatttagaaaatatgtaagtttatttcaattttagatttattgacattttgatcttgatttgcttgagttttagttattgaaattataattggaaatggtagattaatccaaaattagaaatttgattcatgtcaatatttaattaagctttttgttttaattgcagattcacatacacatgtaaaaataattcattcaaatcatgtgtatcctttgccaagtgttctccaataatattgttgggacaatgatattgctatagtcaagtttcaggaaaattccatcaccccaaatatgccacacgttgcagacatccttatcttattccaaatcttaagggtaaagcactgtgtctttcatcactaagtataatattggctgtaggtacttgtaggtaattttagtaacttgagaaagttattctgtttatgtttctgatagtctttatctaaaatggtatagactttgacagttttgttctcaattgatatgattatatcatttgccttcctaagcctatttatattgtggattacattgattaattttggaatatcgaacaaaccttgcgttagtgcaattaaccctaattagactaatataattatatttaaatagaaaatattttttaatgattttttttgtctatattggtaattggcccgtagtttttttctttgtttttattttgtgcttgttggtttttatattggggtaataccaatttcaaatagcaaattgggaaatgcttccttctcatattttgtggaagaaattttgtagaattgatgttaattcttatttaaatatttagcagaattcaccagtgaaacaatcaggacctaaagatttcttttcaacagatttttaacaggaattcaatttcctttagagttttaaggctactcaaattatctattgcatatttgataaatttagtaattagtgtcatttgaagaatttgtccatgttatctacattatcaaatttatgtgtgtagagttgtccttttggtatttgcagggtctatagtgacatctactttttctttcctgatacaagtaaattgtgccttctctctttttctttgttagttttgccagaagtgtgaaaactgtggtgatttttttcaaatagccagccattaacatttacttttcttgattttctgctttaaatgtccatgatttctgatcttaggttactgatttgagactttccctttcttaatgaaagcatttatttttatagtattcccttgtagaaattatttagatatgttccatcaattttgatatattcattttgatttagttcattgtatttttgaattttacttaggactttctctttgacccttagattatgtagaactatgtatttagtctgttgggaacaggatacccaaaatctggccataaattggcccctaaactggccataaacaaaatctctgcagcactgtgacctgttcatgtgaccatgacacccacgctagaaggttttgggtttaccggaatgagagcaaggaacacctggcccacccagggcagaaaaccgcttaaaggcattcttaaactgcaaaccatagcatgagtgatctgtgccttaaggacatcctcctgctgcaggtaactagccaaacccatccctttattttggcccatctttttgtttcccttaaggaatacttttagttaatctatcatctgtagaaacaatgcttatcactggcttgctgttaataaacacgtggataaatctctgttcgaggctctcagctctgaaggctgtgagacccctgattttcccactccacacctctatgtttctgtgtgtgtgtctttaattcctctagtgccgctggtttagggtctccccgactgagctggtctcagcatagtctttggaaatttttgaattattttactgttactgatttctagtattgttccactgtgatcacaggtcacagaatacactgtgtatgatatgacttactatgaattttttgaggtttgttttatggctcagagtgtgagatacggtctacttcaatatatgttccatgcacatgtaaaatgaaaaataaaaatcacagtacttcaattctgtatatcaagatctgatgttttatggctgtcactaatataggttaattgggaatttggggagacagtagtcatggtagtagtctggttgtgcgtgtgttttgcatgtgtttggataatctgtttcttttattgacttgcgttttttctttctttaaaacattttgtatctctttttctactctttcttgttcattcattctctttttccacgttactatttttttatcttgtcaattttttttttcttttactcatattcatagagtttaaatgaaaaaaggagaccaggatacagagagtaattgaagaaacatgacttgtccaaaggaatgaaattgagactatctagtccatttcctcctttaaattgaaatgttatttctgtgccaggacaagccttttttgagtaagtggatgctcaaatcaaccaaaggacacaagactaccacaaaacaggaagctacagcagagtataaattcagttcaacatctgtgtttccagatacatttagcttcagcaataacacatgcctgaccatggagaccacatgagtttttttaagaaccctgaaaaataagcttttgcctgttttctttggccttcagactggaaaaatgagcatattaaataggaacccagcattaaatagttttgcatctagtcaggtgactcagtgtatcacatttagagtttcttccacttttgtattttaaatattacataaaatattttctaataataacttctttaaatacagtaaaaacttaaaatctattttactttcatattcttttatccaactttcttcagagatataatcactcttattggtttagcatttcactcttaccagttctagtattttctaattctatttatgtgttattttggataatcatatttctctcacttactgaatgatgataagtgggaggaagtgaattccattgttagtgtgaaattattatctccaagggtgttgttaatttattgaaaatattatttgtcaagtgcctattgtgctagtccaggcattgtgctagtcactggggatataaaaatgtgcaggtacataaataactttatgaacaattaagggatacaagaaaagaaaaaaatgaaaaagttgtgtgctgagtattagtatactgtaaatacagagggcagataacacagacttgtggttaaagtagtattctcatggaagatgttgttaaagctaacacataaagaaacctaagaattattcacatttggggtatttgaagaagattcagcagaaaaaaaatgacctagaggcaacaataaacatgatactctttctgaaagtgaatgtttttcattgtgattttattttgcatagggcatggaaagggaagattgacagaaatgaggctggaagcagccataacattctaaagagtcaggtcagtcatatgcagaattgtggatactgtaaagagagcagtgagagacaataagacagttttaagttgaggagcaatataatctgaagttttaaaagtgcgcactgttggcaatgtgaagaattgattagagaagattaatactgcagacaggtagaagatcaggtaagagcactgttgtgataatccaagaaagcaattatgagggactgaattatggtttttgcaaaatgtaggaaatgagtgaagatgactttcaaagatttccatatgtgggtattaaaattaccataattataggaatgaatacatatgagagtgataaaaatgaattgcaagcttctgacttaaatcgcttgaatgagtaaaaatgagttcataagaaagagggcagcctgttgaataaggtattgagttcaattttcagtatggtagtttgagggggaatatttaattagataaactactacagctatctgataggttcctggagaatcaggtgtgaatttaggcaaaaggtctaggtgggattttatcacaagctaatgtataggaatggtcaagaatgcagaaaagaagtcagaggaaaaagataagaactgtataaacagaaaatacattctgaggaacagtgaaagcagtattattaatgttatacagtttccagagtaagactagataaaacaatatggaagaaaaagactaccactttaaaaccaaatcataaaaaagaaataaaaatgtccccaaaaagtaaatgtcaaaatgaatataaatccggactttaaatagaaatcatttaaataactaattttagcagtgtaataatatactttaaaatataaataaataagttcaattgttatcattggcataatgttgtaaactaaatgtcttttaagactgggtaatgatctcgtgagagttcttataaaaatagccaatgacccattctttgtgtattacctgtgtgtgtgtttatgatttactgtttaattatttgaaattgtcagcttccaatatgtattaatattaaaaggtacagttcaacttgtatatatgggctgagcatgtttcttacaaaaaataaatttttgttatgggtataaatgattgttataatatcaatgcctgtggttcaggaatacagatttcctcttttataaatgtatgtacaaaacatcacttcagaagttattaagttaataacataatcatgggccatgataattatcttatgatggtcatcatttttaataatttaaagaaaataaatacataaataacagaatatagactttctgatattgtgtaaattgaacattcttaaaattaacttaagatattcaaataagaaactgaacctagtaacatcaatttttaaatttaatttttatacttagggagggagacttctaaccggaataaaattataataaggatgtgttattcaaatctcttcaaatgctcccacgtaaacatatattgaaaataggcaagcagcaacaacaaaacaatagaatacagaccaccctcaaaatttttaaaaaatacactgtaaaagataatcttacaaagtttagaatatgagtggttttagctatgtagtcaccaaagtaggttcacattgacttcatcttctctgttgaaaataagagagaagtgaagagagctaagatgattatattataataacctaacaagtcactaaaaacactcacctacacaactgaggttctgcattctgaatggaatactagacatacacataaaagcatgaatgaaagacagcaaacattagatatgagaaaaccaaaaaggaggaggatttggaaactgaattgttagagcttagataatattttgaaattaatggaaaaaacttgtttcagaactgacaaccaacttacaaaaaacgaactaatatcatcgtgaaatgaataataagaaaaatcgagactaaagagagaatataaagagggaaaatgaaaacaaacaatcaaatcaaagtttaataaaataaaaaagatccaaaacttacatagaatatgagcaagatataaaaatgtatgtttaatcggaatttaaataaagaaaaccaaataaagcagaatgaactctgaaatatacagttctagaaaacttccttaaagaacacaaacataaatactgaaattgcacagtggtgaattagaaaaactaatcaagaatagaagtcactgatatataatccagtaaaattactcaaaatttaaacaaaaaaggaagaaaaaagaggaggcattcaggcaaaaatgtagtatttaaaagaaaataaaaagcaaaaagcagattaacatcagacatatagacaattgatatctgcagacaatgaagcaaacatactaaagaaaatacagggagacacagattaatatctagtcaaacagaattacaggaataaagttcacagacaaataattttaaacatgcagcaattaagggtgtactatttccatgagcacttctgggaagtctaagtaatgagctcatgtgcacaggaaatgataggagaagctttgacataatgtctaggggtggataaggatacatttaaatagaaatgttaatgatgggaataaaaaagtcaatatagtatacagatgatgtgtagtctaaaataaaaattagaaggatttaaaaacgaggaaagaaaaataaggttatataaaattataataagtttgctaacagcttcctgcatgtaaagagaaataaacacagatatcactctttaatatgtgggaaacgaggatgggtagcagatgtttcaggttatctttatagaaagaaaaaaatggtatcacaaaagaggaaactactttcctaaatataacaaagaagaagaaaactaacgaaataataccttgatcacttgaatacatatatatgtgctctctctctctctatatatatacacatatacctcatatacatacacataagcataaaaccatatcacctcattgattccaaatataactttcatataaataaatttaaaagcttaacttactagcttataatattttaggttgatcaatgaagtgaaatctattctgtataatagtggtacatctgaaactacaactagaaaggttacaaaaacgacgtacaaggttacaacaggagaatgcaaatggggtcaatattttcatataccaaacaaggtataatcaagccaaagaacctatgaaaatgaagactattttataaggcaaaaggtgactttcataagaaacatttaacagttattaataattatgcactaaataactcaccgattttcataaagcaaaaatttgagtagattcaagaagacagacaaatgttaaattatataaagcttcctatctctctcagtccaagtcatatacaatcataatatttagtcagtatgtatatagaacttacaaagaaaagttaatgaaactgttcttatatatcaaactccagatctaacaatagaaaatagacctgttctcaaatgcataggaaatattctcaaaaatttaacaaatattcaattataaagaaaatcttttttgcaaatactgtatttatgaaaatagaattctctgactatatggcaataaactattttgattaaaatatctaaatgcttgtacttggaatacaaaaattattatacctggaacgtcaaagaaaaatacaagtttgaaacaaagcaaagcaaaaccaaacaaaaaatccaactattagttacattttagtcaaaggagaaataaaaatattttatgacttttagaaaataaccattatttgagaatgacattacatattgatatgagtaggttaaagcaatgtctcaacaaaattcataatgataattagtaataactagaataagtgcataaaaatacagcatatattaaatgtggcattccaaattttttaggaaaacaactctatttaaaaccagtgctggggcaaatggcgtacaatatggaaaaaacaagttagaactgtctgtacaccaaatatcacaataaatttcaaaggaaaaggaaacctaaaagaaaaaaaaaagaaaaactaaatcaaagttctgtaactacttacagaagcctttaagataattttaaaatctgaaagttaatttaaattcaagcagttataaacgccctttcaagatatattggaaatccaaacattcattccgtttgtggtgatagacaggattggcaatttgaaaccctcaggagacagaactgaccagaattgatgaacaatttgataacaggattagagaaaagtaattctgggttttaaacaatttgctaaaagtacatactatagctccttctttcttcccctgaccctcctctcccttcaaataagatacatattatactattttaacaaaaacattataatggaaataaatgtaaaatgatgagagagagttaaagggagtgctgggcaagttgagtttggtaggattgtagtactactcaaatggattcagatatagatacacaagtggcatttagctatatggagatgaaagtttaggttgtaagagcaaaattaaataccaagagtgatggtgtagacttaacagagaatgaggttttattacctgtcgtttcccaggactgttgtaacaaattgccaaaacatggtagcttctaacaacaaaaatttattctctcacacttctggaagctggaagtctaacatcaaggcattggcaggttggttcctctgcaggctctaaaaggcaaggttcctcgactctttcctagcttctggttgctgctggcattccttggtgttccttggcttgtagctgagtaactaatctctgccactgtcctcacatgatcttccactctgtctcactcttctgtatgtatatgtctcaaacatcccactgtgttctcatataaggatctcattttgaatttagaggccatcaatccaagatgatcttatctgaagaagagtatctgcaaagatcctattttcaaataagattacattcacaggtaccaggtgttaggagttaggcatatctttttttcggaaggaatgccattcaacacataataaatgactacgaaatattttgtcaccattttatacagcagatattaaaagaaagagaagctagaaattcagattgagtgatacggtttacaatcatagccagttctatgtagtccaaaaagaattttttttttcagaaggggggctgagaacaggactgagcagacacacagcatcatgccaggcaatgcaattaaaatatgtgttataaaatgagctttgtcctcaaaagtcttcagacagagtcaacatcattttcaatatggttcaagtcaaaaataatcttaaagagtcttttatcacaatgttattttaattggtgattagcctttgttacattgttgttgttgttgttgttgtgacaaagtctggctcagtcatccaggctggagtagaaggggcatgatctcagctcactgcaacctccgtctcccgggttcaagcaattctcctgcctcagcctccctagtagctgggactacaggtgcctgccaccatgcctggctaatttttgtatttttagtagagatgggattttcgccatgtaggccagcctggtcttgaactcctgacctcaaatgatctgcctgcctcagcctcccaaagtgttggaattacaggcgtgagccaccacgctaggcctagcctttgtaactttagcattatgtttacttctatattgtgataattaccaaagtaaaactactataagcaattttgtaaacatgagttatatgcattattcttctgaagccaaaagaaaaaactaattcatttttagtaaataaaaagattagcttttaaaagtgaaaacattggcttttctttacgaattctgttcattacttctggaagagtctgctttaatgggtcaatcttgttatgcccactaatcttggggaaggaaaagaaaactctttattttaagaccaaatacccagttgatactgggatgggaattaagaaattccctggagatcattgatggtcggatgggattgaggtcagtgagttgctccctgacacgtggaggtatggtattaagcacaggaagactgagaaaaggcttttagtttttatttggtgtatagtttgcaagaatgactacatttttcttttcttttcttttttttttttcggatggggtctcgttctgttgcccagactagagtgcaatggcgcaatcctagctcactgcaacctcggtctcccaagttccagcgattctcctgcctcagccttccaagtagctgggattacaggcatgcaccaccatgcttgagtatttttctttttctttttctttttttttgtatttttagcagagatggggtttcaccaagttggccagactgttctggaacttctgacctcaagtgatccgcccacctcgccatcccaaagtgctaggattacaggcgtgagccactgagcctggccaacaatgactacttttagtaactgcaatttatcccaccccaaacttgtagaaaatagcaaagaaaagtcaatgttccattcctaaggccatggtggaacaatcagccactgactccaggaacagcattaagcctcccaaagaaggcagcaaaaacatgatggaaactgtgcctgagactacaacagatgaattacaggagagacgaagtcgatatctcactgtcagggctatgtgtaaccagagagctttgggtaatgtgaaggctttatccagtcatttccaaaaagaacaagaatgaaaaatacagtggaagtcttaggttccccgaattacacataatggacaattttattacaagcatattggattaaaaaaatcatatcataaatattcagaccgacaaaacgtaagacatgtagctaatatttatttttaattgtcagaatttcaaatttttaatgtatacctgtgagggataatcatatatttagcttcttgaaatggattggaatttatatttttcataaatgtaaaggtatctctcttttttcctgaaactaagattgctaaaggcagaggtaaatattgccttaaacaatgataagaaagacattaggcaaaatagctaattattgactaaattcatccttccttttctctaaattaactgatattgccttgcattttaagttattttttctgagtaaagaaaatatgacacctgtctttgtctttcatatacatttttattcattttttctctttgtgtcaaatacatttttaaaagaaagaagctgagataattagatgcatcagccttacagaattttaaaagaaatcctctcataaattgttttcagtggctagagtatttagtgctccaataaaattagaagatgatgcccatttcaaaatttgatataacatatcaatgcaaggtaataagatgtttataaggaaaactattagaacacctaaaaggagatttcattgcagtgggcttaatttctagaaaataaatcgtctctcagattttcatgataattacacacgtaaataaatacccaaatgtgtcagataactacaatatacaataagcttattaaacttgtttttaaagcagatttatttattttgaacgtgaaataaaatattttgagttacataaataattcatggtgacattgagaaaaagatggtttctatattgcacactgtctctgatttccagctgtcattcttcattagatcgtgttgaatctatcatcaagctgcagcagtcaagacccaattgctcaaaaaagcctttggcatgagattccacagaacatggaaggtagaagttaatataccttagtatggaaacagataattttattatagttgttattattatatgttgtcaagtagagaaattacagggaagcaaatgatataaatgccttatgagtaataaattgtgagggggacagtatggcagataagaatgaattaaccttgtttcactacttgtaagatatatacgattttattttttccaataaaaatagttcaacattatgcttataaatgcacgttttagttttcttggtcaagaaagtacaaacctaggttttttcttttacattatgtaagttttaataagacattgtcataggcacagttaaactataaattaaatttaactcaatgaataagaattctgtaacatattcacttagtcaaagcaaataactaatatgacacactgcattacaaaatttattaataatggggctggtggtaaaacactagaacatccttgaatttatttcaaaataaaaagggaacttctagagtgaatgaagaattcaacgacttgtctaacacacactttttttttacttgccataagaatattttattttatttttcatcaacttttattttaagttccagggtacatgtgcaggatgtgcaggtttgttacataggtaaacagcacacactttttaatacctaagtgcctacactgtaactagtaaactgataaataagacactttcattgtttccattcaataaaccggcagaaagaaaaataattataacaatattacaaactctatggtaaagctatagtttatatgcagttagaaagaacgaaaataattatttttgttaatgagaaaagacttgaaagaaacagtgacatttaaacttggtattgagatgaaggcacaaaagtagactgagaataaattatgaagatttttaaaatatactatgaaaacttgggagtcaaataaactctttaaacgaataggtgacataagctgatttgctttccatagtaatcaatctggtctcagttataggtgatgcatgtgcacagacagaaactgggaacaaggcttttgcataagttcagacaatagaagattagaagctcaacaaaaatggtagagattgaaatgcagaggagagaaagattcaacagtgataagtaatgttagaggcagaatctgtacaatttagtgaaaaataaaatataagtatttcaaagaatagataaataaaataacaaatataggatgaatatacatataaatggaaacaaataacttttaggtgtattttttggggctttcatctacagagatccaacagaaagttttttttaaaaaatgcactggcttatttcacttagcatagcatcctcaagattcatgcgtgttgttgcatgtgacaggttttcttcttttatgactgactagtatactgttatatgcatatactaaattttctatgagatatctaaagtaatcaagctcacagaagcagaaaggaggacagtggttgccagggactgggaggagagggaaatagggatttgctcttcaatgggtataaaatttcagtcacgcaagataaaatagttctagggatatgttgtaaaactgtgcttatagctaacagtatggtactgtaaccttaaaattttgctaaatgggtagatctcacgttatatgttttgttaaccataataaaaaatacactgtatggtggaacaatacagtcactgtggtttgtgggtttgtttgttacaacatggaatttaataatatataacacaggaaataaatactctcattatcctacttctaagatatattaatcaatgtcttaacataatcaatatttatttctcactcacccaaaacttgatgtaggctatgtagtccttgtctatcttttaacttctcaatctggaacatagggtctccaaggtcattactggaagtttgtattagaatttttaagaggaccagtagtggaaatgtctttcactgctttcatcccacatcttgtgtagggcccaagtacatggaaactgcaagaaaggctgagaaataacttcttgtgggtctaggaagagaaagtgataaactaagtatatagtaacacatctgtcacatcacaaataattactaatagtaatctactgtatttaattctagtcacaattatttaaagactttctacataaaactacgtgtaaatggaattgtgttattttgtttttcatttgtactgcgtaaaactctatcatggtaatttttgtgtacaatagcccccattatccacggcttctgttgcccctggtcaaccacggttagtaatattaaatggaaaatcccagaagtaaacaactcatgatttattcatttatttatttgtttattttgagacagagtctcactgtgacactcaggctggagtgcagtggcgcaatctcggctcactgcaacttccgcttcccgggttcaagcgattctttgcttccagagtagttgggattacaggtgtgagccaccatgccaggataatttttgtatttttaatagagacggggcttcaccatattggccaggctggtctcgaactcctgacctcaagtgatccacccgcctcggcctcccaacatactgggattacaggcgtgacccactgtgcccagccaacagttcataagttttaaattgcccgctgttcatcagaaagctcactgtctggctcccgccccttagtcacttagtgaatcattcttttgcccagcatatccacgctgtccatgctacctgcccacgagtcactcagcagtcctcttggtgatcagattgacagattaagagaagaatggtgaagacagtacaataaaatattttgagagagaaagagactagattcatgtagctctcattgctgtatattgttataattattctatcttatcattagttatggttaatttcttactgtgcctaatttacaaattaaactttttcagatatgcattatatgaagaaacatagtatatgtagtatacattaaatttggtattatttttggtttcaggcagccactggggggtcttgaaatgtgtcccccatggctaagcaggggctaccataaacaattttattgatatacttcatttttaaatgacaacagttatctctttcaatgtaattcgtttacctaatgtttgaaatgcggaaaagataagaatctaggaagacccttagatttgtattttgagtaatcaagtagagagttttgttatatattaaaatgggaaaggatagattgaaagaaatcgtgaactctgttttgaacttgtgatgttaagatgcctattagaatgaaaatattaagtggacagtccaggatttccatctggaattcagccagtattttttattcaaattgactgatctagattccacaaatttgaaataccaccatacaaatgatgaaatttctacatatatgtataggttggttctgctttctattttgttctattaagtcttttttttctagccctgttcatattctgataattttattattacaatttttgggcattctttattttatgatggtaccttgcattttgttattttctttagagtgacgtatttaatcataaaatgattttcagaactaattcctcaacctgttccccttccaaataatacatgcagcatctttgagactatattgcctaataaaaatcctttatatgaatataaaaatcaaacagaagtccatttttaacctaagctcagttgaatgggcttctcctctttaaaaataaatgtcccctaaggcactgagttctaaataaagttgatgttaaaagagtagtacagaaaactttttcaaatacaactttcatgtgaatataacaaaaactttcacttgaataaaataaaagaaaaacactgaaaaataaacacagctggtaaaaataactgaaatacttaaaaaacattgtattttaaatcgtaacatttcatctttctaagccaatagtgtcatttaatgaagtgttagttatgattctgtagtgtacgttatttattgcttactaagcatccactttcccatcctatgtccttacagaatttcaaaattcattcagatttgcattcttcttcactctgttgtgtgtttcacagaagaagcccacaaccccataagtatgctattctctttgcctgtgcctgttttgccatgagcatgtggcacagttatgaacaaacacacgttagaagaagttgtttacagggttcagataagactatataaacacaacatttcttcttcctttggagatttttaaaaaattgaattgatgcctcgatgtgtctgaaactcctagaactattatggtaactctggcatacagaaaatgacaacatacaaaacatacacctgaggttttgatgatattttaaaatcagaaataacttataatggtaaggacctacctcccaacatctaaataatatgaggaaattttgttctctattttcttttatttgcagctgaaattgttctctttgtttgtttggctgagcacaggggactttattgatggtacatgacaaggtgaggctccctaggcccctccctcttcaaagggtctgcatggaaactgtgaggaggggagattctcagtgtggtgggggactgaatgtggcagggactccccagcagctgagggcctctttttgtatcttgtgctctccctggggctggtggtctgggggtcttactctttggaggtcaagtggaccatgaggtctatcaccctgttgctgttgccaaattcattgtcataccaggaaataagcttgacaaagtggttgttgagggcaatgtcattgccctcattgacattgaaagcagaagagtgggtgttgctgttgaattcggaggagacaacctggtgctcagtgtagcccaggatgcccttgagcgggccctccgatgcctgccccaccaccttctcgatgccatcatatttggcagtttttcccaaacagcaggtcaggtccacgactgacagtttggcggtagagacacagaaggccatgccagtgagcttcccattcagctcagggtgaccttgcccctgttcttgacagtgccagtagatgcagggatgatgttctttagagctccacggccttcatgccacagtttcctggaaaggccatccacagtcttttgggtggcagtgactacatgaaatgtggtcatgagtccctccacaatgacagttgtcatggatgaccttggccaggggtgctaagcagttggtggtgcaggaggtattgctgacaatcttgaggctgttgtcatacttctcatagttcacgcccatcacaaacacggggtcatcactagaggcggcagagatgatgacctttttggctccccctgcaaatgagccccagccttctccatggcggtgaagacactggcggactccacaacacatttagtgccaacatcaccccattggattttggtaggatcttggtcctggaagatgatgatgggatttccattgaagacgagctttccattctcagccttgactgtaccatggaatttgccatgggtggaatcatactagatcatgtagactatgttgttgaggtcaatgaaggggtcattgatggtgacaatatccactttaccagaattaaaagcagccctagtgaccgggtgcccaatatagtccaatccgttggctctggccttcaccttcaccatggtgtctcagggaagaggctggtggtgcatgagaagatgcagctgtctgtcgaaccagaagagcagagagactgaaattgttcttaatgattacaagtacaaaccgaaatgccttaaatgattttaaaagctttcttgaattattaacagttcatttcacctagggggcagtgatgagctggggaaaaaaatgaccacattggtacagtatactgaagtgcaggttgccactctcactcttgcaaataattttaattgctctcctaaattgtctgtcttggaaaaaaattttgagttgaataaatttccaaatattcatgtttctctagcaactcaccaacagcaattccaaattggttgattatatgttgacattcattaaaatattagaagaaaattaaacatttaaaatttggtaatttgatattttttacacctgatgtggtgttggccttcaatttttcacaactgcttaaactaactgcagttgattctcattattcacagagtccatatttgtaaattcccctatgagctaaagcttatttgtaatcctgaaattaatacttgaggtgcttttgccatcatttgcgaacattcacagagcagcaaaaaatttgatttgcctgatatacaacacctaaggtagaacaaggtaactttctgtcttcttgtttcaattctcatatcctaatcagtgacatttctgagctctctttgtgcagtgttctttgcactatttggttttcactagtgactttacaccttcaaatgcttctccccctcagcctagtgctgaattgctttctagtactcctgagtgcaagaagactgtgatctgctacatggagaaatcaggtgtattagatgatctctgttcaagcacaaatgatagtgtattggctgtgagttcaatgttaatgaatcaacaataattattaaataaggtgtctttagactgaagcactcataaaacaatgttatgtgttgattggttgatgaaaatgtgtagccagagtgcacaggacactaaccctgtattttccataggggcttagtattctctaagtcagtgtttttggtgaatttatagaacataactactatgaatagtgaaattcacctgcatgtgtgtatatattattttgcataatatttatatactgtgtatatattatattttacatctatataaatcaatatatataaatttatccttttaataaattaagttacattttggacaaatattgatgttagtttctagtaaagttttccatcttacatagcttttttctatttttcatttggagttttgattaaactactataattctatggtgtttctattctaatttattactgtaccgatttacatataaagatattctgaaattataacacatttgaattcttagagtaaacaatacttggaaatacacagaatacattttacatagatattcatcaaaatatagacggcaagcagaaatatatgcagattattacaccactatattaattaattacaattttctttacaaaaaacacaaaatcaatattcagatgaataagcaatattagtgagacaaccaaaagcctctgacatgccccttcccagacactactctacacccaaagtagctgcaatattgtcatttaagaccacagcttgtgtttacatttatataaataaaatcacagggtataaacataaacttctaatgcattttttgttgagaattatgttctggagattcatgcatatagttgcatatattttgtgttttttaaattgtagctcatcaggaaattcttgaatcttctctatcagatacataagggaaagttacccaattatccatttcattctcttgtgtaacattaaatcaaatttaatgagaatgaatcttagtctacggattcagttgagcaagaacagcagcattaacaagtaaaattttatttaactcaagttctaaattagtgctctcattcttccttgtcctgttttattgcattatcctaagataattcagcacattactaatgaggaaaggctacatctgagctttagtcacagatcaacaaaggttgtggctcgaatgcccattatccctgttctatcttactcctgtgctcataaccacttatagtttgaaaataacctgctagttctgtgtcatgattagggcacaggaggagttttctctgacactacctataatcctccatgttcaattgtgttacataggaatttcccttctgacctcatcaatctctcacagtgatgctaagcacaacatacgctacctttatattaaagacctttagaatatttcctcttatttttctcttcttaaccagtcagactaatatcctttcaatttcatgatcattttttgcccttcatgtgttttcaagatattgtgctcttatatccccttcattttatcactctgcacacattttgaggtccttttgaacttagacattttgctgggaaaagccagcaagacatgaaggcaacttcattttgctctcccacatgcttcctcttagataacgaattagagaacaatctatgaatttaaatgtgtggataaaataagtaattaaatattgttaataagcatacatattttaaatcttgaattttttcttattagcccactaaattttactgaagatacagaaataggataaagacaaaaattaattgtgagaaaaaagcatacaaacttaccaatgctttaaatccaggtgtggagacaaccttttgatagcttctggtgaacttcctgagaaacgatgtttcatctggggtaaagagactggactgaagagatgtgaaggtagtttctcactccaaactctgattattccaaatattaaatattattgcaccatctgaattatcaaagctctccaaatccaaaacattctagtagattcaattgcttcttctgagagtatatgtattggttttataaaaggttaagaggaaaaaaagaatcagagtagatttaagctaatgctgtcatgtagaatagaatgctgaggttcaaaaagggtgaatgacaaaactgagtctaaaatattagcatcaacggtatggctttttatatattgacttccgttttgctccaaggcaaagcattttgaaattatattaattgtgtgtaagttaacctttgaagaatgtattcttaattctatatgtattttttaaatcatgttatattatctgaagttgaaaaacttattctcaaatagttgaaacttatttcttgcaggtagaaatccattcatttaattaataaaatattgaataattactaatagttaataagctaaaaatataagtggctattattataaatatatcagtttaatactataaccctaaataatttatctcctgaaattctaaaaagatttttagaaacaaaaagagtatcatatcttaacttctttatatctgttatcacatttcctaggaaaccacattataaatatgcaattttaaaactaacttcccttaagatacatatgtaaatgatatggttgctaatcaaatcagacttcatccattatttcttgttgcataacaatttaaagcataattttgttttatatatcaacaacattttcattctgggaaatagcttcataatatatactaagaccatataaaatgaattattattgcaactaagcgtgtactgtgaaatggcttagcaaaacactagcttgcatatcatattcttgtcctgcttaacaactgcaataaaatagaaatgataaggccataaagaacagtgtagaattagaaacagtaatcactgtgcattacattaccatttgatatgatgaactgtagcttgctgagagtaatcttaatgaggattacagtagatatattaaaatatatatgtggccttctattaacaataagacactcaaatgtatttttttgcatctatatttccatgctacattgtaaaggctgttattttaattaacaggactttgaaaatccatttgattagaaatttgaatgccaagttaaaccatcaataaaattaatcagaaacaacatactgagcaaatgcagaaaatttcaatggttttcaatttttattgtgaaggcaaattaaatttaactgaaaagatgtatcatcatgtactgacattcagaaaactatccaagacttagccattggctcaccagctggataacttgcttttatgagcatctattctcacaagatgagcaggacatgcagttgtgtttaaaaactcaagcaatcatataattagtgctatatattttctgccttgctatcaaagaatctaaatgtatcgtattatttaggactctttcagttaaatatgtcagagatcctaatctaactagggctaaagtttgaaggaaagggattgggtttttgaaggaaaggggttgagtttctcttattctgtagactgcttattgataatttattttgctgtgcagaagttctttagtttagtaaggtccctgtgttagttggctttgtgtcactataaagaaatacttaagggtggataatttataaagaaaagaggattaactggctcatgattttacaagctatacaagaagaagcatggttccagaatctgctcagcttctgctgagggctcaggaagctttcagtcatggtgaaaagtgaagaaggggcaggattgtcacatcgtgagagtgaaaggaagagagagaaggaagagatgttatacattttaaaacaaccagatcatgcatgaactaacagaacaagaattcactcatcatcaaggggatagtgctaagcctctcaggaggcatccacgcccatgacaatacctgccactaggctccaccttaaacattggggattatatttcaacatgaaattttgaggagacaaacatcccaacaatattagttccacttgttaatatttgtctctattggaattgcttttggggatgcagccccccaattttttgcgtacaaggatgtgaagaagggtattgcctaggttttcttctaggattcttattgtttgaggtcttacatttaaatctttaatccatcctgagttaatttctgtatatggtgaaaggtaggagtccagtatcattcttcagcttgtggctatccaggtattccagcaacattgattgaatagggggtcctttctccatttcttgcttttctcagctttgttaaatagcagatggttgcagatttgtagctttatttctaggttctccattatgttctattggtctatgtgtctgtttttgtaccagtaccaagctgtattggttagtgtagccttatagcatagcttgaagtcaggtagtgtgatacttctctggctttgttctcttgggttaggattccttcagctatctgggttctcttttggtttatatgaattttggaatagatttttctaattctgtgaaaaatgtcatggtagttcgataggaatagcatggaatctgtaaattagtttaggcagtatagccattttaacaacattgatttctttaatccatgagtatgaaatgcttttccctttatttttgtcatctctgacttctttgagcattgatttgtaattctctgtgtagaaatctttcacctattgggctatctgtattcctaggtatttatttttttatttatgattattataaattggattgtgtacttgatttggctctcagattgaacattactggtatagaaatattactaatttttgtacatacattttgtatcctggaaatttactgaagtcatctaccagttctagaagccttttggtagagtctttagggttttctaggtatagaatcatatcgtcagtgaagagagataggttgacatattcttttcatttttggatgccttttctttcttcctcttgtctgattgctctggcttggatttccaggactatgttgataggagtggttggaattgatatccttaccttgttctgattctcaagagaatgcttccagctttcactcattcagtatgatactggctatgggtttgtcacagacagctcttatcattttgaggttatgatagctcttattattttgaggtatgcccctttgatgcctagtttcttgagggttttgtcataaatgtatattaaattgtattgaaagatttttctgcatccattgagatgaccatatatttgttttcaattgtttatgtggtgaatcacatttattgatttgtgtatgttgaacctgccttgcatttcatgaataaagcccacttgattgtggtttattatctttttgatgtggtgttggattaagtttgatagtattttgttgaggatttttgatcctgtgttcacaagggatattggtctgaagttttagtgttctgttatgttgtagccagattttggtatcaggctgattttggcttcatagagtcaggggggagcctccctcttcaattttctgaagttttttcagtaggagtagtatctaggtatctagataggttgctgggtaaaatggtacaactatttttagttctttgagaaatatccatactgttttccatacagacaatactaatttagattcccaccaacagtgtataggcattccttgttcctcatagcctcactagcatctgctattttctaactttttatagaatagccattgtgactggtgtaatactgtatcacactgtggttttcatttgcatttctgtgatgatgagtgatgtggagcattttttcatatgtttgttggtcacttgtatgtcttattttgagaaatgtgtatttatggcgtttggccactttttaataggtttatttgattttcttttctggagttgtttgaatttatcctagattctggatatttgtactttctcagatgcatggtttgcaagtattctctttcattctggagattgtctatttactatgttaattatttcttttgatgggcagatgttgtctagtttaattagatgtgcagaaactttttgatttcattaagtccaatttgtctatttttatttttgttgcatttgcttttgcgatcttagtcaaaaagttgttgcctaggccaatgtcctgaagagtgttttctaggtttcctttggggatttttatagtttcaggtcttacatttaagcctttaatccactgtgagttaattctgcatatggtaagaattagagatccagtttaattctgccacacatggctattcagttttcccagcaccgtttactacatatggtatcctttcccactgtacattttttttttttttgacgaaagtcagttggttgtaggtatgtggctttatttctggattctctattctgttacattgatctatgtgtctatgctcatatcagtacaatgctgttttggttacaatagccttgtaatataatttaaagttagctaacgtgatgcatccagctttgttctttttgcttatgatttctctggctctttacgttcttttttggttccatatgaattttaggatttttttttctaattctatgaacaatagcattggtaatttgataggaattgccttgaatctgtaaattgctttaagcagtatggtcattttaataatatatccttttaaaaagtgagcgtgggatgtttttttcatttgtgtcatctacaatttcagcagtgttttgtggtacacattgaagagctctttcatttccttggttaaatgtattcctatgcattttattttattttgtggctattataaataggattgagtttttttattatactctagttctaggatacatgtgcagaatgtgcaggtttgttacataagcatacacatgccgtggtggtttgctacacccatcaaccagccatctacattaggtatttctcctaatgctatccctcccttagtccccccacccctgacaggctctggtgtgtgatgttcccttcctcgtgtccatgtgttctcattgttaaactcccacttatgagtgagaacatgcggtgtttggttttctgttgctgtgttagtttgctgagaatgatgtttctagcttcatccatgtccctgcaaaggtcatgaactcatccttttttatggctgcacagtattccctggtgtatatatgccacattttctttatccagtctatcattgatgggcatttgggttggttccaagtatttgctattgtgaacagtgctgcaataaacatacgtgtacatgtgtctttatagtggaatgatttataatcctttgggtatatacctagtaatgggattgctgggtcaaatggtatttctggttctagatccctaaggaatcaccacactggtttccacaatggttgaactaatttacactcccaccaacagtgtaacagcatttccatagttaggggtgagttcttgattttgttctcagctttaatgatcttgttttatgaaaatgctactgatttttatatgttgattttgtaccctgaagtcatcattttcaagtttaggagtcttttggaggagtgcttagggttttctaggtataagattatgtcatctgtagaaagagataaccttatgtcatcttttccaactttgatgccttttgtttctttctcttgactgttcgcaatggctaggacttccaataccacatcgaataggagtagtgaaaatgggtattttgtcttgttctagttctgggaaatgcttcaacttttccccatttagtgtgatgtttgttgtggctgcttttgctgtatcccaggtgttttggtatgttgtgcctgtagtgtaactcattaacttttttttatttctgccttaatattgtcatttactcaaagatcattcagcagcaagttgcttagttttcataaataaataaatttgaatagcttttttttttaaacaaatcctcacgctgtcatccaggctgtaatgcagtggcatgatcttagctcactgcagcctcaatcttctgtgctcaagtgatcctctggcctcagcttcgcaagtagttgggactacagtcatgtgccaccatgcccagctaactgtttttaaattttcttgtacaaaaaagtacaaaatgatggggtcttgctagtctaaaactcctggccacaagtgatcctctcagctcagcctcccaaagaactgtgattataggcatgagtcaccatgctcagccacatttgtggagttttgagagtttttcttggtattgatttctaactttatatcactatggtccaaagagatacttaatacaatttcatatttttaaaatttattgaaacttgccttatggccaaacatagtatctatttgggagaatgttccatgcacagatgagaaaagtgtatattctaaagtttttgagtagaatgaatggtaaatgtctgttaggtacattttgtctagaatctagtataattccagtttctttgttgattttctgccttgttgatctgtctagtgctgttactagtgtgttgaagtcttttgctattattgcattgctgtttatctcttttcttaggtctagtagtatttgttttaagaatatgggtgctcctgtgttgcatgcatatatatttttaggatagtaatatcttgttgaattgaaattgtcattattgtatattgacttgcttgtctgaactcaacctccaggctaacagttggctctgatagccaagagctgcctgtggcacaatcagatgggtatgagcttgatctttctttaataagatgtgctctctggtgcttcaggtgatgggttggtctgtagaatgcccagtgacctgagttccctgttcagtccatggtcaggaggacaaagctgggcagagtcataccagtgagctttcccataaatgtcccaatgacaagtgtaggcaccagtcctcttaggggtggctgggggaaatcctggtgaaatatgctgaggtcacctcagaaggaggaaggcagcaccgattccactttttctaaaaacgtttttgtgtaaagcaatttctctttcctctgaaacacctatggaatttgaatatctctaatacctttagttacactgtagtccttaacatcatctccactaattctataatcttcataatcattcaggacttgaacaactgcctgtattacttatgatgtagctccctatataaggccttgaatattcaatacaagattgatgaatcaacgaaagcattaaccaactgaaacattgatatttgtaagatggtattattctttatatattcttactatgtggcattgtggttaacttttttttttttttttgagacggagtctcgctctgtcacccaggctggagggcagtggtacgatctcagctcactgcaagccttgcctcccaggttcacaccattctcctgccttggcctcctgagcagctgggactacagctgcctgccaccatgcctggctaattttttgtatttttagtagagacagggtttcaccgtgttcgccaggatggtctcaatctcctgacctcgtgatctgcctacctcggcctcccaaagtgctaggattacaggcatgagccacggcgcctggccttgtcattaacttttttaaatcaacattttattcttttaaaatatcacacgaaatttagaagtctgcttctctctgcaattagttcagtactttactttttaccttttagcctcttacctgacccatcaatcctgctgtaatcagatttaagtcttctctggctacagaacccaatatacactaaatgttaacatctcacaggtattcagctacttcagacaacatattaaaatgacaaaacacaatcacttttgtctacattctaaaattcacttgatataattgaattgtagaaataaaggtgaaaacacattcagtacatgttacatcaaagaaatgtagagaaatttaatgagtattggacagtactttcaaggaaaccttagtatgattcagagaaaatgtttactatttggacgtagtgacctaaacgaaatgctcgcttttttgatgcctgctctttatcctatgtcatgtcaccattgttatcagaacagcacttatttattgctcatccagaaaaagatacaattaacattgacaacttaaaatatatgtccttctattttgcacagtaaattttgcaaaatacgcattactccttttatgtcaatggtttctgaactcaaactagtaatctgtcattttaatgacatttgagctgtcaaaataataagcatttaatataaatattgaagctgctgctagaaccctaaaacaaaggattgctgtagcagaataattttcaaaactcagataatagatataataacatacacagaccaaaaaacaacatttggaatttttttcttggaaaacagggaggatgtataaacaggataaatccaaggttgatagtcataaagaaggctatgtaaacaattacttttattaaaatcgaggctttagatgttaaaggtgagaaataaagatgaaagtatcatataatttatgaccataatgcaatatcacataaaagctgtgtatgaaagataaaattattgtgtaaaaagaactaattaaaattttattttaccaagtttaaactgagataccaatttagtcttcactaatttactggttttttatttatttcactgcaaaaggggttaaaaatccctacattgctccttcatagaaagattgtacatgcccaactcaatatatagggaaatgtttttaggctgtataaaagcaagatactaatttttatttctcagatagcaaatatatatatatatatagctacaataattcagtagcaatttcaagaattaaaatttaagcatagctatctatagcttattttgcttattttctttcaagtagtcaggtaattttacaaatagcatatttttcctaataatttgcattaattgaaagaattttgaataacatttgtagtattgttacattctattgttgtctaacatatttctgatcatgtgaaatctaacatagaatatgcaaatcaattaaatctaaaatttctgtatttactgtgagtaaacaaaaaatatttctctgaaaatttttacagtgcttactgaatgagtactattttcattaaaataaaatcagttttctgctgctgtgtgtagcagagaaactggtaataggctagatctgctataaacaagtgagaaactggataaaccactttctgatattatacaagagacattgaatgatgggagccattgacgaaacagaaagttacatggtgagcccacggataatttcaacttttaaaggtttattttattgttaattaacacataataatggtaaaagcttatagagtatgtcgtgatatttctaacatgtatacattgtataatgatagagtcaggttaattaggttatcaattacctcaaacatttatcatttctttgtggtaagaccattcaaaatcttctcttctacatattttgaaatgtacaatataatatttgaactataatcaccctactatgtaatacaataccaggtcttattattcctatctatcgtaatttttcacccttgaccaattctggtgaccacttatgctactttctatttcattggaaccagatttttaagttttgcagctgtgtgagattatgtggtgtttgtctctctgtgctgccttatttcacttaggttaatgtcctctgagtttatccaggttgctgcaaatgacaagattttattcctttttgtggctgaacagtgtttcattgtgtgtgtatatacatatacatatgtatgtgtgtgtatatatatatatatttctatgcattcattcattgatggacaattaggttgctccatagcttggctattgtgaatgtgctgcaataaacatggaagtccagatatctctttgacataatgatttcatctcttttggataaacacacagtaataggatttcaggatccatatggtagttctacttttaattttttgaaaatcaccatactgtttctcataatggaagtaataatttacattcctaccaatagtatatgagttattatatctccacgttcataccagcacttgttatttttttgtcttttttaatctgaataatatacattcggatagatgtgaagggatatttggttgtggttttgaaatttatctccctgatgattagcgactgatatggtttgggtctttgtccccacctaaatctcatcttgaattgtgataatccccacatgtcaagggcaggacaaagtggagatgattgaattatggggatggttaccccactctccccatgctgttttcgtgatagtgagtgaattccaacaagatctgatggttttacaaggggattccacctttgctcagcaccgcactcttctgctgccttgtgaagaaggaccgatttgattccccttccaccattattgtaagtttcctgaggcctcgcccggcaggtggaactgcaagtcaattataaccctctttcccttgtaaattacccagtcttaggtatagcagcatgagaatcaactaatacagtgatgctaagcattttttcataaacttgctgctcatttgcatgtctgcttttgagaaatgtctatttattttgcctattttaaaatcagagtgtttgtttgcaattgatttgtttgaattcctatatattctagatattaacctcctgtaagatgcataatttgcaaatattttctcccattttataggttgtcattaactctgttgatgttttctttgttgtgtacaagctgtttagttttatataatcttatttctttagttttgctttctttgcctgtgcttttgagttattatacaaatattcttggccagacaaattatgtgaagcacttttcacatgttttcttccaatagttttatagtttttgcatcttatatttaagtatttaattcattttgagttgacttaagtatatcttgagagataggggcttgtttcattcttctgcatgagaatatccagttttcatagcaccatttattgaagagactgtttttactccaatgtgtatttttgttgcctttttcaaaaatcaattggttgtatgagtatggattgatttctgggttccccattctgttccattggtctatgtgactattttgctgatgccatgctgttttggttactatggctttgtaatatgttttgaagtcagatagtgtgacaccacaagttttgttctttttgctcaatatagctttggttatctggggtcttctgtggttccacagaaactttagaattttttttctatttctgcaaaaaatgtcattggtatattgatagggatttaactgaatctgtagttggctttgactagtgtggagattttaacaatattccttcttccaaatcatgaagaaatcatatcttctcacttatttatatagtcttcattttctttcatcaatactcagctttcattgtatatatcatttactaccttggttaaatttattcacaggtaattttttgtagtaattgtaaatgaaattgctttcttgattttttttttaaatttttttttattatactttaagttttagggtacatgtgcacattgtgcaggttagttacatatgtatacatgtgccatgctggtgcgctgcacccactaactcgtcatctagcattaggtatatctcccaatgctatccctcccccctctccccaccccaccacagtccccagagtgtgatgttccccttcctgtgtccatgtgttctcattgttcaattcccacctatgagtgagaatatgcggtgttcggttttttgttcttgcagtagttcactgagaatgatgatttccaatttcatccatgtccctacaaaggacatgaactcatcaatttttatggctgcatagtattccatggtgtacatgtgccacattttcttaatccagtctatcattgttggacatttgggttggttccaagtctttgctattgtgaataatgccacagtaaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctgtttctacacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagaagagtagattgcaaaaattttctcccattctgtaggttgcctgttcactctgatggtagtttcttttgctgtgcagaagctctttagtttaattagatcccacttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacctatggctagccagttttcccagcaccatttattaaacagggaatcctttccccattgcttgtttttctcaggtttgtcaaagatcagatacttgtagatatgcagcattatttctgagggctctgttctgttccattgatctaaatctctgttttggtaccagtaccatgctgttttggttactgtagccttgtagtacagtttgaagtcaggtagtgtgaggcctccagctttgttcttttggcttaggattgccttgcgatgcgggctcttttttggttccatatgaactttaaagtagttttttccaattctgtgaagaaagtaattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggagttccctcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggacagaacttccaacactatgttgaataggagtggtgagagagggcatccctgtcttgtgccagtttttaaagggaatgcttccagtttttgcccattcagtatgatattggctgtgggtttgtcatagatagctcttattattttgaaatacgtcccatcaatacctaatttattgagagtttttaccatgaagggttgttgaattttgtcaaaggctttttctgcatctattgagataatcatgtggtttttgtctttggctctatttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgccccgctttggtatcaggatgatgctggcctcataaaatgagttagggaggattccctctttttctattgattggaatagtttcagaaagaatgataccagttcctccttgtacctctgatagaattcggctgtgaatccatctggtcctggactctttttggttggtaaactattgattattgccacaatttcagatcctgttattggtctattcagagattcaacttcttcctggtttagtcttgggagagtgtatgtgtcgaggaatttatccatttcttctagattttctagtttatttgtgtagaggtgtttgcagtattctctgatgatagtttgtatttctgtgggatcggtggtgatatcccctttatcattttttattgtgtctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatgtagtgctataaatttccctctacacactgctttgaatgtgtccagagattctggtgtgtggtgtctttgttctcgttggtttcaaagaacatctttatttctgccttcatttcgatatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtatgtggttaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcatacatatttagcttagctcttcttgttgaattgatcccttgaccattatgtaatggccttgtctcttttgatctttgttggtttaaagtctgttttatcagagactaggattgcaagccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccacttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctcttagtctgatgggcttccctttgagggtaacccgacctttctctctggcttcccttaacattttttccttcatttcaactttggtgaatctgacaattatgtgtcttggagttgctcttctccaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgattgtctgaagccttcttctctcagctcgttaaagtcattctccatccagctttgttccattgctggtgaggaactgtgttcctttgggggaggagaggtgctctgcgttttagagtttccagtttttctgttctgttttttccccatctttgtggttttatctacttttggtctttgatgatggtgatgtacagatgggtttttggtgtgggtgtcctttctgtttgttagttttccttctaacagacaggaccctcagctgcaggtctgttggaataccctgcagtgtgacgtgtcagtgtgccccttcttgggggtgcctcccagttaggctgctcgggggtcaggggtcagggacccacttgaggaggcagtctgcctgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttccaggctgctttgtttacctaagcaagcctgggcaatggcgggcgcccctccccagcctcgctgccgccttgcagtttgatctcagactgctgtgctagcaatcagcgagactccgtgggcgtaggaccctccgagccaggtgcgggatataatctcgtggtgcgccgttttttaagcaggtctgaaaagcgcaatatttgggtgggagtgacccgattttccaggtgtgtccgtcacccctttctttgactcggaaagggaactccctgaccccttgtgcttcccaagtgaggcaatgcctcaccctgcttcggctcgcacacagtgcgcgcacccactgacctgcgcccagtgtctggcactccctagtgagatgaacccggtacctcagatggaaatgcagaaatcacccatcttctgcgtcgctcacgctgggagctgtagaccagagctgttcctatttggccatcttggctcctcccctgctttcttgatttttttttaggtactttactattagcatagagaaatgctactgaattttgtgtgttaattttgtacactgaaatttactgaatacatttattagttttaattttttttgtggaatatttagtgttttgtatatataaaatcatgtattctaccaacagggataatttaattttctcctttccaatttggatgcactttatttctttttccttgcttaattaccctggctaggacttctagaactatgttgactgaaagtcgtttcttgttcctgaacttcaaagaaaagctttcaacttttaccctttcaggatattagctgtaggtttgccacgtagggcctgtattacatagagatagatctttactatacttaattggttgagagttttcaatcatgagagggtgttgaattttatcaaatgatttttgtgcatttattgaaacgattatgtattgctggttcttgactctgttgatgtgatgtatcatatttattgatttgcacatgtgaatcatccttgcatccctggaataaaccccaattcattatggtgaataatgactttaatgttcttttgattttcatttgctagtattctgttaagaatttttaccattacgttgatcaagggaattggcctgtacttttctttctttactgtatccttgtctggttctgatagtagggtgatgctggcctcatgaaatgaatttgaaagactttgaaacaactatatgccaaaaaaattgagaaatctagaagtggttatataaaaatggtattggttttttaaatgtttgttaaaattcagcagtgaaattatcaagtcttgggtttttctttgctgataaactttttattactgatttattcttattagttgttattattctgtttagattttctatttcttgctgactctattttggtaggttgtatatgttcaggaatgtatacatttcttctaggtttctcaatttgttggcatatagatttttataatagtttctttgtgttcctgtgctatcagttttaataccttctttttcatctctgattgcatttatttgaaaattatccatatttttagtttagttaaaagagtcaattttatctttttttggaaaaaactgttttatttgctttcctttattaacttctattttgtgtatttctgctgtgatctttattatttcttttactatagttattttggattaactttgctctggcctttctagttcttggatgtgcaatgttaggttgtttattgaagatctttctaatttttttgatgtagacatttattgctataaactttcatcatagaacttctgtgtctataaggttcatttgagttaggatacagtttaaatccattttttttgttgttgattctatgtctggatgatctgtccattactgaatgtggttgttgaacttccctactattactgaattgaagtctatctctctctttagttagcaaatattttagttatatttgcttcatatattttggtgctcttgtgctgggtgccaatatgtttacagtttttataacctcttactaaattggcccctttatcattatacaatggttacctttatctgtttttacagtttttgattgaattgtattttctctgataagtatagctatcctcctttcttttggttttaatttgcatgatatatcattttccttccctttactttcagtttatatgtactcttattgttgaagtgagtctcttgtaggcaacatatagttgagtcttgttattttaatcaactcagccactgcgtgtcttttaattgaagaatttaagccatttacattcaaggttattactgatagctaagagcttactcctgccattctgttgttttctaaatattttgtagaaaaaaatgtttttttcttcttcttctgttgtataactttgtgattaagtggtttcctgtagtagtaagatttgattcttttctctttctcatttgtgtatatattgtaattttttcctttgtgactaatctggcactttcatgaaaaattcttgtagttatgtaagtatattttaaactgataaaaattaattttgattgcatgcatataattcagacatctaccccaccataaaatttataattttattgccataatttacatttttcatatcttcttgacaacttattgtaactaggattatagcttactattttgaaatttagcttttctactagagatttgaaagattatatactatactacaaggatagtaatagtgtattatgaatttgattatgagtttctctctaaaagtaagggttatactttcatgtgatttcatagtaataactccattttgcttctagttggagcagtcttttaagcattttgttgcaaagtctggtttagtgaaaaatttcctcagccttcatttgtttagaaaagactttatttcttcatttctgaaaaataactgtgctgaatggcaggatttttttttctttcagcactttgaatgtataatcccattcttttggcctgcaagttttctgttaagaaatctgctgataatctaatgggatttcctcatattagacttgatgcttttatcttgctgctcttaggattctctttgtctttcagtttggtagtatgattataatgtgctttagaaagaacctcttttgtttgggattcttttgagtttcatggattttgatgtccatatgtttctcaaggcttgggaagttttcatctattatttttttaaataagatttctgtgccttcttccacctgttctctctttataacttccataatgcaaaaaacatgctcacagaatggtgtcccatatatcttgtaggttttctttgattattttttcttcttcttttttcttgacagaattattccaaaatatttgtcatcaagttctgaaacttctttcttctccttgatatagtctgctgttgaaagtctcagttgcacttttcatttcactcactggggcttttaactccaaatttttttaatgatatttcactctttggaatttgtcatacagaattgtatttctcatttttttcaaattttatatctgtgcttcctttatcttgctgaattaaaaaaaatgttataatgaattccttttcaggcagttaaaaatttttctgttctctggggttagttactgcaaatttattatatttatttggtgctattctgcatccctgtttttaatttttcttgtgtctctgttgatgtctgtacatctagtggaacagtcaccttttcttatattttagagtatctttcacagggaaaaattttcacttgcagatgtgtcttagggtgtcatttaggcagggtggattgcctaggttccaggtgggcacagtgttgtagtatccatgcagtttattcagctatagtcatcatgcttgtgagtgcctcaattgcctaagctgcagcagcttgtagtttcttagacacagcctccatgctgggctgattcacaggtcaaatgtgggtaggggctgtttggttatttgatcaggcatggcttgtccgttgagggtgaatgtaccaggctgttctgggcaatgaacagtagtgaacacttgtggcagagaaaggagtacttcacacatgaagagaagcctgagtggcacactgcagcatccactagtgccaaaggatcctgctgctacatgataattgtactattaggtggctctgaagaagggtggaagggaaatgttaccaaaaggcagagttgcaggcaatgcccttgttgaatatccaccttgtttggaaagggaaattgtcagtgattagaacaatatatgaacacagggtaatggtgactgacttgtttgtttggctagagttctgaaatgggagagagagaaaaattaggaggaggaggaatgggaaaatagcacatggcatggatagacatattaagtggggaagaaaacgtaaagatctttgcttattgacactttccagaaagcaatcaccaggaagaggtactaaatgatcagaatgagttgtctcgtaagtttaaactgtcataccttactgcagtactgaatgcataagtagtaattgtggcagtacacatcaaggctatgtatgggcccaacattatgggtttcccttaaccaagggatggaaaaaactgctgctgatgtccattactttagaaaatcaatcagttacttagaggcaaattgattacattgaacctgtttcacactgaaaggagcagcaattcatgttgccccaaaatctgcacaaattcagggtatggttttgtctttccttcatacaaggcttcagctaatacgtgtatctggggattcaacagaatgttcattccaggttgatagttatgtccttctaagatgcagttgacataatgacttggaggcaatgccttgtaaagattataaaaccgatataaatgactatcatgacctgtcgtgactcaaaacggtagaatgcatagatgagaaaatgaagaagtagaagtgggtttattgactatcccttccaatgatccactaatgcatttttttaaaaataaacatatgcattgagtcaatttccagaaatttatcatttttgtcatgtttataaagttttatcattgcagtttggagaaagattttgccaagctcctcgcagaaatgttgctctgcttttacatttctaaaggaaaattattttgaaactatatttttgtaaacagccaaactatcaatcaaatgtgaaggcaaaataaagattttttaaggtatttatagaagaaatgttttatccacaaactctaagcaaattacttggtgatgaattcaagaaacacaaaggattacatttagaaagaagacataaggtacaatgaatacaactgaagagagttgtggaaaaaatgatgaatcatgaatggataaacctgtggaaagcctcagaaagtaacaaatctagaccagaaatgaacgtgagaggtggtggagagaaggatctgtgcagagaatatcgtgtgacacagatttgttaaatttaaggatatgtcaaaggaaaatagcacaaaaagagaaatgtatgttcaaatttaaggatcaacaaaattaaacaagagtagtatatattatcaggtatcatttcacattacaataaaactctgatcacaataatataaaaagttattgattttcaattttgacagctcaattatatacaaaattagaaaatataactatgttagatttggggaagaagtattgcatgagagctaaaataattattaatgaaaatgataaagacacttattttataattattagaataaaataaatgtttcaggaatattacttatcaatgggaggaactaaaaataatattttaggaggaaaggaagggaagtcaaggaaaatatatgtcacttaactaaatctacatcgaaataatttgtccactgcatagtatgtaacattcaaataacaaccaaaaaaaaaacccaaaaaattacagaagcataaacaagaatatacacttaaagaactaaatgcagtattctggggagtggaactgggaatcaggtagagtgggcaaaggattggtactttttactataaggctttttgtatttgatattagagtattatgttttcaaaaatgtgtacacatgttttaataatcaacggttgtaaagcaaccaaaattaactaaatttagaagaggcatgctgtctaaaaaatatatcaatgaatgttaaaattgtgtctgagattactctagcggttaggagcacagtgtttgaaaccatgctacctatgatgagtccaggttctgccatttagtggtgtgactatgttcacatcatgttaaataagttattgcagtgagtaaaggaaaaaaaacacacaaatatgtaagatttagaaaaagaaaggatgatttaaaagcaaaccttttaaaacaaattgttattgctaaataataattttcttttcctggtcacgtgtgtgtcgttatttatcctattatcctattccttctattaagagtttttgtgtctacttttactgaaggatgttttctagtgactttttttttttgaggcggagtcttgctccgttgcccaggctggagtacagtggtgctatctccactcactacaacctctgccttccaggttcaagggattctcctgcctcagccttctgagtagcagggattataggcgcccatcagaacacccagctaaattttgtagttttagtagagatggggtttcaccatgttggccaggctgttctcgaactcctgacctcaagtgatctgcccacctcggcttcccaaagtgctgggattacaggtgtgagccaccatgctcggtggttctctagtgattttttttttttttttttttttttttttttttttttttttttttttttgagacggagtctcgctctgtcgcccaggccggactgcggactgcagtggtgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctctctagtgatttttaaagatttctttaagagctagttcataataagcctagtctttttgccacaacttgtaaacaatttgtgattgctaatacagtataagtcgtcgacaggagttttggggcttctgaattaaaattaacacactaatgatgattatctttcagttaggcctgtgaataaaatggctgttcagcaaagtagacgctgttgttaaatatactcctcttactgacaatggtgctatgatagcttttaaatgacaggaatcaacctaagagtacactgagataaaggaatggtagaataaaatgtgaagaaacaattaaaatggagcttctgttaagttattaatacactgtaagatttggaataatttcagaaatatatttaggtaatgctgtaagtggagaggattaattttctcataataatttcaattcagatagctgactttgtcagtgaaactgacaatgcttctaatattctgtgatctctgcatctcacagagacttacaataaagactaagtttaattgtaactttttttccctctgacctggacatatttttataaattcgtactgtaatcaatttcagatataagtgcaatactatgcatttaaatattctactcctttaatcctgatccattgtccttaaaataaccttggcagcttttgcttattttccttctaaatattttttccccaggagcttctttgtcccttaatataaatagacttctagtgtctgtttcatcagtgtaccagacacatccagacatactgacattctgatgtaaaaacaggttacactcatattcacatgctgcaaacaattgtgctcatgcgttctaccatagagggttatcataaaatttaaaggaatagaatatgtgaaagcattttaaaaactatgaactatatacactgtgaggaattatcatttaattaattaatttaattttgatgctttaagaaacgaatccatctttccaatactgatgtttgagtattggtaaggacagggcattacttggcttgtaagttactggccaaaactgaaagaaagattcaagatttcaaacttaaattacttgtggcaataagtgtgaaatagactgaggctctcttttcaagccatgataaatgtgcataggagagtatatttttccttctctctcctctcacagatcaggcataaaatggatacaggcatgttgataggcatctgtttaggctacaaggttgccaaaaactacgaaacaattcttgacaaaattctgtcaactgagtaatttaaggctgtccacatttcagaaattttatctgtaagaaatttgtcgacactgcatggatgatggctgtagtcactgcttccttttactgtgcagtgatttggacagtaatggacagactggtttgaagcctctacatttttggtagtataatatatggcaatcataaattgctcaaaaagggcaatataaaaccagctttcagatttcaataactgaggtcagtttgacatttagagacagtgggcttgttgatggcaagtctgcatacttttgcatgattttaaatataaagtaagtcactcagcaaacagaaaataagagtcaagcaaaaataaaattttctgcttgactgaagaggatgataagagtttatatatttattattctggagattatttaaagattagttttaattaagatgaggtgaaaggaaaattagacaaaataacattaaaaaaatttttcaacactaagaaagtataggagacctaaagccattttgtgttgcatttccagtgaattgcctcatttcaggaaaccatctttgtattatattgtcttcaaaactaggggctttaaatataagcatttatacatgccctgtctcctgcagacatccctcttgccttccttacttgctaccagataatcttatttttaaccttagaccttaagtgtgttgctagcatgatgcacaataccctgtgaatctggcttcttggtaccaattcttttgattgttctagtcttcactccctttaatgtgttcggtgccccactagattgcttgattgtcagtaaagtgccattacctctgtttggtgtcttgatccacctggaaattttatgtaagaaattgagtttaaaattttaagtaaaaagtgaaaataacataagatgaaaagaaattaatcactttgcagtatcataaaacaagaatgaaattaaaattaataaaaggagtctgcactaaactaagaaagtaacatttgatcacagttacttcctcatcatttctctccttttcacccttgctgcttagagaagataaggtctttgcagaggaagggagaaaaatagtattcattatatctgaaatatatgaaattctgttatgtgatttatcatagtatttattgttgttttttgtttttaacttttaataagccaaagtagcaatgcaaaacctagaatgagaaaagcctacctaaaccagtaagaaagaacatagtcaatgttagggagacagtaatttattcttacaaaatgagctgacctattgactggcattagaaagcagctgtagtaaactgcagttccctggtgtttgcactaaattacaagtaaaaatatttgggttccaggtctacctgttattaattagcttggggcaactcagtcgctttaggaattgacacaatatacacatttaatctgtaagtaagaggttggagtgaatgagttccaaagttttttatagctcagcaaaattgtttaattttgaggaattagttttaaaatatgactggtattaaaactaagatctttccagtttcctaatcctgttattttcaacaggtcagacattacaataatataactttcatatcttttatgcccatacagaagttgtgattagctcacagcctctgcccagctggtgttgtcaaataaaggtttattctattaggtggggcagggtgtgttggagggggcaatgaagacagaaatgaaattaaaccttcaaattatattattcttaaggcccagtctctttggagcaggtgtataaagtgggaaccaaccaatttggagattcttagaatctttatgattgtcttagaagtcccagccaggcttaaaacttagaattgtctctaatgatattttaggggagtgtacatacgctagcaggtaggcccaaacagcaatgattctggacggatttgaatttgcaactggattcccaaactctaggatactagctgtcactctctatcatttcgttatccttgtaattaaacaaccgcaaatcttctgcaaatgaattttgatttccactgccacaaggtgatagagttttactttactcatttggagagtcatctgttttggatgttgaaatgtgacctccaatgttggagaagggcctagtggaaggtgtttgggtcatggaggaagacctctcatgaatggctttgtgctatccttgcagtaatgagtgaattgtcacacttagttcacaaaacagctggttgtttaaaagagcctggaacctcctcagctttttcttgctccccctcttgccatgtgacacactggcccccctttaccttctgccatgattataaacctcctgaggccctcaccagaagcagatgctagcagcatgcttctcataccacctgcggaactgtgagccaaaataaaccgattttctttataaattacccagatttaagtattcctctataagaattcaaaaaactaacacagaggtgtacaaactatttttcaaggaacgtaagttatactttaatgttggcagtgttctcaagagcaggttagtgtgctacaacaaaggctgaattacttaacgaaagtgaaaaaaaatgcagcctagtgaaaatgtgtaatgttctgtagaactagaatgctatgtttcattgaagagttcagtataagaacctttctctgtttctgactttctttttactgctgctattctaaattttttttttttttttttttttgagatggagtcttgctctgttgcccaggctggagtgcaatggtgcagtcttggctcactgacacctctgcctcctgcgttcaagcgaaagcaattctcctgcctaagcctctcgagtggctgggattacaggcacccaccaccatacctggctaatttttgtacttttagtagagacggggtttctcaatgttggccaggctggtctcgaactcctaacctcacgtgatctgcccgcctcggcctcccaaagtgctggaattacaggggtgagccactgcacccagccctaatacttctagtcttgactcaagtatacctgcaactctccaaactcctgtgatttggggctaatataagaatcacctgtcactagttccattgaataactacattttttgtaggaagaagcgtcgaaaggctttcagagaaccatcagtcaagtcatggactggtatatggtgtaccttaaaattaccagggaagcatcttataattttgatttcctggaaagcattgcagaactactaataaagaaattgtgtgcagggcaacaaaatgtttattctatacaagttactcaccgtctatattactcataaaattgataacaactgctcataagaaaaacaaaattgtgattttaattaaacttatttctgtgttgggattgttggtgccatgatttttacccactaaacttcaattttgaaccctagaaatagtccctaccttgagttcttcaccctgtagaattttcacttttttctggtgtacagacattttaaagtttcagattaaaaaataactatcaattgtatttattttgtaagaaaagtgttaaaataaatactgtgaaatgatatttagaataaattctttgttgaaagaaaaaatatagaagtaaaatttttataaagaaatgagtacaactctgttatgttaaatggaaattaggaatagtggtaggaaatctttatagttactttagtttttagatatgtatttcataattttggatactaaaatgattaccaggaagcaacttccagtaatgatgtgcattattaccagatatatttttgtctctcaattccattctcaaatataagaaattaatattctttgggaaaaaatgttaaatttaagtctgaggcaggaaagaaacacacaaaattggaactagaacgtaaatttttgaccaaaaagcaccatatcaaagactgatgagtcataaccaaaatgatagggtggcaggtctgacgagaatcttatagggcaaatacatgatcattagagtaacaaaaataaaaacaaaaattgtttaatctcctaatgactactgcagttgattgagacacataaattatctaaaagtccaatagttcaaaataagtttaaaaaataataatttgacactatttaaaatagctagtgtaccaaatacctactttgaaaattgataaattaaagaacaggaatttttctgattcagttttctgtaaaaattctgagttttgtaaaagtaggaaaatatatcataaaattgctttttaaatacccctcaagatataattgatgcagtcaacaattatcaaacagatattaaaaccattacttgaaaacttgtttggtgactggatattcacaagacattaatgcattaccatggtaattatttgttcattataaagggaaaacaaaaaatgtgcacttgtgggttcaagctgtcacaacttgaacctggtgacccatcactaagagtggacttttagtgcttcatgatataatgtaaaatgaaatagaagcatcatactatggtcttgcaataaggctgaaaaaaaatactgaggcctttgcctctagttttcagttcacaggaaacagaataaatatttaaaaaaaaaaagattaacatatccataaggaagcaatagtatttgtagagttctgaacattatgaaggaaacctgatcttattcctctgataaggcaatgaagttggattagaaaagatttataaccggtaaatctattcttaaaaaatcttatctatcagggttggggggctaggagaggaatagcattaggagaaatacctaatgtagatcacgggttgatggatgcagcaaaccaccatggcaggtgtatacctatgtaacaaacctgcacattctgcacatgtaccccggaacttgtcttattgtttcaattaaacaaatgataaaaatactattttgttttacctgtcaatgtgaaagtgagttgagcattagataaaattaagaaactttcaaatttccattattgaaaaaaaattctttctttaaaaagctgcatactgacgatccatgatgacagttcttgattcaaatactttggtaaatcaaaaataaacaaattaaacatggtgcatgttaaacatcattcaatcttgatgatgtgggtattaagattcattaaaatagtctcttttatatatacatatattttaaacctttaggaaaatttaatttaaaagacattttaaggcatattcagtgatcttttaattactacattttggttaaatttggcctccttttgactacctaaattataaaggcaaaatgtttatctataattcagatttcatctttgctctacactgctatgggtttaaccaaccaattctaatccacagtctactttttataattcacaaaaagtaatagtacaatgaaaaatttcgtaaatttttcctgtaatttgtttgaatttctggataccactggttaagataaatcacatttgtagtagttgctattgcttaattttttttaagtctaaatttttgatttatgtcttaacatggatgcctttcattagggagataaagtaactttttacccaagcaaagtcaactcaaatataaagtagtagtgccctaaaaataattaaaataactattgctttaaaatacttatataattttaatacagatttattatattgttagaataattaaataatattcaaaaattatttttataaatataaatatttaaataatatatctatactttacaaaaaatataatattgtcattttgaatatctaaacatcaaaaagccaatagtcattctttgtatatagtcccatattgtctctcaaaagtgaactgttgatgtttatctgaataagtaatttttctagtatattgttatcagttttaattttttcacacaattaaaacacttctttaaatttgcattttgtggtcaacatatttgaaattgttgtctttctaatcaacacttctcaattgatcataatatattttttgagcaaatactccttctttaggagccaaggtaactaggaagattagatcaaatctgctaacaaataggcattatcaattttacaaatagaatgcataaatattttatctgaaatatttaaatagacactattccttagactgaattgagaatttttttaacaaaagaaaaaaaactaataaaattagtaatttcatttctcatttagtgaattttagcaaaattattatgggatgaaatcactggtcttctgttttctattaaagaatagaatataacctatctgattaaaaataagagttctgattgtcacttcaagaatggcaatgggaggagttctgcagacagacatgctccctagtgaaacagacataaattgtgaaaaataaaaataaaagaatatttgaagtctcttgaaatggtcttaagggcaaattacaaataaaaaaaaattattcaagaaaatctactaatattcactaggtgcactgagaatctgtggcatttgaactggaacctactccttttctcctatagcccctcaaccccagtataatggattttaactcttaataagtacatccagaatatgggatttcttctctcaccttacatctgaaggctatggtatattcctggtaagggtgggacatcagtattctcattcccttcctaccccagctacctgatacagaggcaattccaggagagtttggccaagaggttggaggctcccttcttccactagatctcactcataaatgaggtctttgccacagaagcgtgctgataatatttgtgcccaactgctcccacctagctcattcatagagtagagcttccattcttctttacataaagataaaggcaaataaaaatgcccagaggttgccattcctaaccagagctcttccaaagtagcagtggactcaaagaaacaggtcactattcctggcatcagttccaggtccatagctcagagactttgtctaagtggagatgcaggccatataaacagagaactctaaagctctcctgaatttgaaccagtctgtgggagaaaagaggccaaagcaggatgacagaacaggccccctccagtgattgtccctccacagaaatgtaatttgagaaactctccgtgtccccaaatatcttcacaatagctaagagaaccaggtgagagatcacagcacctgattatagcacaatgataaaagacacattgaagagggcaggaaggacagttttacattaccacacagaccctctcccaaccccagacagcacagtgcagaaagagataccatccacttgagagagaaagagcaaagtaggcatagaattttatctgaaaaatcccatattgggcccttgatagtaaaacctagcactaggcattaccccatgactcttgactccaaggtattaaccacagactgagcatctaaacccattctgacaccagacaagaatatataactcctgtgagaaaaacgttagttatagcttgcatcactactggctgactatagtggccttgggcttcaaataactcacagcaacaggctggcctcagcagccatgagttttgagtatacgccagtgctgtgcctgtcttagcagccaaaatattgttcagtccagcattgttccagttatgatggtcttgggtttagggcttccactagctagcactacaagaaatgcagtggtcagggcttagggacaacactagatgacctactcagaatctcagaatgggcttactattgaaggatgttcctcaacaaacctagagtgcaaagaatggagcaagtacctacttcttcaatgtgcaaggataaacacgtgacaaggatttagaacaatcaagaagacatgacatcatcaaatggacaaaataaggtaccagtcaccaaccttaaagatatggaaatttataaactgtgtgacaaagtattcaaagtatctgtcttaagaaagctaaaaaatctgtgagaacatataaacaattagaaaacataggtaaaacaagtgatgagaataagaaatttaagagagactaaaataataattaaaagaaatcgaatagaaatcctggagttgaaaaaataaatgaacaaagtgaaaaatgtaatagtattaacagcagaattgatcaagaggaaaaaattctataagctcaaagacaggttatttgaaaacatacagccaggggataataaaatgaaaaaatgaagaaagcttatgggatttatgagatagtattaaaggagaaaatgtatgagtgattggtgtgcaagagtgaatggagaaagataaagggatagaaaacttatttcaaagaataatagcacaaaaaaatcaaactaggaacaagatataaatatccaggtacaggaaggtcaaaggtttccaatgagatacaatccaaataagactactccaagacatattataatcgaattgtcaaagctgaaagaaaaagagtgaatcttcaaagcgacaagataaaatacgcaaataaatggagttcaaatgtgcctgtagcagacttctcagtagaaactttacatgccaggagataagatagtaggatgatttattcatggtgctgaaggaaaaaaaataaaatctatgccagtgaagaatatggtactgagcaaagctgtcctgcagaagtgaaggaaaaataaagactttccaggagaaacaaaagatggagattttcatcaccatcagaactgtcttataaaatatgctaaaggtagtacttcaagctaaaagaaaagaaggctaatgagtttagcctaatgagttagcctaaaagaaggctaatgagtttcatgttgtttttacaacacaaaaacatgtaaaaatataaaagtcactggaaaaggtaaggacacattcaaattcagaattctctaatactgtaatggtggtgtgtaaatcacttacaattttaggatgaaggttaaaagacaaatctattaaagataataataagtacaataatttgttaaacgctatgcaatattaaaaggagtaaattgtgacgtcaaaattgagggccaagtgaaaacagagttttttttttttttctatgaaagttaggttgttaagcacttaaaaaacttcatattactatgttttctgtgagcatcatggtaatcatgaagcaaaatctgtaacaaataccctaaaaaccaaaaggaagaaacaaaatatacttccagagaaatcacttaattataaaggaaaattgcaaacactctctagttacaggagccagaataaaaatggatcaatctgtgaagttatttatgtgccagatcattgttgaaaacaatagagcaatcagcatgtaattaatggagcttaatagctctatgtaattaggaaagagacaaagagaaccctgtcaaaccactgttatctcaaggtgacagtgtacacacccaaggttgtaccatcattaaaatagttctgtcagtcactaaacaaatacacaagtgaacaacagtaacaagctgtggggaagggtgaaaagagtatagagtgttgctacaatatattacggaaaatatctaaatttcaacaacaaaaaatgatgatttatgcaagagacaagaaagtagaaaccatatgaaagaaaggaaataaacaaagcaggcaatagaaactgtgagagggaccagatgttggatttagcagacaaaaaactttcaaagtagtaatcataaatattttcaaagaactaaatcacatccttaagaacataaaggaagtcatgatggcaatgtctcaataaataaacaatataaataaatatatagaaatcataataagaaccaaatagaaattctggagttgaaaagtacaactgaattgaataaacaatttactaggctcaataatgggtttgacctggcagaagacaaaaattagtcaacaaacattagaaccaaaaaaggtatatgacattttaatagagtcatggacaaggattgagtttaggtaaaatttatgccaagaaaatttttaacagacacaaagcaaagcagggctgtatataaaggagtcaatatcagttccaaataaccaagctgacacagggtctttcttcctcgggaattacaaagttaagctaaatgtggaatattacatcaggaagccacttgtttgatgttctgtatctgtgttggaaattagactgctttgctatgtcaaggtgacttaaatcttctagaagagagtaagatgttttatttactaatataatttcaaaaaaaattttatggcctattttagaatatgaaatcattcttgagtaataaaatggtaatcactcaaagaaaagagttgttgggacactttacagctgcagaatattccatggagaaatcttgtttcctgttgactctacagttggatttatctgagtctgtttgtccagcgcgaggaatgatagataacctgattttttactagaaacatctattgctactgatgataaatataatttcaacattggcattgttcttctgctaatggtgctaaaacattaaagatatcatttcacttacatttcagcacaagaatggtcaatttttatttttatgtcaatggaaagttagacttcttacagtaataggtaaactaatgttttgtagctcaatgtgtttccactgcttacaagcacagtgttctaaatatttgacctttgatgtggatattggtgcttcttcagtggatttatcctctggattttcttggtttctgtgcactataatcacaaaagccccaatgaggatttaaatgtcaatgaaaattttattcaaattatactttaatcaccacattttttagtatttaaattgcagtacctaaagtttcattttaaacttattatttcaaaaggatgtactatagaataaaaatttgtttctaaaaactaaagccaaaacaccgcagcaagaatgttcaactgttttctataagctctatgacagcctatttctgttcacttttctgagctgtgcagcctatttctgagcacatttcatgtacacctaatgtacaattccccacatttatccttgacctgacctacaagagacctaaaatattaggacattttgaacactgcaggattacctatgagagtactgccaatttttcagcaaatgcccagcacagtcagagaagcactggatgcctctccagttgtgcttctgaactcattttgcaagatgtactttgcaaggaaggagttatcaatgctgtgtctacaacggtagtaaatgacaaccatcttcactgagcatgcttgcttagaaaatagcagaagtttaggtaaaaagtgaaggcttgtggaacaaatctcagttactttcatacattttgtaataataacatttacctaaccatgatgcattgttgaaaaatggaaacctacgagatgctgaactggatggaatccaggactatggatagctataattgagactctggcaggtgaacatcttgtatggttatatttacattggtggaaaaaaaatgtaaactcactcaagatatgtaatcaaaaatgggttcttgattataaggatacagaatgatctaatatgaagagtacttaggaaattgagttgtccctccagaggaactggatctaagagatgcttttctttgcatacctgttctttctgagtctttcactgcctagtaactctctactgttcgaccttatgggggagaaaggaaaatcaatgctaaaagctaaggctataggaaaggactgccagataatgaggggctttagaatcacattagtgtgtttagaatctactcttcaggcaacgggaaaataataggatgtaggcaagaaaatataatcgtatttatatgttagaaagatgaatgtgactgaagaaaaaaattcttaagacttcccaagagaagaaattgtaaaatctacttttcaaaaatttcttgtgcctcgtcaacagttgcagccttccaggaagtgatttatttgctgatagaatgtgtcccaagtgtacaaattaagcattccttcctacccaatctcacaggcagaaaaaaagaagcatttgaattgtacttatatttctcattatgcttcaggttctcaaattggtgtgaaacaacttcctctgtgaatagtattttgtatactatgccaagggagtacaccacagggcaataaatgcagatgttttctgagtggggccttcccataaaggaagaccatattataatttggaggaaacttttttcattactttaaatataagcactgtcagaatacagaggaaatggcttaatatatataaatattaaaatttaaaggcccaaatattaagtacaggtgtataaatggtgttttgcactgtatttttatattttatcttttaaatattttcttctataatatgtatttcaatgtagtaattattaagtatttcttatcttcaaggaataataatgattatgtagggctgtgtttcaaagtctttgtaggtcagtggcaatctggctctctgagattcttctctagggcttattaaatacaaaattcataggtctcctcctcaagagtctgattcagtggatctggtaaccatttacataaatattataaagctgagttggagaaattttctattttcaaatatttgcaagttagaaatgtttcatttcagcctcttatattccattcttcctgctttagagaaatatatattcatcatgccttcactatcacttgaacctgctaagcagaaatcctcctgcctatagtttaattctgtcctatttattcctatacataatatacttcacagcactttgaatataaaaactcctatcaattttacctcctaaggaattcaattactcctcactatcttgactaccaccactcttatctaagttacactcatctctttcataatctacaggtgtagcttcctaattagtctacctccatcaggctgtgctccctccaatctattcctcataacatagatgtacccaactttttaaaatgcaaattgaatcatattgtcaccagctcacctgcctacatgcacgtgcatgcacacacacacacacacacacacacactctttacccttaaacaatttcattttccttcaataggtttttattgcacataggataaagtcagcattccttagaagactacagtctacatatactagccattactacctttccaacataacctcacatcactactttattttcattctgtgttctgaccactgcacttttttttaaaagatatctggactatggttgacagaataatgccataatgcccccaacccaagattcccacttaataatccctggaacctaggaatgcatcatattatatggtataaggatattgatgatgcagattcaatcaacattgccaataagttaattgtaatataagatgaccacgaatagtctgattgggaacaatctaatcgcatgatttcttggaagcagaagaagcaaacgaagagagttagaaaaatgcaagttttcattttaaccaaggaatatggttccctctagaagctgggaacagaacagatctcagctcattgccaacacaaaaataagggggaccttaatcttatgacaatgagctgaactacaccaataacttgaatgagcaaggtaatcaactcttccctagagcctccagaagatatcatattctgccatcaccttgatgtcagcccatgagactggtgttgtactgctaacctacagtactgtatgataattagttcagtttgttttatgcccctgagcttttgttgaattgccaccccagcaatagaaagctaattcttatacccaagatgttatccggtgatgttccctgcctagaatatgttttctctcatattcacaaaactcgtattcgttagatttcaagtttaaaaattcgatttatcttccactttttaaaaagttatctttcagttagaaaaaaaaccctcctatttctgaataatttgggcagtactatcaatgtacattcttgcacagctgtaaatatctcagtgctatttttaatagtagattgcaaacccctaggagccagatatataacttcatactttcttgcatttcttcttgtaagcagtatattttaattttgtttactttgaacactttgcaccttttatccagtaaaaaacagataaaaggagagtgttattctagaaataggtattaaaaagagcaagatccatccactctgccccaatcctcctcaccatactgacagagtcgctacattaacttctagagttctgggacaaacccgggtcacatacaacaaggaatattcactgtttgaaacttgctggatgctacctatccaaggaagaaaatatatctataattgtacacaataaacttcatattatcataacataaggtgggtacattaataaaaaaaagcatgtttagaattgggtttgactatgtctagaggatactagtaaatttcaaaaagaaattggatatagaaaggtcttaattaattacaggaaactggaaagtggcaagtggtttgactggtgagagatacttgaaggatcaaatttagacaactgtatacaaagaagtctggaaaagaaataatcatttggatgtcatgggagttgggggaaagtgtgtggattttagtgtcttgggtcaatgatcacagacagtttctaccacagaaggggaattaaatatccaggtagttgcataatgcttacacagtaagcctcagaacagagtaaacatggtggtggcagtggaggttctagatgggccccaaagtgtgtctctctcaaaattccttctctgaattccaggtgttagaggaggtgcccaaggcactgaactttctgaagaagctttgcttgctctggacctctcaaacctaatagccttctctgtaacctttctgtgtaggggacatgagccttcccaaatgtgacatatattcaacatataaaaaggcctactaagttctctagctttctcttagtgcattgaagatgcagggtacaataaactgtccttcattcagagtgggtgttctagcatggttcagaccttgaaacttgagaatctttactaatgtggtaccctgaatctttgcaggattacctcccaactactagaattcatgtaccttgccagagaatctggagtacgtgccatattctacttttcaggtgcacttatgtggagaccagatgatctcttgtgaaagagagtgggatactgagcaaaggagtggagcaaagccatgaaatgagttactgacctttccaagtgaacgttaatttgcattgtcctatctcatgagaattaaaaatggcatactgactaaatagtttaacacatgccaagtctcagaagttgtgttgagctattccagtgaaaatactacgtccagcctagctgttgtgactagggctaacaaataattaactgtggctcactgccatgcaaaatgatccatctggcttttactgggattgggatgataaattgaatagacataagatagatgtcactaatttagcctcctttaagtctttttgtgtggcattaatctcttccagtctacataggatgaaacatggtttctaatttacttacttggctagagacaagatcagttcagtagcttccaattaaccattcttttttagtatattttattccatagatctgagaaccggtatgattattctgcaaaatgctaactatactcttactgattacaaacatggggaccacaagaatgaccgaagggtgtcagggcagcttactctcactgcaatatgagtttttgtctttgcacaagttaactctaatacagtttatgatgggactgtttttctattggtatcagtgtctgctcagaacctgcatgcagtaagccttgtaacagctgtgtatttctttttctagagtagacagttattccagaaaatggtcataggtctcattgatgaaagcattagtgaatatgttatgatgtatacttgctgaggcattgctggggcttttcttaaggtgactaagcctctccttccatgtctggcatataagtctgagaactagcttaagcctgaaaatttgaaaaataaattctgattttctactattatggataacattggccttctgttcacctacttttgaggtttttcatgtatttaagtcaagtaatgtccttcttagctgtcatctagctcacccatagtgcaatatagatttattagacaacaccccagaccctgtggtctaaggtcttttgactgccatgttgaccttgctaatcatgtcactctgtctcagttaagtagttacctgtcttatgctattttggaatgttacaattgccactggctacagaatcatcccttaagaggaactctggcctgcagaagagagcaaccattatctttacaaacaacattggtgactgctctacttagtaaattaattattgctttggtaaagagtgtgtcctttggctcttcctgaataatttagtaagttggtagattctctgatattataaaatatatctattgcaacagaatcaactctctgagctttttcatggtttctcccacactctgacaaagtatttacagcatttctgccccattcatggtaagccatcatgtatccacacttcaaagatacactccgcagtgcatgagaacaagctccaagtgccttgcctggaaattcagtcataaagcacagaagagaattccctccatattcttcctggccttatatcacctaatccccattccaccatcttcaaaataaaattataagcacattctccaaggttctgtacttccttgatagaacattgtaaacttctcccttaccaaatctaaaataatactttctacgtgacatggtgatatttgacccctgtttttttctttggattcagcgagtaaaggtaggggtaactgcaagagatgaatgctcatttaacactatatttaccccattctctgtgttaatctttgtctaacccaagcctagcattttttgccttcacatcataaatgacactaatagtacacaaatacctccagagctttttgaattattgctgactacctactcttgaataacaggggtattgcattatcatatgcatcctcttccatcttgattccataacaatttaacataggtcagagtattagcaatagtgattcaattatatgggaagggtgattgcttccctaaacccaccagcattaagatcgttgttgccatttagctgtctggtgatcaattctggaattgtatcctgagtatctacttcttaggatcaattctggcaccaaatgtggtagtttaggttctcctagaaagcaaacccttagcaaaattgatgcttgctaaaaccttagcattgattagaattaagtacaggaagaagtttatttgtaattgaatctatgagacattaataggaaagaagaaataaaacaggaaaataaaggcagtcaattatatgtatgttgttagtcaagtgacctctgaggtcatctaaagcttaaccatactagatcttcaggatccagcacaatatatgcacaatgaatggaaaagctgtgatgtttatacacaagtcactgttcatcactagttgagacctatgaggtatgactgggaatggcagttaattatctggcaattcactagcctacagtacagaaagcaaacttcactcaggtggtcatagagcccaggcaaagaaatactcatattggctactaagagttgagactgtgttgaagtgaagaagtaggggtataaaagtagagcaccagtgcttctgttgcataagtctctgctcctaagtcactataagataagaaaaacttctcaactttacatcctttcttatttcacagaaataagaatatgcctttaaactttatttctgaaactttgtataaacaggcaacaaaatgagcagaaataacattgaccaattaggaaagacaaatatacacacaaacttaaaaataatatttgttactagtcttcttttaaatgtaaattctcttccacccctgatttgtatttcttggattccaatagcatcaggggtagattcatataaaattacacagacattgccctggggaaatgtggttggaactgtggccatatctagttgttttctaattctcctgttttccacttcttagatttccttacaggtgtagattcaatattttctttcaggacctgagttatggtgagttactgttatgtagtaacttctattatgcttgctacctgcatacacacaaggtctgaaccaagaaggcaggaacagagcaacgcacactgcataggacttgtctcaagaaaatcacattgtcatatctcttttgtaaccttgttaaagtcatttgtttcaagttgaaatatttagtagtagagtgtgacacccccaggaatccctccacccacacaacaatcaggccggcactgctctacttgccctacacaaatacacttgaatatttccaaaatctatgccattcctctattccaaggactttcttactcaggcttacccgtattcctattgaactagtttgccttaattatctcctttacggactcaaagttgaatggtaaaaaccacagctattctacctagaaaaatagaaaccttgtcattaccaagataaataatgtccttactaaaactactacatgtcaatatgagctacttacgtacattttatttgtaaatttaaaaatcattttctcctttgaacttttttgcaattattggagttatcttacaatatgtatgtatgtcttgattattaggtcaaaataataaagtttattagccttcctacaggattagaaatttattccattttgaccatcagctttttataatctatgctattataatgagcctaaactacttatttaaaacccaaggtttctcttagctattcagtagcaaaaggtaatgttcttcaaagagaatacatatatattctgactgaaatattgaaacatagtgcagaaaggtgctaaaggaataagttcttcatagctagctgtattttcaagatggttccctttccagaatttttttcaagatttcacaagttttcataccctatctatgtggtgcttactttctgccagaacagcttcatcaataggagcagacagaacaaagctgtgacagggaagttacactgagtctatttgttgaccacagtttatttcccaacattcatagatctcacatctatccatatcaactttttgtgcatatcaactttcattgtcagtatatcatgcctatgctatcaattttcgttgatctcacatcctactgcagtcaacatcataaacaacatttagacaaaataatttgaatatgcctgagctcgttgatattattgaggagttgccctggtctgtttccatagaatagaatgttgcatagggtgtgtagtatgaaagaaatgcaatggatttccagtatgatagaaccaaatttaaatttggcttgaacactgccaaattgtttgaacttttgaaaactgcgtaatcatttcaaacttcaaaattctactcgatagaatgggaatttgattgttgtgataattaaatataagtagttgagtagattgttttatgttaattatgcatttaatggttacagtattagctctgtattgttacttaacatattactgcaaacttagcttcctaaaacaacacacatttatttcaaaattactgtgggtcaagagtctgggcatggcttaattggatcctctatgtaggatctcagatggctgcaatcagtttattagccagtttgtgttctcatctggagactggacttaggattaatccactttgaagctcatttggtttcttggcagcaagatgaagtcttatacaacttaactgtaatgacagaaggaatatctcatcatctttgccatattctcttaactaggtgcaagtgacaagtatctcccactcttaagaggaggtagttatacaaaagtgaacactaagcaggtagaaatcacagggtcaccttagggtcttaaacagtaaataagttattacttctccaagtcctagatttcccgagcttttaaagcccttttggcaatgattttacagaactaggtcttagattcttgctgataaaatttcttttagcatatgtttcttaatgaaaaatgaatgtgtgattttttgttttccaaagggttcttataataaaaattatttccaatagcttatgaagtatgacttcaatttcttccttaggtctcaatactagaaaaaatcaaatttcccatttctgatagttaatcagatgttcctctagtcgcatatatgcttctctaatataattatatatgtatatacatataatcattaaatttaacacatcatattattcaaaagatagcctgaagaaagattatatataatatatatatgtaaattgctagtagatatattaaaaattgtataacacctttggtcatatgaatacaaatttagaactgcagtgaaatatcagtatatacctatcagaaaggttgaaattaaaaaagataagacagataataccagggcttgaaaaaaatatgaaataactaaaattttcttatattccttatgagaatgtagtcaaactacatcagaacattttaatggtattaacttaggctaattctatgacacatgctaattttatgaccaagaaatctcactcttacagagcaaagaaaaaaaatgagcatgtatgcctattaaaaaataagtgaaacaatgtattttttataattttattaataataaccccaaattgagaataaaccaaatgaacataaataggcaaatgaaatataatggaataataaatagcaattaaaaatatcaaactactgatatgaataatagctgcaaatcaaaaatttattatcctaagtcaatgacaccagacagaaaagggtaaatactaataatttaaatgaatttcaaaagaggacgaattcttgataaatagcataaaataatggtagatgtttaaatgaaattttttttttttcctgaggcaagtattaactgggaaggggcatgaggcactttctgggaacctggactttctatgtgttgatatggattgtgattacatggctgtatacgtacataaaatatattcaagctgtatacctaagagttacacagttcataaactttatagcttatgttacactgcaataaaaatgaaagcaagcatgcatatggctagaggaatgcggggatgagccttaggtgtaggaggactaggctcttacagtattttctttaaaaataacctttgttctaccttgacttttgttaccaaatcttaaactagatgaattctgaaatcttccactattctgcgtatggactagtgagtagctaaacacatgtgaaacctttttagagttctactattattactactcacaaaaagtttaaatgtggcaattttatttttattttttgagacagagtctcgctttgtcgcccaagctggagtgcagtggtgcgatcttggctcactgcaacctccgcctcccgggttcaagtgattctcttgcctcagcctcccgagtagctgggactacaggcatctgccactacacctggctaatttttttgtatttttagtagagacggggtttcaccgtgttagcccggatggtctcctcgatctcctgacctcgtgatccgcctgaaatgtggcaattttgctaattctacattttactaagttttatattttgccgatgaacaatgtaaacacaaaacttcccttactccatattattccactctcaaaattatatatatggaaagatgtatgttcttatagctggcattttgaattagaagagacaataattgttaaattcctttttttccctattttaatgccatctcctaataaaacttcctggttatattttctgctctataaaaagagtaaggacttagaaatccacaatatgattgacacttacttaccaatatattatgataaccagtacaacttactgtaccattcaatgtgtttttatagtcttcagttaattacatggtaactaagacctcgtaatatacagtcaaatgggtttggctatagatgtgtctaatcatgaactcatatttttaaatactcacttcagaggatttttttaagctaccttactgttatattcaccttatttctccattatattttctataaaaactattgatagataacatttaaagctaatactttaaaataaatgtttatgcctttgaaggtctgagaattccattaaaagctttgattttacatacattttaggcaatagtggaatttatcagatattttattcaactctttgaaattaagatatatcacaaaaatttgaaattgtgtcatccataaaaactaatcatatctcttcctttgtaaaagtatttcaatggctgtcactggtctggtggtaaaggtgaaacttactatcatgtcttagaaggatgtaccatgttcttcccttatataattgagtctctgctgccatatccagcctcaactcacactgctcctaaatcttactcctatgtttagcctttttattgttttcaatttcttaaatacaggcttttatgtcacttatggacatttggatattgtaatgatattatagtctattttagaagttttttttcaaatatggcaattatgttactatattagagtcttgaaaataatagagttggccaggcgcggtggctcacgcctgtaatccctgcactttggaaggtccaggcgggcggatcacgaggtcaggaattcaagaccagcctggtcaacatggtgaaagcccatctctactaaaactacaaaaattagctggacatggtggtgcatacctgtaaatccagctactcaggaggctgaggcagaagaattacttgaaccgggatctgggaggcggaggttgcagtgaatcagatcgcactgctgcactccagcctgggctacagagcaagactccatctcaaaataataataattattagaattatagagttacattatactattcaagaaaatggagtagaatcaaagagcattttactgtcatatccctagccatatgcctgttttcgagaaaacatttttatatttttctagcctttcacattattataaaacgtgtacaaaagaaaaaaactgcatataaatgtctttccattgatctactgatattaataaatatttcaacagtttaaaataaatctgatttctgaatataattttcccccgtatagagaaaaataagtgaagtaaaaaataaagaagcaacatagctctctcacttcctagctgtctgatcttgggcaaattaaaagctctttaagcttcaagttttccatgtataagatcagacaataaaagggttgtgaaatgaacactccgtggatgaaatttcaaattaagtaagttgattaggtttctagcttccacacatgatacagatgttactctgtcctcataagaaagattgaaggcagaatgacagacgggacccaagaaagccattcccatgatgcatgcctggggaagcagaacatcagtttctgaggaaagacacaaaagtccatgcagattgtattctatattacttatggaaaaaaataaaagtcgcatcctgtggaaaaggaggagctaatgatgttgctgtaggagagaatggaaataaataatgataaatggggcaattactcaaaaaagcataacgatgtgaaatgtccatacacctaaaagtacaggtctaaaatatatgaagcaaaactggtgaactgtaaagagaaatagacaagtttgcaaaatttatatctcagtttttcatagaattgatagataaagtacaggacatattagtaagtacaaagaagtaaacagcactgtcaaccaacgtgatttacccaacatcctgaaatgctctgtagaaaagagattatatattattttccagtgcccatgtgttattcacccaggtggatcatattcccggtgacacagaaaaacaagctcaaaatactgaaatctgataaaactgtattattgggacataattaaatagcattcagtaacagaaagatatttgaaaaaaaacaaaccaactatttagaaattaagaacatacatctaaataaccagtggatcaaagagaaagtcaaaagagattctgtaaaatatatgccaatgaaaaaatttttttaccaatatttgtacgatgaagctaaaataatgcttaaagaaaatgtataaaattcagtgtctttgttagaagatacagatgtccaaaaatcatctgtgataagagaagggcaaattacatgtaaagctaacatcagtaaataaaatatacattaaaaacttgaaaaaaatgaaaatatagataaaaaattgaaaagaaaaccagaagtgaaaaatcaatctgtaatgaagatagttatttgaaaatatcaataaaatttatagacttctagttagactgacaaaaaatacaaaaagaaaaaaagagaaaagaaaaggctattaaaggaatattaaaaggctattaaataaatactttaacaaaactctctgtcgttaaatttgaccaattagattaattggaaacattttttaagtaaataaactaccaaaaattttccaagaagaaatagagtgagtaactttatatctgttaaaaaaattgcatttgttgttaaaaaatatagccaaagaaatctcaatattcatggagcttcttgcataattatactaaatacttagtgaagaagttatatcaatcctacacaatcagttctccaataaagaatgaagggaccaccttcaaaatcactcacttttatgacagcataattaatacacctctgaaactcaatatggatattacattaaaagaaaactatagataattatttctcatgaacatagatgcaaccaactttaacaaattattggtaaatcaaatccagggacatatgaaattgataatatatcttgaccaattttgttttatctggttattaaacattgattcaaaattggaaaatcatccaatgtaactcaccatatcagcacactaaaggaaaaaaaaagataatcttaatagatgtagtaaaagcacttgacaaaatctaacatccaattatgatatagaactttcagaaaaccaaaaacagaggaacatgttttcagtctgagaaagtatatcttagacaaacaaatcaaaaactgtagctcacacacagttctacataatgtttctacatattgctgaaaaactgggttttctctctctaagtttggaaaaaaccaaggatatcaactatcacaattcctgcatagtatcatacaggaggtcctaacaaatgcaataaagccagtaaagaaataaaagacatacagactggaaaggcaaaatatataattatatctatttgcaaacatcaaaatcgtttggatagaaattagtgaagaaccaacaaaatgctaacaaaactaataaatgagttaaacaagttttcagaattcaaggttaatatgaaatgttaacatttttattctactaatgaacaattagaaactgatcctagaaaaaagtactatttacagtcgtagtattaatcatgaaatgcttaagtttaaatctcctaaaatacatgtaatatatgtatcctgaaaatgataaaactataaaacattgattaaatataggaattaagtcgatgaacaaatatagtgtatttatagcttgtgattctatattattaagatcttagttgtgttcatatggacctataaatttaagcaatcccaataaaaattccaaagaacatttgaaggaattgacaatatttacatgaaaagtcaatgaagccagtagagacaaaacagttttgaaaagtaagaacaaagctagacgactcttgatagttgacttcaaatctgtagtaatcaagacagtattttattgaataaaaaagaggcatataaaacaatgctaaataatagaatgtcctaaaatacatacgtgtggtaattcgatttcttttcgaaagccaaagacaattaaatagaaaaggggtatctctttgataatttatgctagagatagtagatatccttatgtgtagtggttatcaaatatatatctagtaatccttttatacttcctcctccctccttcaaatgggaggctaactcatctatccttgaatgttgtctgcacttagtaattcactttcatcaagtcaaatgctgtggaaatgaaggtatgtgtcatctgttactacattatactaggcattgctgctttctcatcgatctgtctcttggatcatttggtctgggagattcccttaacatgttgtgaggacactaaaacagccttacgaagatttccatgtggcagaattgagaccacattgcaacatcaatgtgggtgcttagaaatggacccctctcctctcaggcatttcatgaatgtagcctgggaacatcttgattacaacctcatgagaaacctgagctagagctaccctgctatcaagttccaaattcctaacccacagaaattgtgaaataatgtatgtttgctcttctaagctacctagttttgggggtagccttttacgcagcaagtgataactaaattcagtatgcaaaacaaacaaaaacaaacatggtttacaactctccaataaagttaaatactgtataaacttaaccatttgatcctgcagttccttctccaggtatttgcttaaataaagcaaaagctgttgttcatacaaaacctgtaagcaaatgtttatagtggctttattcataatcgcaaaaaactggaaagagctgaaatgtccctcaactggagaagggataaatgtagtattataatcttagcagtaaaaaggaatgaactatagacaaatgaaacaatgactgagttccaagtacatcatgctaagtaaaataagacagactcaaaacactacatattatattatttcactcacatgtcatcataggatatgcaaaaatgtttagttttgtaacctatacattatctataaattaaaaatgaaatcaaaatcaaatgattaactaatgtcctaatcatcacagacatttgataaagatgaaattttactatcactaactaaaaaatagttatattaacagatcaactttagtttcgtcaatccattttcataatatttcacgaagtagacaaatctctaaaaagtgtttttgcaaataatccagaaattgcctttttatttatctttctcttccaatttttagcatttcaaagacttccttttgcatctgggagaaaaactgtggctcatcaaagaattagggtcacatcagatacatgttggcttaggatatttttaatcctactttaggtttttttctaactgttagtcattaatttacagtacaaataaaaattagtcatttatgaggttcaaagcaatgaataaagcagtgaaagtgccagtgcttgtgagtttgttaatgtttatacttgacacttcatttatttttttctgggcattcatttaaagtcattttaattattacctgtttagaataagatgcaaaaatatcttcacatagcctatagaataaaggaagaagtagaaaaataaaccatatcatattatgttttgtattacagtacactatagtatggtgtactataatatattataccatactgtaatagaatagaatatattagattagaatacaatcaaatatagtatactgtggtatattatattacactatattacattataccacagtacctcagggtatactatattacattctattctaatatatatatataacatagtatagtatactatattatactatattagattatattttatcataaaataatacattatattattaataatatactatatatagcatatattacaccattctatataataaaatactatattatgtatatagtatactatataacactatagtatactatattataaacaaaattatgatagtgtatggatgtctttttatggaaatatgcaaaagaatatgagagcactatgtagatagatgccacgatgcattcagttacagaaataaatctgtttttattactttcagttgtttgcttctttataataatttcaataaatggtttatacactttctaatgtaattgcagatttaattgattaaaataggctaagactttgtcactgaaaataatgtcaaaatcacattagcatcactagagctagttaaatcaagttattgtaaaatataaacatgcttgatagatctaagttccattaccaacttaattagctagaatttcattctgtagtagaaatgtctttaactttccatccgatagtaaataattctacgtgcattcaatagaagaaatttcacgagaagtgattgtagttttgatgctggtgaatgattagaaatttattttgttatgatgtaatgtatggaattaaaaggataatgagattatagtcaaccattgaaaatgtcttgggaaaaaggccagtaggtatgccacagagatgccacatgtgacagccaggaagtacaatgatagcacatttctgttggtgaagaaaggtaacagcttagcgtgtgaatgcgtatttatcacttaatgaaactctctcacctatttctatgaaaatcaatcttggaagggaggttaaggaaaatagaactataaagagaaggttttggagatgtttagccaaatactcttatctgatgaactggctgggctacagaaaacttgattccatgtacagaaaataaagctttagtctaaaaaaaaaactttaatatttcttgatgactgtctatagacatagcatttatgtctagatatacattatgaaaattctcttgtcatcagaattaataattgtgttccattatgggctgaattgtgtcaccgcaacatttatatagggaagtccttactccatagtacctcagaatgtgactgtatttggaaatagggtctttcaagagataattaagttaaattgtggttctacgcaagagcactaatccaatatgacgggtgtccttttagtgggagattaagacacaagacaacacacaaactgaggggaaaccatatgtgaacacaggaaagaagacagccatcttcaaggcaaaaaagagtcctcaggagaaactgtatcagcagacaccttgatcatggacttctgggcttcaaaattgtgagaaataattttttgttgtttaaaccacctaatatgttgtcttttgttatggtagcccaagaaaactaagacatattctcattcctccttccttccagatgcctgtgccagtttctacctcatccccacaaacaaagttataaagcaagaccagataagattttttagaataaaaaattcactgcttcccttctctgcctgaaaacgtcaaggttattgaataaataaaaattatctagcatgatatatacaacgtttcagaaattaattcaaatctctttttctaagcctttatatgctgcttaccattcccaaaatatgtcttgctcttaattttttctgcttccccacctttgcagatgttaagcaatcccttagaatgttcttttcttcctttcctagctcacaatttttaatccagttccaagtcctcttacaaacatctcgtttttcaaaattatttgactatctccagtcagaaatatatttctctatatatttcgcagaattgtgtacctattcattcattctccaatatttgttgaatactaattgaatgccaggcaggctactaggaaaggggaaaaaacattaaaccacttggagtttcatgaaccttacattctattgaaagataggtattaaatgaaaatgtatacatatctctacaattaggatagcacatgtattgcctaatttatgcatcaatctttagcttatgcacaattcatttgtatctattcatatgaataaattataagtactgaataaattaatacacaaacaaggatgatattgtttataggtggactcagaggcttcctacatcccatgatgccaaaccccttatttacccaaaacgctaaacatctgcttgattataattgttaatctattacaaggaaaacacagttcataaacaatatagagaagaaaatgcaaattgcaaatataatgtagtttttgacatatccatgctaagatgtgagataccagattcttttttgaaaatctagataattgtagattcacatgcaattgcaaaaggggtgcgggaaggggagggttaaagacaagatgattaatgggcacacatatactcttaaataaatgaagttaagacctagtgttacacagatcagtagggtaactatagtttgcaataatctgttgtatatattaaaatagctaaaagagaagaattcaaatggttctagcataaagaaaaaacaaatatttaagatgatggatatctgaagtacactgatgtgatctttacaaattattggactgttttaaatttatcacatataccctgaaactgcatacatctgttaatattatacgtcaataaaatataaataaataaataatatcgacagatccttggtaaaatttacccatttttcctgacactagcattttgtaaaactacagtataatatcacaattggaatattaacatttatgcaatatatccactcagatatatccagttttacttttattcagttgtatgcatttgtgggtgcatgcaaattctatgtgcagtgttatcatccgcgtaggttctaacatgacagtcaagatacttaccagtttcaatacccaagaatcccttatgtgaactatttatctactcccctcagattcttttgagatacatgttatttattatgtattatatttttattgtttgtacatgtaggaaccacatagtatcccaagaagagaaacaattcaattagtaagaaggtaagtacagaaaggaaagaaaaggggcaggggtctcattatttattttgagtcactgtcataatctggttaaactaattctaggcacttatttttgtccagggatttcgctaagcacaagaaagtttataaagataagtaagtaacaatttaattttttccccctcaattgtgagaggtaatcagtctgaacaagataagcactgtgagatctacaatatgcaatccttggatcatgcaatggcaaggaaaaggagtggtgccatccatgttaaactatttgttgtttagcttttcatgcatacacagtacacacttgtacataaacacattttacatactattgtccactcacaaataattcacatattacagaatatctgaatgtacttttatctgaagactttctcttaattcctaggcttttcagcattttatgacttataaccatttccagctacttataatgtaatatttgataagtactactgactgcccctctttggattctcatagatttgtctctcctcttcaataacagtttccaatgtggggagaggaggatttgtgtggcaggctttttgatagcttgtttatctgagtatttttgttaagatttcataattgaatgacaatttacctagatacaagattctatgttctcagtgctttgtatacaatatgttaaaaatgtgatttcagacctttttgcctttaagttttccaaatgcaggtaaagcctgaaacttcagcagccattttgatgtcatgagggtaatcagcctaaaagggaatgccagcatgccaaggatggtgagcacaattttacatagaaactgagtctttgattatgttggtgaggtgctgaaataatcaactttgggaagaaaaaatgtgtattttattgctaactttcatgcaatgttgctggtggaaaatctgttatgcctttgtataatacataattttaaaaattagaacatcttctttctttgtaataaataattaataaaataattaaatttcttgttaattactgtattgttcagtcaaaattcattcccttctagtagattaacccaggatgagttccacagagctcaaatttggctactggggttcagtaacatctttagatatctagggttagtaagaatctctaagaaaatcagactattgatattggcaacacagcctcttctcaaaatgtctactgtcttcaatgatactacaacacccctctctttaaaagttaacttgattgtgtggcaggtcttggaaatgggaaggatgtgaacaagactccgagaagagtagtggaggagaaagagacaagccgacacaccacaacatttatgtgacataaaatctcgagttctgaaatattttgatttctgtatccccagtggacagagcatgccactacctagcacagaatacatatgtagatattgaataaataagttatccctataaatagtggaatcaactgtttcattagacagaggctcatatgatgatggtctacaagaagtgtctacatctaagttttaaaattcaacattcaatatacttagtacatttaagttatttgttgaaaatgtgcaacagttttttaaaaacattatttttcagtatagtttagtagatccatacctattcttttttggattccaagaatgagagaaatgtagcaagtttggcgttgcttttcaactgccacagtcacaaaatagcttcctattagtgaagaattttgttttctgcctttttactgtgtagaatgctttccaagtagaatataaacctaattcattcatattgtgctaagtatgtttgtatcattaaatttttgaagaaaaacatcaagccgtcagcttcatggaggtctaattagtgtgcagaactgccttgactacattcttaaaagatgtaagtaaaactataaaaacatctttcttggtgttgaggttttaaatgaattaattaagtttattccaattaggtcatttttctttcaagaaataatatcactttcaacattttctaatgtttcatatgtaaaatgagtaatctaaacttggagtctctacgtcctcagcttgcatacattctgttcttcacctgttaaaatatagacaaattctttaatgaagttcgtctctatcagttcacaaattgtctcttacttggtcagtacattaacaacttttaggcctcctacatcactattttattgcattggctgttgtaaaatatgttctcaaatttttcttttgctctaaaccccctgaatgtactgtgtaattccttggctgattttaaattgacatttaaaattacatttaaaaatgtatattttagatatttgccaagtatataatttcaaaaatgataaaaaatattctttaaggataaaaatatttatttttatataaatgaatggaatctaaaagctatagtgatttaatacctgtcatcaaaaattcatcgtatattaatgttctctttttcactactcataaatcgcatgctgttttattttcattttgttttcacatattcttttgacttctctgatagaattgatcattatataatctatttaattgtttgaaaacattgtatctatcaacctgtttagcattctgttatagaattctgtacatgtattagaatataagtttttccagggaacatacatttttaatattagaaaatctctttcgttgttattaaacatgagttatcatttatatggtaattaatacaaaatcaaataatataagcaagtgactgttttgtatgaataattattaactacaaatactaaaatattaattaaaatgtatctgttaatattattccatggagaaatattatcagctttttcaaataattaaattgtcaaataggtgaatttatgcaggaaggtgattttagttttctcttagtgatgaaaactatcaggcaaataattataattattatttttcccagtcatattcctgaaatgcttctgtcaattcaataccctttaataaaagactcagctaatatcattttaaatcctctctgttagaaacaaggaatttggaagaatattcagtatttcaagatacctaaaataatagctaccactttctgagtgcttagtatgtgtgaatcacattttttgtggaatattttatctattcttattataatcctatgaaataagatcataccaatattatgtattaaagaagtaaggatcacatattagagatgttaaataaattttcaaaaatgttacacctataatagggaatattaaatttaaaaagtagtggtattttgtactgttcattgaaatatagttaaacaatttatctcctttgattgaactcatatggtggcatttggtacaaagccaaagtgttcacatgctttgtgccctatcatttttcaaattgagataatatatgcatatatagtatttttttttttttgagacggagtcttgctttgtcacccaggctggagtacagtggaacgatctcggctcactgcaacctctgcctccccggttcaagtgattctctcaccttagcctcctgggtagctggaattacaggtgcccaccaccacgcccaggtaatttttgtatttttagtagggatggggtttcaccatgttggccaggctggtcttgaactcctgacctcaggtgatctgcccacctcggcctcccaaagtgctgggattacaggcatgagccaccgcacctggcctcatatataaattttaataaaatatagaaaagttgtagaatgttttagtgtctgtagtgatgtggatccttaatgcgaacacatgagaaaaataataaattcaaactattttcttaatacatgagatacttatgtttcattttgtatttttgtaattgttcataacttggcaaataaaactgtagtaaaatagaatgcaaatttacactgatattttgttatgatgacataaatattcccatatgcttttggatatgaaattggttatgaaacacaaatagagtatttcactgtagtcaaagctagtgaaagttacagaaaaagtaagaggaggccaggcgcggtggctcatgcctgtagtcccagcactttgggaggctgaggcgggcggatcacgaggtcaggagtttgagaccagcttgaccaacatggtgaaaccccatctctactaaaagttcaaaaattagccgggcgtggtggcgcaagcctgtagtcccagctacccgggaggctgaggcaggagaatcgcttgaccttgggaggcagagcttgcaataagcggtgatcgcaccactgcactccagcctgggcgacagagtgagactctgtctcaaaaaaaaaagaaaagtaagaggaaaggaatttgcatttaaatagggtatggctgagacataggtaggatgcaaaaatagccatttatatgtatttagtgagcttctataatttgtccagcactaagttatgttctagggctatgtctataaatgaagattgacactgaaacagatacagaagcgatcacatccttttggtgcttaaattactttgcagtgaacctctgggtttttttcctcaccaacacaatctctttccctccacccttgttttcctgacttatctaacccctccccctttttgtgaaattggctcttgtacggccatgtgttatacacaagcataagaccaagccagattatgtatctgggcagctttgatcttaaaccaagtcatataggaatacaagtcatttgaagtttaattatcagatttcagaaacttagagttagtttcttcatttctgcagttgagattctgttaaaaagagtgaggaagaccctaattgtttgaagaaagtcaatcttaaggaggaaagaatttgcttaaatatttagggaagcaagcgatggaggaatgaagagttgggaaaatggtgttgtgtatgcgtgtgtgtgtgtggtgagtgtgtttacttgagcattctgcatataaccatccatattagtgttgttcatggacttgatactgacatgaatcagtaaagtaccctttctaatttaactgccttgacttaggtgtttccggcatttacaaactaaagagttctgattaatacataaacatgtaattgattattatcatactatatgctataaagaaaaattcaagcttattattactgtataaactctacagaagaatatacaataatatattactcaaaagaaaaagcagactttttaatctctgcatatttctgtttttttctctcttcacacactactcaatagaacactctgacaaacttccagatatgtggggggttttgcttacaaactaagaaattattcagtggacaccagctgggtcttctctaattcaattcaattctgacactatctgtggagttgcaatgtgtcccacccagtacatggatgtgtttcccctatccagaggctctctgaaccccatagttcagaaatttttatggagtcttcatcatgtaggcatgattgattattaactcaattttcagctattctcccctctttgcagagtgagatgtgaggtagaaagctccaagattctaattattgcttggtctttctgctgaacagcccccagccaggagctcaccaagagccatctcattagaaggaaagatgctcatatgagtcaggaaattacaaagactttagaagctctgtgtcaggaactgaggtcagaccagatactagaagagaagactttatttcgcaattagtaagaagtatcttggaagaagcagaaaagatacatatgaggaagtcaatttattcttagacccaaattacagtaaccagtgatcaactgtgtataagagggaactaaatatttcccaaaaagcccacgtgaaaatttaaacattaaaaaagaaagagagacagaaagaaagaaagaaaaagaaagggagggagggaggaaggaagggaaagaaaaaaatttctttaacattctaagcaggccaaactgaacaaaggttcagaagcattaattaccttatttctactttacctttttatctggtaagaatagcaaatacagtgcctgtgaagtgggtaattgatatcattaataacaacgtttaggccaatagagcatcaggaacaatttttgatactgaatggattgcctagtcaggtgaaaataactacttgaaaatccaatttccagaatacttaatctataaacagcctaagctagaggagccagagaataaaattaagattccagcaataaagaaaactaagctaaaatagcaatcgtgtatctcaacactgaggcgagaggaacctgagggcaactctgctgtaatctgtcaccaagaggtagaagcccactatgagatgttgccttctctttctacttccacagcaacttcttcctctgcgtgtcctccttccttttctttcctcaaggaccctgttgccacactcaaccttgccaaacagagttggtgtggattttgttttcagactgaaaacttttggaaattattcaagcctgcaattactaggccatgagtgaaataaattatgtatgtttaatttattaaatgacaacttttccctgtcttttgttctatttttatcatttttctcctcatacatcactgtcctcagaatgaaatactttatgaaactgaaagttggctcataactagaactctatatttttgacaattcttagttgaaaaatattacttttacagatcaatgtccaatgacctagctcataagtgttttttcctaaagctgaaaagaaaaatcagtacttatatccctttggatttcttagtacaggcactgacagctgagttagtgtaaagcacgtggttataaattgcaagtaggcatttacagccatcaaaatctcactgttaataaccccattgatcaacaactaagccaccctcttatggataccaggagtaaagcaaccagactactgaccagtgaaacgacagaaaaataccatcagtaggccacattgacttgttactatgtaatctggtttaccttatataaaaaaaagagattttctcttgtctgaatatatgcatcctgtatccctgtccatggagtaactgtcaaacttctttacattgagtctaatggactaaattagaacatttgctttgtttctaaattccacatctattttttttttaccaagatatgttttcatcaacaaaattatgttctttcttatgctatgtgctgtaaataggtctatgtccccaaacacatacagatttaaatgaaaatcaatagaaccacatatttgtgcctattaaaagcacagcttgtgttgacttaaatcacttatctattgatggcaattgttgcacaagacataactgaaaggagacacctcactatcagagaaaagcaaaatatgttatctttacctgcaggaaaattacctactaagctcctcatactcaggagaccacaatttcaccataacatatatcttaatcaagacctgggagttatatcaaagatcatcaaatgtacagctcctataaaacatcttgatcacaaaagtagtagactagaaagaaattccatttcagagagtgaaaaccctactagcttctggcatggaactcacagacatcatgttgctttggtttctatactctggtgtttaataaaaatgtccccttaattcagtgaactttactaagtataaaagagatgtggggaaataagaaatgccctcaatacatcatttgtgataaagtaccattctttagttatagtttccttgtctatgaaacttaaatattgatcataacttttaggtttctcctctatggggcattccattaatacataattacactgcaaattctaaggacattttctgtaaaatgacatggctgatgctgtggtttagtgtactccattgaattattttgcctgagtattatggaaaaatttatctaaactaggtctttattgcttctcacttttaacaatgctctgttggatataatagtcagaagaaagaaattgaatcattaagaataactttaatgttgtatttttgactttgtttaaccttggagcagataatactcttttaaaaatagcaataataatgcttcacagtgagtaactacagatcatattaaataaggtactcaagtgtcttcgtccatttgtgttgacagtaaaggaatagctgaggctggataatttacaaagaaaagaagattatttggttcacaattctgcagactgtacaagaagcatggtatgaacatttgcttctggtaagagcctcaggctgcttccactcatggcagaaggggatggggatccatcatatgcagaaatgacatgatgacagagaaagcaagagcagaagggaggtgccaggatcttttaaataaactctttagggaactaataaagtgagaaatcgcccattactgtgaggacaacagcaagccattcatgagggatccacccccatgactcaaatacctcccattaggccccacctccaacattgaggatcaaatatcagcatgagttttagggggacaaagatccaaactacagcaccaagtttatgccaaagatgtgttaaaattaaacacttctcactaatttagctcaatttttacacttttgggttcacactgaataataaattgtaatcagttctatgtgagggtgaagaaattctccctttgcattgattgcctgtaataaacaagaaaacctcatgtcttttgtttggttaaacatacataatcctcaaagatgatctgtaatgtggctcagtttttgacatgaggatctaaaactttttctgcataagtgtttaaaagattacaatttgaaggtgtcttctaaatattatctcctttaaccattgttacctttgtcagtggagtgcatgtttacttggttgagaagaataaacaatagtttacctattttcatgttttctttcttttcatatagcaaaataggtatatttgtgggctgtgaaaggtctagatctgtgatgtattatttaaaagcataaattttcattcaaactgagtatgtgaggatcctggccccatccaccttttggcaacccctctgaatttcagtaatttataaaatggggcccataatagtacattctatctagggcttacttttatgattgaaggcattaatgttgataaaaaacttaatatctgacacaaaataaatttttctgatagctattatatatggcaatgcaatagaagtttgaaacaaaccatgaaagacatatatttgtgtttgtcattgattaattgaaacaataaaaaactcaatttaaaataattaaatgacaatagatatgtaaactggtcttttataaatctgttattttgtttctcttctattggacaacgtgctattctgagtgaacccaagttaataggcagaattgcatttctaatgttttttgacaaaaatgttcttgtaatttaggctttaaggaaaggaggaatttgtaatcccagcactttgggaggctgaggcgggtagatcacgaggtcaggagatggagaccatcctggctaacatggtgaaaccacgtctctactaaaaatacaaaaaattagccaggcgtggttgcgggcgcctgtagtcccagctctgccggaggctgagtcaggagaatggcctccaggagaatggcaggcgggaacctgggaggcgagacttgtagtgagccaagatgacgccactgcactccagcctgggtgacagagcgagactccagctcaagaaaaacaaaaaaaaaaaaaggaagaatttatgttcttttaaaaaaacatatttatggaatttttacctgaaaatctgatggttgtgaggtgaactgaattatctactaaactcttagagcaggccatcactgacaggcctggcagcatgacagaatgacaaaagactcggagctatgagaacatcagaaggcatggacagtgatagcctaactggaagcactgtcaacagtggcctctatgagactctctcaagcagcttgccacatagagggatgtgacaaggattagatgaagcagaggggagaataaaagagacgaaagacactgactaataactaccccaacagccacacacagtttgtgagcaatatgaatgccttgggaactgcctcaaatcactggagactctagaaagaaaactcctgcagaagggttggctgttcctaaaatcttgtttgaattcacagacctaacacatctgcctacatctttgcaaaggatatcagaaatgtgaaagaaaaattttacagtctggcagaggcaaatggcaaattctcttgctgatgctatgaattacaattttgttggctactgaattttcaggaataaagaatatttgttttgtccattgataatttaaagtcatgtcttagcaaattttttataaattccttgaactcagcaaatgatacttatgctttattaatgtgcattattaatccatattttaaaaattataaaatgtcataaaacataagccactcattcacagatgaattttaaaaaatgattttaaaataattttaaatgctctcatattattaatatttctgtgcaatttgattttactttagggttacagataccttctgaaaaaagaggtataaatttaatattcctttttagtaactacatggtatttcatagtgttgttaccttaaaggattaaattgagcatttcccaatttgtggatattttggctcttcctaatattttagtcacaatgagcattggcaaaataactattctggtgttatgtttttatgaactagaactttccgctattcctttcccggaaaaagaattgctggatcaaagaatagatgaatgttaaatattaataaattttccttcctttgaggctttttgacatttattgatttgtaggagttgtttatttactatggatattttatcttttgggattcttagttacaagacacacaagttgagtcaggctgagttttaaaaaatattatagaatactggatttctcaacagatacttgggagtgctaagcagtgagggaaaaattgctccaaatcatttcacagaattataactggtaggaaactactggaaaaaaaaaaaggtaaccttgtacatgacgtaactagctttgtagttgaagtttgaaatttggtttgggtatatccaactgaaaagcttacattccgtgctttggtcactgttacaagagatgctgaaaaacaagtgaagaacaatttccagttctgacagttcctaaaatgggagcacagcatgtagataggtgggaaagaactttccaggcaggaacaaccagcactgaatgaccttgaagagacggcatgcctagcatgtttgtgatacagcaagctggaatcggcaatggggagggtaaccagaggactaggaatggtataaagatcggtgaaaacaggacttagtagaacctggtaagtaatttgaattttttctttgtgaggtatagaaacactggatcactttgagcaaagaaatgaaactcactccattacaaaatgtttattctgactcttgtgttgaaaatagagtaaaggtgacaagacagaaggcagagaaactggcagatgagtcagaagattggtgaagcaagtgagagatacagcgtggaccagagtagcacctgtggacttggttataagttgggggactggagttatgattggaaggtagagccaatgttattcctaataaattaaatgtgtgtgtgagggaagaaatatgagttaaaaataacttcaaagtttctgctgagctaatggaaagttacagttgccatcatggggataggtggatcaggtttaggtgtaaataagtaggaagaagctaggaattcaggttctgggactttttaaaatttcgacatgtatattgaatattcaagtggaatacaaataggagttggaaagtcaggaaagtgttctgagatggagatataaatatgtgagttactggcttttcaagagtgtttagagcatggtaacgagtgaggtcatcaaaagcagtagcatgaatacacaagagatgtctaaggcctgacacctggaatactccaatgtaaagagcttggggagaagcagagaaactaacaaaggagattgagatggtgttgcaaataaaaccgaagaaaaatcaaaagccatgtgatacccagctctaggaagcacaaatggcaattttgtgcaaatcaaaaatgtgtcctttcctcatggcacagtactgccatctactggaatatgtttccaaaaactgtattaagattataatgcccccaaggtaaatgtccttcagtgcttagctgtaagcagtagagaaagtgtatcaagggggaggaagtatatcaaatgtttctgatctgtttaaggcttatgagtattgaaaaacgattaatggatttagcaacattaagtatgtgttgaccttgacaaatgccggtttgaagtcatgaaaatgaaagtttagttactgttgagttaaaaaaaaactgtacacattattattttcattttcttttaaacccacagtaactgaacttccattttcatgacttcaaaatgacatttgttacggacaccaaatctgtacaagaaatccccatgacacaagtttacctatataacaaactgcacgtgtccctgaacttaaaataaaagttaaaaaaaagaaataaccatagatagtgacaatggaccattctatcaagaaattttgttggaagaagaggcagagaaataggttagtctgtagttgacatggaagttgcttcaagggagtagggtggaaaaattggtcatgaaggagaaataaggaaaaattaagaccacaacactccgtagtagacgagagagaataagatctaaggcactaatgaaggaattgtctgtagagacagggaaatatatagttcgtgcataggaggtggtgaaaaacagaggctctagaaggagggtacatatggtaattagagtctgtagacactttcttcttttcacagtatagtaagaagcaaggtcagcaaaagcaagtgaggatgaaaaaggagatttgagagctctctggctagcatcttctcacttttattattgctatgggaactaggagaatctcaaaagtatttacatacttcttggagacacatttttcctgatgaatatttaatagcaccagcctaaacaaatattatttagtagaacatgcttgtttttagtcatcttctttcctcacagtgttatctgttctactcatgtattgatgagtgtccatttcatctgaatattacccaacaagtttgcatccttctctgaccttggacattggcatgtgttcctaaccttgtttccttctccatcaatgatacacattattatttaatttccaaactctgtcaaataaatgtgtgacaatatattcatgtgataaaaataatcactgataatttgcaatacatttgtagaagtgtgacttataccttatttgtgtgctgacatctagtgcagatctcagagtcaggccaactctccattgtcctcacaatcctacttgtcttagtctgttttctgacagactattttggattgggtaacgtatattgaaaatacatttatttctaacagttatgggggctgagcattccaaggttaagcgctgcatcttgtgagtgccttcttgctgatgagaactctgtacagacttctgagccagcacagggcatcacgtggtgagaatggcgcatatgataacatgctgtgctcaagtctatctccctcttctggtaaaaacaccagtttcattcccatgataaccaattaattaattatttaaatacacgaaactatgaatgggctaatcctttcatgagggcggagccctcttaaaggcctcatgtctcaatactgccacattagggattaagtttcaaagtgagttttggaggggagcaaccatagcacttcacttccccattttctgaccaaggccttcagactacagagtagctatttaattctatgtttttgacattgtcccatgcctgcctcacttttagtccaagaggtatagttttcatggtttcaaacaatgctaacagtcccaactgtcttttctttataagatcaatatggaaaatttgatgaaataaatgaaaaaaactgtatatatactaaacttctatgagctagttaatacagaatttcttgtgtccattgttgatggggatgacttaaatttcagttgagttcctacctaatttcaacttttattcttgaatggggatttccccattttgattactgttatattcaagaaaccaatcacaagaaatatttaaggataataatggctattttcttgcccaaagtggatattttgcatctccaagtttccaaattattgctcttaccaacttgttgcctgtaatcatattattcatattgatagtgagaatctttatctcattccctgcctttaaagataacttttattataaattttattactgtttacaggataggatgttactttaattcttagttttcaatgagcttttattaaaacgaagtattgaacttttgcttatctattacattagccatatatttttctactttagttaactactttggtgcattgaaaaaatagattttataatgcatagccatcttcacagtcctgaaataaactgataattatgtcataattttattaatataccctgggtttgggctaaccactgattcatttagtagcattaacattttcctctgcctcacttttagttcaagataaaattggcctatggtattatgtttctactttctttgttcaataatgttacaaatgttaccctaacctcataaaacatataacagaaattttagtatcatcaactggtgagagaatttttgttttctatttcctcttacacattctttccaagatatctggtttctctgcaaggctagtttagaatgttacacttcttacacaattctagctctatataggccataattacataaataacagaggatgaaaatcacttcaaaggatgaaacatagaaattgatgtagtgaagctttaggctgtccaggataatattttctaattaaaatgttgcaaatctggccaactgaattatgttcactttgaacacttataataagggcttacttttggtttgagtaaatacaaataaatcgcttaagaaaatatggcattattccccctcagggtgcattcaaactggaataaaaaattattacaagaagaagatgaagtcaccaaaagagctgagaattgttaaaataaagaatgtcaggtagaatactcataaggctgaactggtaacataattaggtacttgctaaaaacttatcaaggtacaacctgggcaataacaccttctagaatggcaaccagactatacagagtgttaaaaagaagaatcttggtaaaaatgatactagcaattaaaaatgagaaaactaaggataaacatgaagggttctggaaacaattcaggaagagatatttgaaaggcatgtgctatgataaagtttaagtgacataaaattaatagcaatatcaggaagcaaaaaaaatagcagaaatggaaagatacagagcgaaaggggacactcacttgaatcacaagattatatgtttgagttcagtacactgaaatatttcatttttcaatatgaaagacatgtaatatagtgacctctaggcactcatttcaatatgcaagagccattaaaaaggcacttcaaggtgttagcaggatctactccactataaccatagattgcaggtttgccttcactctgaaaagagtttcctttgcagttttatgtgagaaaaatacaatatcaaaatgagtatattacgatacagaatctccctattaaccaaatgcaatgacccaaatatgaccccacaagaagtgaatctggtgcatataactaatgaggagggtgaaattgttcattctgtaaaactgatggtcagtcactgaagagaagaatttgggactgcacttcaggaaaaagaaccaaaacagtaacacaattctgcttctacataattgtgcggaccctcatgaatcacttgtggagaaaacaaaacaaaacctcttctcagaattctgtccactaatttctaagggaaaaaaaaaatgtggtagatagaaaacatgatactgctagagcacagacatgcagataacaaatgacaaatctttctctaaattaagatttttaaacactcattttgctatttgaatacaggaagatgactcctgttttctcatttgatatatttaatggagagttcacagataacaattatttccttggcttaaggtcaatgtattaaggtcatggtagaactggaaaataaagagaaaaatgctgaaagttttcatctttagtgtatttattatctatttaaaaaagtattttaaagacactgtttttacaccgttataatgaattcaaactacgtctcatgatcttttggaaaactgaaataatctcaaattatttcctgagtacaaaatgtcaatgtaatgggagtttaaaatgtgatgacccaattatttcaattaaattatacaatatttattagactataagttgcaaactgctatcacataactttatgaattgcagaagatagaagaggacgaaataatacataggagcataaaattatctcatcattctctctttgatagaaacagacagtatatgctcattataatattcgatgacttagctgccataattggttctatcttttcataatactgtttatcctattataaacctaaattccatttgatcaattgttggtctcagagtgaaggaatcagtcttgcatgtattaatcgaagcttatggtatgaagtacagcccaagataaattttacaagaaatatgactataagtaaaatagattctgacacttctatacaacacattaacacatctttgtcataagcatgattctagacaatactactttagaactttagttctctgtgtttgaaggttgggagatttttttttaattttttacaagaaaatctagtcatatcaaaaatctgccataagagaaagattttaagttttaaagaagtcagaactatagttaataatactgtatcatttacttgaaatttgctaagagggtagccttaagtgtaacactatgttatacttatgtacaagtgagtcttaaaactcatgattttacttgtagtaactttgatttgctctctttacaaccaagcttcttgaaagtaattttgactcccagttttcaattcctcatttaatattattttaagtcataacacattgcttcatttaaaactctcctattcatagtcctaattgttcttgtctctaccaggcacttgacatttatccaaccattcagttattaaacaaatatttattcagtgcttaccttctgcctattgctgggatctgtcctggaaatccaacagtggatgcttctatttttctgtctacctccataaatagctctgcttccgttggtctccagcaatgctgtccaatctcaaccagttagttatacaaaattattgtaaaactcatgtgccagcattataatcttttcaccacaaaagcagagcttattgacaataagagtaaaatgtttcagttcagaggcaagaattatacaagtgaacattttgaagtaatgacaatgtgtgactataacaaaatgtagagacttgtaaaggaaactacatgatgcctagttgctgaaacaccattcatagtggagaaatcaaagtcacgccatgtgtgttttacaaatcattaacacactcagaataaatgcttgaaaatatgaatagcttagagaggaaagagcttttctgtcctactacttacctatctgataactagtgagaaaatggctacttcaacctgtatacacattcagtgtaacatttctaaaacctatactttctctaatattaccaagccatgtcagatgaaaatacatgtaatttttgtagctattgttttgtgctaactttactgaatttgttcaatcaaccaacagtattacattatttattaatgcccttgtctcagagccaattaatcataaacattcccacagtttgaactgtctaacaatggaatggattctcatgtgttttctgcacacttgctccccagtgacattccatgagaagatccagaagagactcccttcactaaggcattaagaaacatatgggtgaggggagattttccatcactgaaagtactctgtttgctcacttctgtgggccagatatgaaccataaaggaggccacaattgagaagtgctcacagatttcagtaggaatgatgtgattccagaaaatcagatacaacattatagaccttaaccaccaaacaaaatgtgggtatatctacaatcaaggctggtagagttgtacaggtcatcagagtgctttgggccaagaaaactctggcagtggctaaatgattttgacatccttagaacaaaatacagacccttttagaatattgcttaattcatataacaagaaattcttcaggtctggagccaaaagcttgactccagtcaccactgtggagatatagcctttcacccagtttctatgttaattttcttactcagagccctttgattgaatagggtgcctggaggactctgcactattgacgcaccactcacagtaaatctttccccatgccttccccgaagagacttatggccttttttatagcatatccactctgtgaagcaattcaccgtgaatagcttttcctggcacctgaggagttcacctagacatatactcatcttcatggatttcagagtctggcactactggtcacatccttctttccagaatgctttcccatttgttattgttgctgttgtttgttgttttgagacagggcctcattctgtcccccaggctggagggcagtggcactgtctccactcactgcaacctccgcctcccaggctcaaatgattctcccacctcagcctcctgagtagctgggaccacaggcttgtgccactgtgcccagctaatttttacgtttttgtaaagataagattttgccatgttgcccaggctggacttaattagagggctcaagtggtctgcctgcctcagcctcccaaagggctgggattacagacatgagccaccgtgccctatctgtttttccatctggattcatggaatagcctctcctgattctacttctatatttttagctactttgtattattggagcaaaatataggcacagaaatggtcctaaattataagagtgtaggtcaatgagtttcccaaatagaacaacctcatataatcaccacattgatcaacaaacagggcagccccacacctcagatatcatcgttttgacctcttccagttagtgaccatctaggtttgtcgttaccttgacttctaacactatgaattagttttgtctgatttttgagcttaatataaatgtatcatacagtatgcgttcttgtatgtatggcttcttttgctcagcatgataatgtttggaagattgcttcaatgttatatatcattatagtacattaattttcatacctcttttgtatgagtaaacacaaattatttatccattctacttttgatgaatatttgagttgtttcccaaatattactctatcataatgaaaactgttatgaacattattgtacaagtctttgcagaacatatacatttcggttgcttgattcgctcattaaacattatttttaccagtgttctgaaattggtcctctttggttatcacacatcacttttgttactacttatttctttaaaacttctacaaatacatctgtctactgagaacttctgaacttttaacaggtacttccaatacctaatatttaattttttttcttctttaattttcctttctatattaccttcttagattaatgtatgcatgacacatggtagagttacttaaaatatcgcctttttcttctcatttggtaatgaaatgtgtcaattctactgaattaacaacccttatacttaaccatcttctgccgctgtcttagtttctgcctttatcttatttgaaagtgtttgtaaaactaattttatgacagcaatgctgatgtctagtgatttagagtagtt

SEQ ID NO: 60 - DNA, 9742 bp, Homo sapiens
acataacgtatttctagtagaaaaatgaattcccttgtctagatgcagtcagtcgtgagaaaaaaataaaaggaggaagatatctttagagatttcttattgcgccggtatttttcatttgccctggcaagtccaatctctattcttctcaaacttgctctgtgcacccaggaggctgaaatatacaatgtattatttccagggctcccttactgcctgatgtcagtggggttcagccaataaaaagcaggagcaagtgactggaggaagagagaagaacaagaactggaggaagagagaagggtttggtaagtagttacactcctggctccctcctgcttctaggaatgctggcattaactatttccttgaccaaaactcaaagatccagccaggcagctctgtcctcacaagcttctctgtctatggattttagtaaattatttacctctcccctataggactaggaatgataccagggtccctttattactaactgagaggttctagactattcttgtgtggcttccctgtggggtgcccaaatctttattccatgtttctcaagttaccacatcagttatcttttggaaacctgaatgcacacctaaaatatctagaaatttgagacctttgttttctggatctttttcaagaattagtttaggtgctgacttgataggaatttagcagagtattttttcaaaaatacacttaaaactacgtcaaactgttatttaattatgtaatatatttgttgctttatctaattagatttgcatttcttatatataccatgcatataaaaatatatttgatacaaattataatacaaggcatacaaaactagaccattataataacagaacattttctaaagagattttaaaagtgtaagtcaaatgccttaacgtaatactacttctaaagtgtattctaaagaaataatcttctatgtgtggttagatttaactacagaaatattcattgtaacctttctttagaagtgaatattgaaaactgaaataaatctaaatgtccaactttataattgctagttatggaatactaacaaatgaaatccatgcttttaaaatagcatttagtgacccaaatatatgttcaaaatacgtataaaagaaaaactggtatgttattaaagaagatagaataaaatttcttttccaaaatgtatgctaacaagacagttttgaaacttccgaaaacgaaaatgttgttaggtaatattttcactaaaattaaattttctgtttgctgagattataggtgtttctaacaaattttactgttgtttatgtatgctatagacactgaacatgtataatttatgtatcaaggaaaaaatcagtaagttcaattttttcaataaaaattaaaagtcacataatatatccgagaagataaagacgaattacactttatctgacaaaagagagtgcatggtttatggagagagacaattttttctctggttttagctctaagatataaaaggaatttattgtatacatctggaaataagaggtactgaatacctaaaatatattaagattaattactgttttagctttttttttaacagtatagaagtattgtgtgatgacttatcttatcaaccattgaaagagccattttcaaagactgattaaaatagaagacttccataaacaattttcaccgaagcattgaaaactattatctaagattaagaaaatacttttctagggatccctcatatctagggatctaattaccattagatccacctcatataatggaattaggacaacccaaagatctggatgattgaattgtcatttggggattattaccatcatacagctcagtttatggcaatttctatacatgtatttagtattaattgaaggaaactcataggaattagatgtcagacatgaggactacatacatatctttagagtgcttgtgtcctaaactgaaaagtgtattttaagagtctgggatatgaaaccaactttttctctattcttgtcaaatccatgtcattctagctactgacataatttgcacaatataagtacaaataataatgagcaaatttatgtgaaaatatgtttccagtgtacaggtagttttaaccattctttttacaagaaatgtgtgtgtgtgtgtaaatgtcttaattgttataatgattaagtcattcacagatgtgttaacaatgttttctccatgtagacagagtgataataatttgtattacattttagagttgtttgatgcaaataaataagaactcaaaatttttttgaggttaaacttcaagaagatgaaaggaaaactaaaatcacaaagtaaaatataattaaaacatttcaactaagaaaaaagtaaaaagttaggctgtctagacaatgtttgaagtttaagttggttaattgcaatggaaaaactgctaattaccacaaatagtaatttagagacataaatattatacaggtgtggctgcaggaagttgattttaatcaaacacatttggcgtttccaatgttgcaaaaattacaattgtaaacactgtccaattcaatcaaatgttatgtgaattttaagtgagtctcagtaaattatactgtataaaaacaggatttttactatggatcataattgctaatgtgtttcatactcgatgttgaaatataaatcaattcactctcttatttggtttggaaatttaagaagacaattcaaatttcccctgatacactctaccagtgtcactggactggtgatgtgacaagaaaggtcttctgtagaactgaactgcaataatatggagactgtaacaaaattacatatgtacctaagaatattgactttaaaagccttcttcagattgcagcattgatttctagatctgttgggaactggctgccttacttaatgtaacagtcttggcaatagaataatcatatttatcacccatggataattaatttttaatcattgaaattcactgaaatatgttgaatatgaaaactatacaaatataattttgtatgctacgataagtttcagattctttgaaattttattctaaccatcaatcataatggtatagtatgataaaggtagaacatgtaattataaattcaacatttaggaagtttatttttctcttctttttaattatctcaaaatgatcttgatttctgcaaagtattagtatatctggtaggtgagagtctatttcttttaaacttcatctgtattaaccagctttataccaccaaaatgtcccccaaatttaaaactttacacagtaaggccttatatgcacacctggcctcatttcaaaagactaaagcagtggttctcaaattcagctgcacattaatagaaactggaaaactgtttaagctcctgatacaaagccacatgtcagactaatttatgctgaatcactgggccaaggacccagacatcagtatttttaaaaactatggaggaataaccaggattaagaaccactgcacaaaatggtaaatgcaacttttatttaagttatttttttaaagaaataatggttgaattgatactgatcttagtaccaagtcacggcaattttttctgacttagagaattcatcctggcgttaagattattaaagaacctagaaattcaagtgtttttgtttacatttttcctgtaaatattagagtatgctagtgctcagccttatttgataattttggaaaatatattaaacatttgagattaaatatcaaaaatctctaaaataattttagaaataccattcttctatgaaataagtaagctcagtcaagatacatattatagtgcccatttaagaacgtctaataataatgtttgcactgcttaaagattaggttgataaattaattattgttgattctacttgcataatcaacagacacctagagatggagtcttaagtatagacacagaagttgaatacttttaagaacttttaaatttacgtcctggttaaatcttactctaaaattatgttgcatggttgtgattagtacatgtgtgattagaaccgtctttctcaggttattacaccaccatatagacacagcaaaaataataaaattaaaaataaagcaagaaaaataatgtaacactttattggctttgagataattattttgagatcctaatcctaccaaaacattctgcttttcttaatttgatcctacttttttttctttgctcgttttaataaaggatgaaccaatatcctgagaaattttcaaacagggctgagtataacactcagtccctagatctcactgtattttagaaaaattgtaaagtatttcaaataatgagtaaagtttcaactctgcaccattgtgtctttgtaatacagggaaagtcacttcacttctctccctctctcgtttttggcatatgcaaggcagagaaaataatatctactccagctatcccataggttattataaaatataataaaagatagaaaatcactttataatattcaaagtattaaaaaagtaaggcatgattatatgtgggattaacagcagtttgttatttaccatttaatgtattttaatgtacgtttttgccatatttaaaaattataatttttacattttgatttttaattgaaagagtaatagtatgacattatgccatgttatatctgatgccattatgtcaaacaaacaaacaaaagcattttaaactatttggaatatgataaaaataaatcttttaactatgataatacaggtttttgaggatttagtttgtacagcaaaaacagaggcaataaaggcaaaaatagataaacaggattacttaaaactataaagcttgtgcagagcaaaggaaacaggagggtggagggtggagagacaacctacaaactgggagaaaatatttgcaaaccttatatctcaatgtactagtgactatcaccctaataactagtcacgggagcattgtcatgcatttcgtattttttaattttcgagatgctgccacttaccatggcgggagcctgatccctgcggaatcgattgtggctggacttatcttgaatattctgagtcaacatacccaaccataaggtgctaattcattcatgcttgaagggcataacaatcaatacacgttcacgcacacaagtacgttcacgcacatacgtacgttcacgcacacgtacgttcacgcagatacgttcacgcataatttaaaggactacttctgattaaatccgaaaatccaccctccctccatctctgactttattgttaaattaggtaagaggtacccttgccgacccccagaaacaagatacttaaattgaacctagtcagaaccctaaaaatcataatttaaccatgaacactccaacactagcccctcgattaacgtaattttctaaaaaatcccaatattctccaaccaaataaaatctcctatttatatgttaactaaatttctgtcttaatacttatataatacttcaagcatccctctctgaaaagtgtgtatcccagatattatagtcctaaatcaaatataacttcaactacaaatgtcaccttagccaaaacctctgctaattcaacttttttaaaggccctaaacttccaggactgcaaatgaccacttcagatttatacccaacaagattctaccctgacatccccctagtatttcaaaataccactcaaatgtttttcatccagttaatgtagcttaattatttaaagcaaggcactgaaaatgcctagatgggtccgcaaaaccccataaacatagaagtttggtcctggcctttttatgaattctcagtaaaattacacatacaagcatccccgccccagtgagaatgccctccagatcacctggttcaaaagaaggaggtatcaagcacgcataaacgcagctcaaaacactttgctcgaccacacccctacgggaaacagcagtgataaattttaattcataagtgaaagtatgactaacctatacaatatttagggttggtaaattttgtgccagccaccgcggccatacgattaacccaagctaataaaactcggcataaagagtgtttaaggtcttcagtcaacaaagttaagctctatctaaatcgtaaaaatctccagctgaaataaaatatactacgaaagggactttaatgtcctgaggacacaacagctaaggcacaaactgggattagaaaccccactatgcttacacaaatagttatattaacaagactgttcgccagagtactacatgcagcagcttaaaactcaaaggacttggcggtgctttatagccttctagaggagccggttctataattgataaaccccgatatacctcaccatctcttgtcactcagcctatataacaccagcttcagcaaaccctaatatatatatatatatatatatatatatatatatatatatatatatatatatatagtaaacacaagtatgcactaggtcaaggtgtagtccatgggatggtaagaaatgggctacattttctacatccagaaatatctcacaataaccttcatgaaatctaaatgttcgaagaggatttagtagtaaatcaagaacagagtgcttgattgaataaggccataaggcaagcacacaagcccgtcaccctcttcaagtagtgctctagaaatcactattattaataattgcttacacacatacagaggagataaatcgtaacacggtaagtgtactggaaagtgcacctggataaaccaaagtgtagcttaacccaaagcactcggcttacacccggaagatttcattacaacctgatcgctttgagccagctccagctccaagccttgctaaaaaatattattagaactacttaaatcaaaccatttaccctcgacaaaagtataggagatagaaattacttattctggtgcaatagatatagtaccgtaagggaacaatgaaagaactatatcaagcaccaaaaagcaaagacaaatccttgcatcttttgaataatgaattaactagaataaacttcacaaagagagctctagccaagtcccccaaaatcagaggagcttctccagaacagctagaagagtacactcatttatgtggcaaaatagtgagaagattcattagtagcagtgacaagcctacggaggctggtgatagctgattgtccaaggtagaattttagttcaactttaaacttaacctacagaattacttaatcctcctgtaagtttaactgttaaagggggacggatcttcagatactagaaaataaccgtcctatagagagtaaaagattttaccaccataattggcctaaaagcagccaccaattaagaaagcgtttaagctcaacatctgactaacttcatttctaatcaccctgttaaactcctaatattacattggactaatctattattcagtagaagcaataatgttagtgtaagtaacattaagacattatccattgcataagcttacatcagaccagaataatccactgacagttaacaacctaatattaacaaatgattaatagacatcttattatctttattttaacccaatacagtcatgctctaaggaaagattacaaaaagtaaaaggaactcggcacatttcaccccatctctctaccaaaaacatcacccctagcattgctagtattagaggcactgcctgctcagtgacatatgtttaagggttgcggtatcctgaacttgcaaaggtagcataatcacttgttccctaagtagggacttgtatgaatggccacaccagggtttagctgtctcttactttcaaccagtgaaattgacctacctatgaagaggcgggtataaataaataggagaagaccctgtggagcttgaattcattaatgcaaatagattcaaacaagccaacaggccccaatgtatcatccctgcattaaaaattttggttggggtggccgggcacagtggctcacgcctgtaatcccagcactttgggaggccgaggtgggtggatcacgaggtcaggagatcgagaccatcctggctaacatagtaaaaccctgtatctactaaaaatacaaaaaattagccgggtgtggtggcacatgcctgtagtcccagctacccaggaggatgaggcaggagaatggcatgaacctgggaagcagagcttgcagtgagcggagatggtgccactgcactccagcctgagagacagagtgagactctgtcttaaaaaaaaaaaaaattggttggggtgaccttggagcataattcaacctccgaaacgacttaaactaagaccgcactagtgtaagtcagttattacacattgacccaataattctatcaacaggataagtgaccctagggttaagagtgcaatcctattctagcatccatatcaacaacagggtttacgaccttgatgttggatcgggacatcctaaatggtgtagccgctattaagggatcatttgttcaatgattaaagtccttcgtgatctgagttcagaccagagcaatccaggttggtttctatctatttagcatttttcccagtatgaaaggatatgagaaaccgggcccacttcacaaagtgcccttacaagactaggatttttacacaatatgctattggttactgagtgctattgtagaaccggtgcccaggtcttataaatttcaggttcttatgctttccactaagctgcattgcccttctccttttttaaaattttttaaattaatttatttatttatttatttatttttggctccatcctacagactgtctgggagttgtggtacagatattttcagccatatttatggtagtttcccacctcacttgaggtctgtgggtagcaaaagagaaaagttagctttttttgccttttccatgccctcctgtttcttcactaaaccacattcaataaatgatctaggagcttttacaatgctccatgtacaagaacctcacagaggaattacacacagttcctccttccagagagctctccatatattacgagatcaatttggcaaagagaattacaataaaatgcagaagtgctgtgagagagttgtgaatggaatgatgtggaaacacatacacttatatattgaattctatcctaagaagttaggaaaagttttcagtaagagttggcatttgaactgaatcttacaggaagaaagtatggtaagataattagaggaggatgtgataaaaacgaggtaatcaaagtcacattgaaatgtgtgaatttggtggaaagtcactagttgttgaaggagagaggtagacaggaataacgtaaaagacaggagccaggagaagtagatttaaactagatcatgcagaattatatacaagactaggatttttacacaatatgttataagcaagtacaagtaagtgatgttaattaggtggattgaaataatggttgcaagatagaggtgatagagaaattacagatatattatgacaatgatataaagaataaaattgagtaaaaaaatagaaagctgttaaacataccagagaaattattaaggttgaattaaggtagcaggaacaaaaaagaatttcatgtaagaaaaatcttcagatagtattgaaaaattcatatactgactagatacaagaataag
